United States Patent
Cleaver et al.

(10) Patent No.: US 12,037,602 B2
(45) Date of Patent: *Jul. 16, 2024

(54) METHODS AND COMPOSITIONS FOR MODULATING A GENOME

(71) Applicant: Flagship Pioneering Innovations VI, LLC, Cambridge, MA (US)

(72) Inventors: Stephen Hoyt Cleaver, Boston, MA (US); Barrett Ethan Steinberg, Somerville, MA (US); Jacob Rosenblum Rubens, Cambridge, MA (US); Robert James Citorik, Somerville, MA (US); William Edward Salomon, West Roxbury, MA (US); Zi Jun Wang, Arlington, MA (US)

(73) Assignee: Flagship Pioneering Innovations VI, LLC, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/467,428

(22) Filed: Sep. 14, 2023

(65) Prior Publication Data

US 2024/0084333 A1      Mar. 14, 2024

Related U.S. Application Data

(63) Continuation of application No. 17/929,455, filed on Sep. 2, 2022, which is a continuation of application No. PCT/US2021/020943, filed on Mar. 4, 2021.

(60) Provisional application No. 63/035,674, filed on Jun. 5, 2020, provisional application No. 62/985,264, filed on Mar. 4, 2020.

(51) Int. Cl.
| | | |
|---|---|---|
| *C12N 15/90* | (2006.01) | |
| *C12N 9/12* | (2006.01) | |
| *C12N 9/22* | (2006.01) | |
| *C12N 15/11* | (2006.01) | |

(52) U.S. Cl.
CPC ......... *C12N 15/907* (2013.01); *C12N 9/1276* (2013.01); *C12N 9/22* (2013.01); *C12N 15/11* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | |
|---|---|---|
| 6,693,086 B1 | 2/2004 | Dow et al. |
| 8,889,418 B2 | 11/2014 | Zhang et al. |
| 10,113,163 B2 | 10/2018 | Liu et al. |
| 11,447,770 B1 | 9/2022 | Liu et al. |
| 2003/0121063 A1 | 6/2003 | Kazazian et al. |
| 2007/0037759 A1 | 2/2007 | Deininger et al. |
| 2011/0045591 A1 | 2/2011 | Schumann et al. |
| 2011/0059502 A1 | 3/2011 | Chalasani |
| 2011/0171729 A1 | 7/2011 | Wang et al. |
| 2014/0113375 A1 | 4/2014 | Liu et al. |
| 2014/0273234 A1 | 9/2014 | Zhang et al. |
| 2014/0315985 A1 | 10/2014 | May et al. |
| 2014/0349400 A1 | 11/2014 | Jakimo et al. |
| 2017/0275665 A1* | 9/2017 | Silas ..................... C12P 19/34 |
| 2018/0298391 A1 | 10/2018 | Jakimo et al. |
| 2019/0055543 A1 | 2/2019 | Tran et al. |
| 2019/0169639 A1 | 6/2019 | Zhang et al. |
| 2019/0177735 A1 | 6/2019 | Sederoff et al. |
| 2020/0109398 A1 | 4/2020 | Rubens et al. |
| 2020/0248155 A1 | 8/2020 | Halperin et al. |
| 2022/0396813 A1 | 12/2022 | Feala et al. |
| 2023/0131847 A1 | 4/2023 | Rubens et al. |
| 2023/0235358 A1 | 7/2023 | Citorik et al. |
| 2023/0242899 A1 | 8/2023 | Steinberg et al. |
| 2023/0272430 A1 | 8/2023 | Bothmer et al. |
| 2023/0332184 A1 | 10/2023 | Rubens et al. |
| 2023/0348939 A1 | 11/2023 | Bothmer et al. |
| 2024/0002822 A1 | 1/2024 | Altshuler et al. |
| 2024/0002886 A1 | 1/2024 | Altshuler et al. |
| 2024/0018551 A1 | 1/2024 | Altshuler et al. |
| 2024/0026324 A1 | 1/2024 | Altshuler et al. |
| 2024/0035049 A1 | 2/2024 | Bothmer et al. |
| 2024/0042058 A1 | 2/2024 | Citorik et al. |
| 2024/0076638 A1 | 3/2024 | Altshuler et al. |
| 2024/0076698 A1 | 3/2024 | Cleaver et al. |

FOREIGN PATENT DOCUMENTS

| | | |
|---|---|---|
| EP | 1700914 A1 | 9/2006 |
| EP | 3448990 B1 | 6/2021 |
| WO | 2003064644 A1 | 8/2003 |
| WO | 2014093718 A1 | 6/2014 |
| WO | 2014150624 A1 | 9/2014 |
| WO | 2015035139 A2 | 3/2015 |
| WO | 2015191693 A2 | 12/2015 |
| WO | 2016028843 A2 | 2/2016 |

(Continued)

OTHER PUBLICATIONS

Kojima et al. Recent Expansion of a New Ingi-Related Clade of Vingi non-LTR Retrotransposons in Hedgehogs Mol. Biol. Evol. 28(1):17-20. 2011 (Year: 2011).*

Fujiwara H., Site-specific non-LTR retrotransposons. ASMscience. org/MicrobiolSpectrum, 2015, pp. 1-16. (Year: 2015).

Galantou RN., Cellular factors controlling human L1 retrotransposition. Ph.D. Dissertation, 2017, Universite Cote D'Azur, France, pp. 1-175. (Year: 2017).

García-Rodríguez et al., Use of the computer-retargeted group II intron Rmint1 of Sinorhizobium meliloti for gene targeting, RNA Biology (2014) vol. 11, No. 4, pp. 391-401.

Garneau et al., "The CRISPR-Cas bacterial immune system cleaves bacteriophage and plasmid DNA," Nature (2010) vol. 468, pp. 67-71.

(Continued)

*Primary Examiner* — Celine X Qian
*Assistant Examiner* — Tiffany Nicole Grooms
(74) *Attorney, Agent, or Firm* — K&L Gates LLP

(57) ABSTRACT

Methods and compositions for modulating a target genome are disclosed.

26 Claims, 16 Drawing Sheets

Specification includes a Sequence Listing.

(56) References Cited

FOREIGN PATENT DOCUMENTS

| | | | |
|---|---|---|---|
| WO | 2016036754 A1 | 3/2016 | |
| WO | 2016065364 A1 | 4/2016 | |
| WO | 2016201047 A1 | 12/2016 | |
| WO | 2016205728 A1 | 12/2016 | |
| WO | 2017059241 A1 | 4/2017 | |
| WO | 2017123609 A1 | 7/2017 | |
| WO | 2017151719 A1 | 9/2017 | |
| WO | 2017173004 A1 | 10/2017 | |
| WO | 2017180711 A1 | 10/2017 | |
| WO | 2017186550 A1 | 11/2017 | |
| WO | 2017197238 A1 | 11/2017 | |
| WO | 2018027078 A1 | 2/2018 | |
| WO | 2018049168 A1 | 3/2018 | |
| WO | 2018071663 A1 | 4/2018 | |
| WO | 2018089860 A1 | 5/2018 | |
| WO | 2018165629 A1 | 9/2018 | |
| WO | 2018176009 A1 | 9/2018 | |
| WO | 2018218166 A1 | 11/2018 | |
| WO | 2019051097 A1 | 3/2019 | |
| WO | 2020014528 A1 | 1/2020 | |
| WO | 2020047124 A1 | 3/2020 | |
| WO | 2020082076 A1 | 4/2020 | |
| WO | 2020186262 A1 | 9/2020 | |
| WO | 2020191233 A1 | 9/2020 | |
| WO | 2020191234 A1 | 9/2020 | |
| WO | 2020191239 A1 | 9/2020 | |
| WO | 2020191241 A1 | 9/2020 | |
| WO | 2020191242 A1 | 9/2020 | |
| WO | 2020191243 A1 | 9/2020 | |
| WO | 2020191245 A1 | 9/2020 | |
| WO | 2020191246 A1 | 9/2020 | |
| WO | 2020191248 A1 | 9/2020 | |
| WO | 2020191249 A1 | 9/2020 | |
| WO | 2020191171 A9 | 10/2020 | |
| WO | 2020191153 A9 | 11/2020 | |
| WO | 2020252361 A1 | 12/2020 | |
| WO | 2021016075 A1 | 1/2021 | |
| WO | 2021062410 A2 | 4/2021 | |
| WO | 2021080922 A1 | 4/2021 | |
| WO | 2021102390 A1 | 5/2021 | |
| WO | 2021138469 A1 | 7/2021 | |
| WO | 2021/178709 A1 | 9/2021 | |
| WO | 2021178717 A2 | 9/2021 | |
| WO | 2021178720 A2 | 9/2021 | |
| WO | 2021178898 A9 | 11/2021 | |
| WO | 2021226558 A1 | 11/2021 | |
| WO | 2021248102 A1 | 12/2021 | |
| WO | 2022150790 A2 | 7/2022 | |
| WO | 2022173830 A1 | 8/2022 | |
| WO | 2022212926 A1 | 10/2022 | |
| WO | 2022256714 A2 | 12/2022 | |
| WO | 2023004439 A2 | 1/2023 | |
| WO | 2023283092 A1 | 1/2023 | |
| WO | 2023015318 A2 | 2/2023 | |
| WO | 2023070062 A2 | 4/2023 | |
| WO | 2023086389 A1 | 5/2023 | |
| WO | 2023086558 A1 | 5/2023 | |
| WO | 2023086842 A1 | 5/2023 | |
| WO | 2023096847 A2 | 6/2023 | |
| WO | 2023096977 A2 | 6/2023 | |
| WO | 2023192655 A2 | 10/2023 | |

OTHER PUBLICATIONS

George et al., "Analysis of the 5' Junctions of R2 Insertions With the 28S Gene-Implications for Non-LTR Retrotransposition," Genetics (1996) vol. 142, pp. 853-863.
Gilbert et al., "Multiple Fates of L1 Retrotransposition Intermediates in Cultured Human Cells," Molecular and Cellular Biology (2005) vol. 25, No. 17, pp. 7780-7795.
Gladyshev-Rotifer et al., "rDNA-specific R9 retrotransposable elements generate an exceptionally long target site duplication upon insertion," Gene (2009) vol. 448, pp. 145-150.
Goodier et al., "Restricting retrotransposons—a review," Mobile DNA (2016) vol. 7, Article 16, 30 pages.
Govindaraju et al., "Endonuclease domain of non-LTR retrotransposons: loss-of-function mutants and modeling of the R2Bm endonuclease," Nucleic Acids Researh (2016) vol. 44, No. 7, pp. 3276-3287.
Govindraju A., Protein/Nucleic-Acid Structure and Sequence Requirements for Specifying Second-Strand Cleavage and Second-Strand Synthesis During the Integration of the Site-Specific Line R2Bm. Ph.D. Dissertation, The Univ. Texas, Arlington, 2017, pp. 1-101. (Year: 2017).
Ha et al., "Exosomes as therapeutic drug carriers and delivery vehicles across biological membranes: current perspectives and future challenges," Acta Pharmaceutica Sinica B (2016) vol. 6, Issue 4, pp. 287-296.
Haack et al., "Cryo-EM Structures of a Group II Intron Reverse Splicing into DNA," Cell (2019) vol. 178, pp. 612-623.
Halperin et al., "CRISPR-guided DNA polymerases enable diversification of all nucleotides in a tunable window," Nature (2018) vol. 560, No. 7717, pp. 248-252.
Han et al., "Circular retrotransposition products generated by a LINE retrotransposon," Nucleic Acids Research (2012) vol. 40, No. 21, pp. 10866-10877.
Han, "Non-long terminal repeat (non-LTR) retrotransposons- mechanisms, recent developments, and unanswered questions," Mobile DNA (2010) vol. 1, Article 15, 12 pages.
Herschhorn et al., "Retroviral reverse transcriptases," Cellular and Molecular Life Sciences (2010) vol. 67, pp. 2717-2747.
Hockemeyer et al., "Efficient targeting of expressed and silent genes in human ESCs and iPSCs using zinc-finger nucleases," Nature Biotechnology 27(9): 851-857, 2009.
Holstein et al., Efficient Non-viral Gene Delivery into Human Hematopoietic Stem Cells by Minicircle Sleeping Beauty Transposon Vectors. Mol. Therapy., 2018, vol. 26(4): 1137-1153. (Year: 2018).
Hwang et al., "Web-based design and analysis tools for CRISPR base editing," BMC Bioinformatics (2018) vol. 19, Article 542, 7 pages.
International Search Report and Written Opinion issued in PCT/US2019/048607 mailed on Jan. 15, 2020, 15 pages.
Ivancevic et al., "LINEs between Species- Evolutionary Dynamics of LINE-1 Retrotransposons across the Eukaryotic Tree of Life," Genome Biology and Evolution (2016) vol. 8, No. 11, pp. 3301-3322.
Ivics et al., "Molecular Reconstruction of Sleeping Beauty, a Tc1-like Transposon from Fish, and Its Transposition in Human Cells," Cell 1997, vol. 91, pp. 501-510.
Jamburuthugoda et al., "The Reverse Transcriptase Encoded by the Non-LTR Retrotransposon R2 Is as Error-Prone as That Encoded by HIV-1," Journal of Molecular Biology (2011).
Jinek et al., "A Programmable Dual-RNA-Guided DNA Endonuclease in Adaptive Bacterial Immunity," Science (2012) vol. 337, pp. 816-821 and Supplementary Materials.
Jurka et al., "Sequence patterns indicate an enzymatic involvement in integration of mammalian retroposons," Proceedings of the National Academy of Sciences (1997) vol. 94, pp. 1872-1877.
Kajikawa et al., "A new mechanism to ensure integration during LINE retrotransposition—A suggestion from analyses of the 5? extra nucleotides," Gene (2012) vol. 505, pp. 345-351.
Kawashima et al., "A novel target-specific gene delivery system combining baculovirus and sequence-specific long interspersed nuclear elements," Virus Research (2007) vol. 127, pp. 49-60.
Kelley et al., "The Phyre2 web portal for protein modeling, prediction and analysis," Nature Protocols (2015) vol. 10, No. 6, pp. 845-858.
Kierzek et al., "Secondary structures for 5' regions of R2 retrotransposon RNAs reveal a novel conserved pseudoknot and regions that evolve under different constraints," J Mol Biol (2009) vol. 390, No. 3, pp. 428-442.
Kleinstiver et al., "Engineered CRISPR-Cas9 nucleases with altered PAM specificities," Nature (2015) vol. 523, pp. 481-485.
Klompe et al., "Transposon-encoded CRISPR-Cas systems direct RNA-guided DNA integration," Nature (2019) vol. 571, No. 7764, pp. 219-225.

(56) References Cited

OTHER PUBLICATIONS

Kojima et al., "The Wide Distribution and Change of Target Specificity of R2 Non-LTR Retrotransposons in Animals," PLOS One (2016) vol. 11, No. 9, Article e0163496, 16 pages.
Kojima et al., Recent Expansion of a New Ingi-Related Clade of Vingi non-LTR Retrotransposons in Hedgehog, Molecular Biology and Evolution (2011) vol. 28, No. 1, pp. 17-20.
Komor et al., "Programmable editing of a target base in genomic DNA without double-stranded DNA cleavag," Nature (2016) vol. 523, pp. 420-424.
Krzywkowski et al., "Limited reverse transcriptase activity of phi29 DNA polymerase," Nucleic Acids Research (2018) vol. 46, No. 7, pp. 3625-3632.
Kuroki-Kami et al., "Targeted gene knockin in zebrafish using the 28S rDNA-specific non-LTR-retrotransposon R2Ol," Mobile DNA (2019) vol. 10, Article 23, 12 pages.
Kurzynska-Kokorniak et al., "DNA-directed DNA Polymerase and Strand Displacement Activity of the Reverse Transcriptase Encoded by the R2 Retrotransposon," Journal of Molecular Biology (2007) vol. 374, pp. 322-333.
Landrum et al., "ClinVar: public archive of interpretations of clinically relevant variants," Nucleic Acids Research (2015) vol. 44, pp. D862-D868.
Larson et al., "Spliced integrated retrotransposed element (SpIRE) formation in the human genome," PLoS Biology (2018) vol. 16, No. 3, Article e2003067, 37 pages.
Lathe et al., "A single lineage of r2 retrotransposable elements is an active, evolutionarily stable component of the Drosophila rDNA locus," Molecular Biology and Evolution (1997) vol. 14, No. 12, pp. 1232-1241.
Letunic et al., "20 Years of the SMART protein domain annotation resource," Nucleic Acids Research (2018) vol. 46, pp. D493-D496.
Li et al., "A Review of the Structure, Preparation, and Application of NLCs, PNPs, and PLNs," Nanomaterials 7, 122, 2017.
Lim et al., "Specific insertions of zinc finger domains into Gag-Pol yield engineered retroviral vectors with selective integration properties," PNAS (2010) vol. 107, No. 28, pp. 12475-12480.
Liu et al., "Computational approaches for effective CRISPR guide RNA design and evaluation," Computational and Structural Biotechnology Journal (2020): vol. 18, pp. 35-44.
Luan et al., "RNA Template Requirements for Target DNA-Primed Reverse Transcription by the R2 Retrotransposable Element," Molecular and Cellular Biology (1995) vol. 15, No. 7, pp. 3882-3891.
Lubelsky et al., "Sequences enriched in Alu repeats drive nuclear localization of long RNAs in human cells," Nature 555 (107-111), 2018.
Mahbub et al., "Globular domain structure and function of restriction-like-endonuclease LINEs—similarities to eukaryotic splicing factor Prp8," Mobile DNA (2017) vol. 8, Article 16, 15 pages.
Maita et al., "Crystal Structure of the Endonuclease Domain Encoded by the Telomere-specific Long Interspersed Nuclear Element, TRAS1," Journal of Biological Chemistry (2004) vol. 279, No. 39, pp. 41607-41076.
Malik et al., "Ribonuclease H evolution in retrotransposable elements," Cytogenetic and Genome Research (2005) vol. 110, pp. 392-401.
Mastroianni et al., "Group II Intron-Based Gene Targeting Reactions in Eukaryotes," PLoS One (2008) vol. 3, Issue 9, Article e3121, 15 pages.
63rd Fujihara Seminar, "A new horizon of retroposon research," Jul. 31-Aug. 3, 2012, Kyoto, Japan, program booklet with abstracts, 90 pages.
[No Author Listed] Invitrogen—"ProQuest Two-Hybrid System: A sensitive method for detecting protein-protein interactions," User Manual, Version A (2005) 116 pages.
[No Author Listed] Rice University Events Listing for Aug. 3, 2018: Thesis Defense by Gia Longsworth, "Expanding the Enzymatic Activity of the Programmable Endonuclease Cas9 in Zebrafish," with Abstract, first posted on Aug. 3, 2018.

Ade et al., "Evaluating different DNA binding domains to modulate L1 ORF2p-driven site-specific retrotransposition events in human cells," Gene (2018) vol. 642, pp. 188-198.
Altenbuchner, "Editing of the Bacillus subtilis Genome by the CRISPR-Cas9 System," Applied and Environmental Microbiology (2016) vol. 82, No. 17, pp. 5421-5427.
An et al., "Plug and play modular strategies for synthetic retrotransposons," Methods (2009) vol. 49, pp. 227-235.
Anand et al., "Structure based design of protein linkers for zinc finger nuclease," FEBS Letters, 587:19, 2013.
Anzalone et al., Search-and replace genome editing without double-strand breaks or donor DNA, Nature (2019) vol. 576, No. 7785, pp. 149-157.
Babushok et al., "Progress in understanding the biology of the human mutagen LINE-1," Human Mutation (2007) vol. 28, No. 6, pp. 527-539.
Bailey et al., "The MEME Suite," Nucleic Acids Research (2015) vol. 43, pp. W39-W49.
Bao et al., "Repbase Update, a database of repetitive elements in eukaryotic genomes," Mobile DNA (2015) vol. 6, Article 11, 6 pages.
Barnes et al., "Recombinant R2 Retrotransposon for Targeted Integration of Large Genetic Cassettes into the Human Genome," Molecular Therapy (2019) vol. 27, No. 4S1, Abstract 216, p. 109.
Bateman et al., "UniProt—the universal protein knowledgebase," Nucleic Acids Research (2017) vol. 45, pp. D158-D169.
Belfort et al., "Group II Intron RNPs and Reverse Transcriptases—From Retroelements to Research Tools," Cold Spring Harbor Perspectives in Biology (2019) 11:a032375, 17 pages.
Benitez-Guijarro et al., "RNase H2, mutated in Aicardi-Goutieres syndrome, promotes LINE-1 retrotransposition," The EMBO Journal (2018) vol. 37, Article e98506, 22 pages.
Bibillo et al., "High Processivity of the Reverse Transcriptase from a Non-long Terminal Repeat Retrotransposon," J Biol Chem (2002) vol. 277, No. 38, pp. 34836-34845.
Bibillo et al., "The Reverse Transcriptase of the R2 Non-LTR Retrotransposon: Continuous Synthesis of cDNA on Non-continuous RNA Templates," J Mol Biol (2002) vol. 316, pp. 459-473.
Birbach et al., "Cytosolic, nuclear and nucleolar localization signals determine subcellular distribution and activity of the NF-kappaB inducing kinase NIK," Journal of Cell Science, 117 (3615-3624), 2004.
Boissinot et al., "L1 (LINE-1) Retrotransposon Evolution and Amplification in Recent Human History," Molecular Biology and Evolution 2000, 915-928.
Bono et al., "Connecting genotypes, phenotypes and fitness: harnessing the power of CRISPR/Cas9 genome editing," Molecular Ecology (2015) vol. 24, pp. 3810-3822.
Burke et al., "R4, a non-LTR retrotransposon specific to the large subunit rRNA genes of nematodes," Nucleic Acids Res. 23, 4628-34 (1995).
Burke et al., "Sequence relationship of retrotransposable elements R1 and R2 within and between divergent insect species," Molecular Biology and Evolution (1993) vol. 10, No. 1, pp. 163-185.
Burke et al., "The domain structure and retrotransposition mechanism of R2 elements are conserved throughout arthropods," Molecular Biology and Evolution (1999) vol. 16, No. 4, pp. 502-511.
Candales et al., "Database for bacterial group II introns," Nucleic Acids Research (2012) vol. 40, pp. D187-D190.
Chan et al., "Crystal structure of a group II intron in the pre-catalytic state," Nature Structural & Molecular Biology (2012) vol. 19, No. 5, pp. 555-557.
Chen et al., "Fusion Protein Linkers: Property, Design and Functionality," Adv Drug Deliv Rev (2013) 65(10): 1357-1369.
Chillón et al., "In vitro characterization of the splicing efficiency and fidelity of the Rmint1 group II intron as a means of controlling the dispersion of its host mobile element," RNA (2014) vol. 20, No. 12, pp. 2000-2010.
Choi et al., "Interplay between RNASEH2 and MOV10 controls LINE-1 retrotransposition," Nucleic Acids Research (2018) doi: 10/1093/nar/gkx1312, 15 pages.

(56) References Cited

OTHER PUBLICATIONS

Choudhuri, "Bioinformatics for Beginners: Genes, Genomes, Molecular Evolution, Databases and Analytical Tools," Elsevier (2014) p. 64.
Christensen et al., "Footprint of the Retrotransposon R2Bm Protein on its Target Site Before and After Cleavage," Journal of Molecular Biology (2004) vol. 336, No. 5, pp. 1035-1045.
Christensen et al., "R2 Target-Primed Reverse Transcription—Ordered Cleavage and Polymerization Steps by Protein Subunits Asymmetrically Bound to the Target DNA," Molecular and Cellular Biology (2005) vol. 25, No. 15, pp. 6617-6628.
Christensen et al., "RNA from the 5' end of the R2 retrotransposon controls R2 protein binding to and cleavage of its DNA target site," Proceedings of the National Academy of Sciences (2006) vol. 103, No. 47, pp. 17602-17607.
Christensen et al., "Role of the Bombyx mori R2 element N-terminal domain in the target-primed reverse transcription (TPRT) reaction," Nucleic Acids Research (2005) vol. 33, No. 20, pp. 6461-6468.
Cordaux et al., "The impact of retrotransposons on human genome evolution," Nature Reviews Genetics (2009) Nature Reviews vol. 10, pp. 691-703.
Cost et al., "Targeting of Human Retrotransposon Integration Is Directed by the Specificity of the L1 Endonuclease for Regions of Unusual DNA Structure," Biochemistry (1998) vol. 37, pp. 18081-18093.
Craig et al., Editors, "Mobile DNA III," ASM Press (2015) pp. 1-1346.
Denli et al., "Primate-Specific ORF0 Contributes to Retrotransposon-Mediated Diversity," Cell (2015) vol. 163, No. 3, pp. 583-593.
Dewannieux et al., "Role of poly(A) tail length in Alu retrotransposition," Genomics (2005) vol. 86, pp. 378-381.
Doucet et al., "A 3' Poly(A) Tract Is Required for LINE-1 Retrotransposition," Molecular Cell (2015) vol. 60, pp. 728-741.
Eickbush et al., "Integration of Bombyx mori R2 Sequences into the 28S Ribosomal RNA Genes of Drosophila melanogaster," Molecular and Cellular Biology (2000) vol. 20, No. 1, pp. 213-223.
Eickbush et al., "Integration, Regulation, and Long-Term Stability of R2 Retrotransposons," Microbiology Spectrum (2015) vol. 3, No. 2, MDNA3-011, 20 pages.
Eickbush et al., "R2 and R2-R1 hybrid non-autonomous retrotransposons derived by internal deletions of full-length elements," Mobile DNA (2012) vol. 3, Article 10, 15 pages.
Eickbush et al., "R2 Retrotransposons Encode a Self-Cleaving Ribozyme for Processing from an rRNA Cotranscript," Molecular and Cellular Biology (2010) vol. 30, No. 13, pp. 3142-3150.
Ellefson et al., "Synthetic evolutionary origin of a proofreading reverse transcriptase," Science (2016) vol. 352, Issue 6293, pp. 1590-1593.
Enyeart et al., "Biotechnological applications of mobile group II introns and their reverse transcriptases—gene targeting, RNA-seq, and non-coding RNA analysis," Mobile DNA (2014) vol. 5, Article 2, 19 pages.
Faure et al., "CRISPR-Cas in mobile genetic elements: counter-defence and beyond," Nat Rev Microbiol (2019) vol. 17, No. 8, pp. 513-525.
Finn et al., "InterPro in 2017—beyond protein family and domain annotations," Nucleic Acids Res (2017) vol. 45, No. D1, pp. D190-D199.
Finnegan, "Transposable elements—How non-LTR retrotransposons do it," Current Biology (1997) vol. 7, pp. R245-R248.
Flasch et al., "Genome-wide de novo L1 Retrotransposition Connects Endonuclease Activity with Replication," Cell (2019) vol. 177, p. 877-851.
Fujimoto et al., "Integration of the 5' end of the retrotransposon, R2Bm, can be complemented by homologous recombination," Nucleic Acids Research (2004) vol. 32, No. 4, pp. 1555-1565.
Meers et al., "DNA repair by RNA: Templated, or not templated, that is the question," DNA Repair (2016) vol. 44, pp. 17-21.

Mills et al., "Which transposable elements are active in the human genome," Trends in Genetics (2007) vol. 23, No. 4, pp. 183-191.
Mita et al., "LINE-1 protein localization and functional dynamics during the cell cycle," eLife (2018) vol. 7, Article e30058, 35 pages.
Miyagawa et al., "Identification of cis- and trans-acting factors involved in the localization of MALAT-1 noncoding RNA to nuclear speckles," RNA (2012) vol. 18, pp. 738-751.
Miyoshi et al., "Poly(ADP-Ribose) Polymerase 2 Recruits Replication Protein A to Sites of LINE-1 Integration to Facilitate Retrotransposition," Molecular Cell (2019) vol. 75, pp. 1286-1298.
Mohr et al., "A Reverse Transcriptase-Cas1 Fusion Protein Contains a Cas6 Domain Required for Both CRISPR RNA Biogenesis and RNA Spacer Acquisition," Molecular Cell (2018) vol. 72 pp. 700-714.
Moran et al., "High Frequency Retrotransposition in Cultured Mammalian Cells," Cell (1996) vol. 87, pp. 917-927.
Moss et al., "The R2 retrotransposon RNA families," RNA Biology (2011) vol. 8, No. 5, pp. 714-718.
Mukha et al., "Endonuclease domain of the Drosophila melanogaster R2 non-LTR retrotransposon and related retroelements—a new model for transposition," Frontiers in Genetics (2013) vol. 4, Article 63, 15 pages.
Naldini et al., "In Vivo Gene Delivery and Stable Transduction of Nondividing Cells by a Lentiviral Vector" Science (1996) vol. 272 pp. 263-267.
Nami et al., "Strategies for In Vivo Genome Editing in Nondividing Cells," Trends in Biotechnology (2018) vol. 36, No. 8, pp. 770-786.
Nichuguti et al., "Both the Exact Target Site Sequence and a Long Poly(A) Tail Are Required for Precise Insertion of the 18S Ribosomal DNA-Specific Non-Long Terminal Repeat Retrotransposon R7Ag," Molecular and Cellular Biology (2016) vol. 36, No. 10, pp. 1494-1508.
Nuñez et al., "Cas1-Cas2 complex formation mediates spacer acquisition during CRISPR-Cas adaptive immunity," Nature Structural & Molecular Biology (2014) vol. 21, No. 6, pp. 528-534.
Opposition Brief filed in European Patent No. 3448990, mailed Mar. 15, 2022, 66 pages.
Osanai et al., "Essential Motifs in the 3' Untranslated Region Required for Retrotransposition and the Precise Start of Reverse Transcription in Non-Long-Terminal-Repeat Retrotransposon SART1," Molecular and Cellular Biology (2004) vol. 24, No. 18, pp. 7902-7913.
Ostertag et al., "Biology of Mammalian L1 Retrotransposons" Annual Review of Genetics (2001) vol. 35, pp. 501-538.
Ostertag et al., "Twin Priming—A Proposed Mechanism for the Creation of Inversions in L1 Retrotransposition," Genome Research (2001) vol. 11, pp. 2059-2065.
Paix et al., "Scalable and Versatile Genome Editing Using Linear DNAs with Microhomology to Cas9 Sites in Caenorhabditis elegans," Genetics (2014) vol. 198, pp. 1347-1356.
Pei et al., "PROMALS3D—a tool for multiple protein sequence and structure alignments," Nucleic Acids Research (2008) vol. 36, No. 7, pp. 2295-2300.
Pellenz et al., "New human chromosomal safe harbor sites for genome engineering with CRISPR/Cas9, TAL effector and homing endonucleases," Human Gene Therapy (2018) doi: 10.1101/396390, 39 pages.
Peters et al., "Recruitment of CRISPR-Cas systems by Tn7-like transposons," PNAS (2017) vol. 114, No. 35, pp. E7358-E7366.
Piskareva et al., "The carboxy-terminal segment of the human LINE-1 ORF2 protein is involved in RNA binding," FEBS Open Bio (2013) vol. 3, pp. 433-437.
Qu et al., "Structure of a group II intron in complex with its reverse transcriptase," Nature Structural & Molecular Biology (2016) vol. 23, No. 6, pp. 549-557.
Ran et al., "Genome engineering using the CRISPR/Cas9 system," Nature Protocols (2013) vol. 8, No. 11, pp. 2281-2308.
Ruminski et al., "Processing and Translation Initiation of Non-long Terminal Repeat Retrotransposons by Hepatitis Delta Virus (HDV)-like Self-cleaving Ribozymes," J Biol Chem (2011) vol. 286, No. 48, pp. 41286-41295.
Ruschak et al. "Secondary structure models of the 3' untranslated regions of diverse R2 RNAs" RNA (2004) vol. 10(6):978-987.

(56) References Cited

OTHER PUBLICATIONS

San Filippo et al., "Characterization of the C-Terminal DNA-binding-DNA Endonuclease Region of a Group II Intron-encoded Protein," Journal of Molecular Biology (2002) vol. 324, pp. 933-951.
Sano et al., "Mutations to create thermostable reverse transcriptase with bacterial family a DNA polymerase from Thermotoga petrophila K4," Journal of Bioscience and Bioengineering (2012) vol. 113, No. 3, pp. 315-321.
Sharma et al., "In vivo genome editing of the albumin locus as a platform for protein; replacement therapy," Blood (2015) vol. 126, No. 15: 1777-1784.
Sharon et al., "Functional Genetic Variants Revealed by Massively Parallel Precise Genome Editing," Cell (2018) vol. 175, pp. 544-557.
Shivram et al., "Targeting novel sites: The N-terminal DNA binding domain of non-LTR retrotransposons is an adaptable module that is implicated in changing site specificities," Mobile Genetic Elements (2011) vol. 1, No. 3, pp. 169-178.
Shukla et al., "High-throughput identification of RNA nuclear enrichment sequences," The EMBO Journal (2018) vol. 37, Article e98452, 11 pages.
Silas et al., Direct CRISPR spacer acquisition from RNA by a natural reverse-transcriptase-Cas1 fusion protein, Science (2016) vol. 351, No. 6276, Article aad4234, 31 pages.
Simon et al., "Retrons and their applications in genome engineering," Nucleic Acids Research (2019) doi: 10.1093/narlgkz865, 13 pages.
Smyshlyaev et al., "Acquisition of an Archaea-like ribonuclease H domain by plant L1 retrotransposons supports modular evolution," Proceedings of the National Academy of Sciences (2013) vol. 110, No. 50, pp. 20140-20145.
Spuch and Navarro, "Liposomes for Targeted Delivery of Active Agents against Neurodegenerative Diseases (Alzheimer's Disease and Parkinson's Disease)," Journal of Drug Delivery, vol. 2011, Article ID 469679, 12 pages, 2011. doi:10.1155/2011/469679 for review.
Stamos et al., "Structure of a Thermostable Group II Intron Reverse Transcriptase with Template-Primer and Its Functional and Evolutionary Implications," Molecular Cell (2017) vol. 68, pp. 926-939.
Strecker et al., "RNA-guided DNA insertion with CRISPR-associated transposases," Science (2019) vol. 365, No. 6448, pp. 48-53.
Su et al., "Human DNA polymerase [eta] has reverse transcriptase activity in cellular environments," J Biol Chem (2019) vol. 294, No. 15, pp. 6073-6081.
Su et al., "Sequence-specific retrotransposition of 28S rDNA-specific Line R2Ol in human cells" RNA (2019 ) vol. 25, pp. 1432-1438.
Sultana et al., "Integration site selection by retroviruses and transposable elements in eukaryotes," Nature Reviews Genetics (2017) doi: 10.1038/nrg.2017.7, 17 pages.
Sultana et al., "The Landscape of L1 Retrotransposons in the Human Genome Is Shaped by Pre-insertion Sequence Biases and Post-insertion Selection," Molecular Cell (2019) vol. 74, pp. 555-570.
Sultana T., Influence of the genomic context on integration site selection by human L 1 retrotransposons. Ph.D. Dissertation, 2016, Universite Cote D'Azur, France, pp. 1-184. (Year: 2016).
Takahashi et al., "Transplantation of target site specificity by swapping the endonuclease domains of two LINES," The EMBO Journal (2002) vol. 21, No. 3, pp. 408-417.
Takasu et al., "Targeted mutagenesis in the silkworm Bombyx mori using zinc finger nuclease mRNA injection," Insect Biochemistry and Molecular Biology 40(10): 759-765, 2010.
Tang et al., "Rewritable multi-event analog recording in bacterial and mammalian cells," Science (2018) vol. 360, No. 6385, eaap8992.
Taylor et al., "Affinity Proteomics Reveals Human Host Factors Implicated in Discrete Stages of LINE-1 Retrotransposition," Cell (2013) vol. 155, pp. 1034-1048.
Templeton et al., "Improved DNA: liposome complexes for increased systemic delivery and gene expression," Nature Biotech, 15:647-652, 1997.
Thompson et al., "Independently derived targeting of the 28S rDNA by A- and D-clade R2 retrotransposons," Mobile Genetic Elements (2011) vol. 1, pp. 29-37.
Trevino et al., "Genome Editing Using Cas9 Nickases," Methods in Enzymology, Eds. Doudna et al. (2014) vol. 546, Chapter 8, pp. 161-174.
Truong et al., "Retrohoming of a Mobile Group II Intron in Human Cells Suggests How Eukaryotes Limit Group II Intron Proliferation," PLoS Genetics (2015) vol. 11, No. 8, Article e1005422, 35 pages.
U.S. Appl. No. 62/263,223, filed Oct. 2, 2015.
U.S. Appl. No. 62/332,099, filed Apr. 13, 2016.
Ustyantsev et al., "Convergence of retrotransposons in oomycetes and plants," Mobile DNA (2017) vol. 8, Article 4, 11 pages.
Wagstaff et al., "Molecular reconstruction of extinct LINE-1 elements and their interaction with nonautonomous elements," Molecular Biology and Evolution (2013) 30(1): 88-99.
Wallace et al., "L1 mobile element expression causes multiple types of toxicity," Gene (2008) vol. 419, pp. 75-81.
Wicker et al., "A unified classification system for eukaryotic transposable elements," Nature Reviews Genetics (2007) vol. 8, pp. 973-982.
Xiong et al., "Functional expression of a sequence-specific endonuclease encoded by the retrotransposon R2Bm," Cell (1988) vol. 55, pp. 235-246.
Xiong et al., "Origin and evolution of retroelements based upon their reverse transcriptase sequences," The EMBO Journal (1990) vol. 9, No. 10, pp. 3353-3362.
Xu et al., "Accuracy and efficiency define Bxb1 integrase as the best of fifteen candidate serine recombinases for the integration of DNA into the human genome," BMC Biotechnology (2013) vol. 13, Article 87, 17 pages.
Yang et al., "Identification and characterization of nuclear and nucleolar localization signals in 58-kDa microspherule protein (MSP58)," Journal of Biomedical Science (2015) vol. 22, Article 33, 15 pages.
Yang et al., "Identification of the endonuclease domain encoded by R2 and other site-specific, non-long terminal repeat retrotransposable elements," PNAS (1999) vol. 96, pp. 7487-7852.
Yasukawa et al., "Next-generation sequencing-based analysis of reverse transcriptase fidelity," Biochemical and Biophysical Research Communications (2017) vol. 492, pp. 147-153.
Zhang et al., "A novel RNA motif mediates the strict nuclear localization of a long noncoding RNA, " Molecular and Cellular Biology 34, 2318-2329 (2014).
Zhang et al., "Genome Editing with mRNA Encoding ZFN, TALEN, and Cas9," Molecular Therapy (2019) vol. 27, No. 4, pp. 735-746.
Zhao et al., "An ultraprocessive, accurate reverse transcriptase encoded by a metazoan group II intron," RNA (2018) 24: 183-195.
Zhao et al., "Crystal structures of a group II intron maturase reveal a missing link in spliceosome evolution," Nature Structural & Molecular Biology (2016) vol. 23, No. 6, pp. 558-567.
Zhu et al., "The iCRISPR Platform for Rapid Genome Editing in Human Pluripotent Stem Cells," Methods in Enzymology, Eds. Doudna et al. (2014) vol. 546, Chapter 11, pp. 215-250.
Zimmerly et al., "A Group II Intron RNA Is a Catalytic Component of a DNA Endonuclease Involved in Intron Mobility," Cell (1995) vol. 83, pp. 529-538.
Zimmerly et al., "An Unexplored Diversity of Reverse Transcriptases in Bacteria," Microbiology Spectrum (2015) vol. 3, No. 2, Article MDNA-0058-2014, 16 pages.
Zimmerly et al., "Evolution of group II introns," Mobile DNA (2015) vol. 6, Article 7, 19 pages.
Zimmerman et al., "A Completely Reimplemented MPI Bioinformatics Toolkit with a New Hhpred Server at its Core," J Mol Biol (2018) vol. 430, pp. 2237-2243.
Zingler et al., "Analysis of 5' junctions of human LINE-1 and Alu retrotransposons suggests an alternative model for 5'—end attachment requiring microhomology-mediated end-joining," Genome Research (2005) vol. 15, pp. 780-789.

(56) References Cited

OTHER PUBLICATIONS

The Sea Urchin Genome Sequencing Consortium et al., "The Genome of the Sea Urchin Strongylocentrotus purpuratus," Science (2006) vol. 314, pp. 941-951.

\* cited by examiner

| Module | Function |
|---|---|
| A: 5' homology arm | The 5' homology arm module is complementary to the DNA sequence 5' to where the GeneWriter system nicks target DNA |
| B: Ribozyme | The ribozyme module is a sub-part of the 5' UTR sequence of the retrotransposase |
| C: 5' UTR | The 5' UTR module is the RNA sequence or interacting moiety that the driver of retrotransposase uses in the process of retrotransposition |
| D: Heterologous object sequence | The heterologous object sequence is an RNA sequence that serves as the template for the GeneWriter polypeptide to insert a desired payload into the targeted genomic location |
| E: 3' UTR | The 3' UTR module is an RNA sequence or interacting moiety that the GeneWriter polypeptide interacts with to bind to the template RNA molecule that is used in whole and/or in part as a template for retrotransposition |
| F: 3' homology arm | The 3' homology arm module is complementary to the DNA sequence 3' to where the GeneWriter system nicks target DNA |

FIG. 6

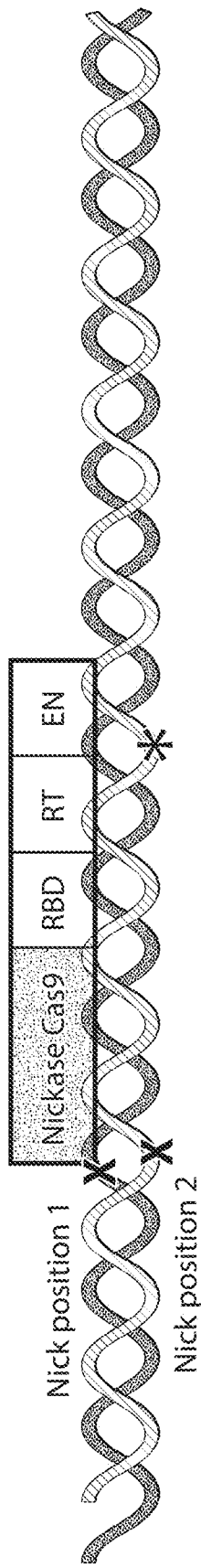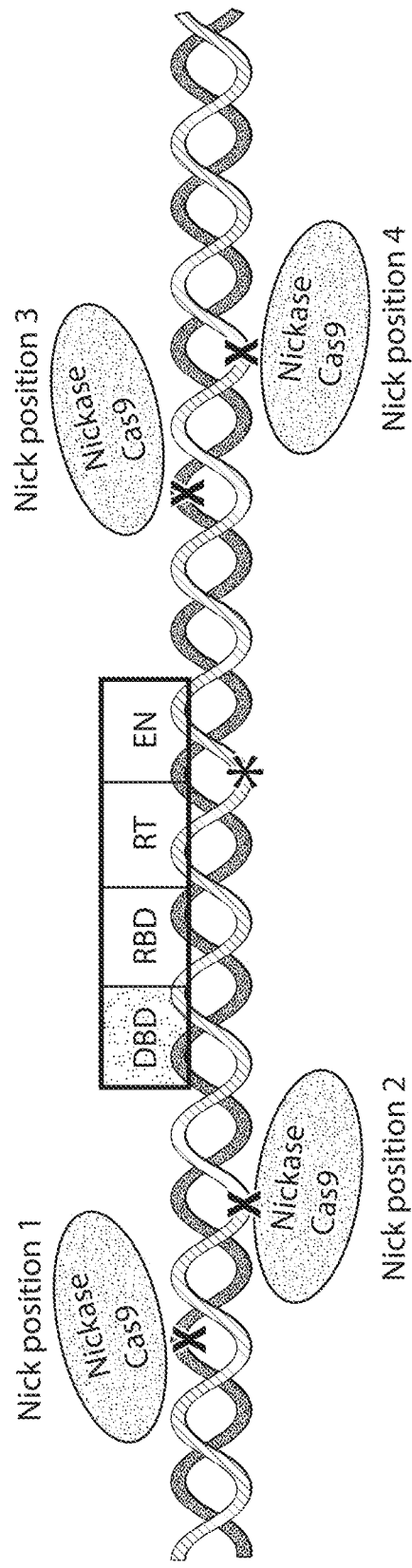
FIG. 7A
FIG. 7B

METHODS AND COMPOSITIONS FOR MODULATING A GENOME

RELATED APPLICATIONS

This application is a continuation of U.S. application Ser. No. 17/929,455, filed Sep. 2, 2022, which is a continuation of International Application No. PCT/US2021/020943, filed Mar. 4, 2021, which claims priority to U.S. Ser. No. 62/985,264 filed Mar. 4, 2020 and U.S. Ser. No. 63/035,674 filed Jun. 5, 2020, the entire contents of each of which is incorporated herein by reference.

SEQUENCE LISTING

The instant application contains a Sequence Listing which has been submitted electronically in XML format and is hereby incorporated by reference in its entirety. Said XML copy, created on Sep. 13, 2023, is named V2065-701022FT_SL.xml and is 4,006,212 bytes in size.

BACKGROUND

Integration of a nucleic acid of interest into a genome occurs at low frequency and with little site specificity, in the absence of a specialized protein to promote the insertion event. Some existing approaches, like CRISPR/Cas9, are more suited for small edits and are less effective at integrating longer sequences. Other existing approaches, like Cre/loxP, require a first step of inserting a loxP site into the genome and then a second step of inserting a sequence of interest into the loxP site. There is a need in the art for improved proteins for inserting sequences of interest into a genome.

SUMMARY OF THE INVENTION

This disclosure relates to novel compositions, systems and methods for altering a genome at one or more locations in a host cell, tissue or subject, in vivo or in vitro. In particular, the invention features compositions, systems and methods for the introduction of exogenous genetic elements into a host genome. The disclosure also provides systems for altering a genomic DNA sequence of interest, e.g., by inserting, deleting, or substituting one or more nucleotides into/from the sequence of interest.

Features of the compositions or methods can include one or more of the following enumerated embodiments.

1. A system for modifying DNA comprising:
    (a) a polypeptide or a nucleic acid (e.g., DNA or mRNA) encoding a polypeptide, wherein the polypeptide comprises (i) a reverse transcriptase domain (e.g., as listed in Table 3B, Table 10, Table 11, Table Z1 or Table X) and (ii) an endonuclease domain, wherein one or both of (i) or (ii) have an amino acid sequence encoded by a nucleic acid sequence of an element of Table 3B, Table 10, Table 11, or Table X or a sequence having at least 70%, 75%, 80%, 85%, 90%, 95%, 96%, 97%, 98%, or 99% identity thereto; and
    (b) a template RNA (or DNA encoding the template RNA) comprising (i) a sequence that binds the polypeptide and (ii) a heterologous object sequence.
2. A system for modifying DNA comprising:
    (a) a polypeptide or a nucleic acid (e.g., DNA or mRNA) encoding a polypeptide, wherein the polypeptide comprises (i) a reverse transcriptase domain (e.g., as listed in Table 3B, Table 10, Table 11, Table Z1 or Table X) and (ii) an endonuclease domain, wherein one or both of (i) or (ii) have an amino acid sequence encoded by a nucleic acid sequence of an element of Table 3B, Table 10, Table 11, or Table X or a sequence having no more than 10, 20, 30, 40, 50, 60, 70, 80, 90, or 100 nucleotide differences therefrom; and
    (b) a template RNA (or DNA encoding the template RNA) comprising (i) a sequence that binds the polypeptide and (ii) a heterologous object sequence.
3. The system of any of the preceding embodiments, wherein the heterologous object sequence encodes a therapeutic polypeptide or that encodes a mammalian (e.g., human) polypeptide, or a fragment or variant thereof.
4. The system of any of the preceding embodiments, wherein the heterologous object sequence encodes a therapeutic non-coding RNA (e.g., a miRNA).
5. The system of any of the preceding embodiments, wherein the heterologous object sequence comprises a regulatory sequence (e.g., a promoter, an enhancer, a binding site for an endogenous regulatory component, e.g., a miRNA binding site), e.g., which alters the expression of an endogenous gene or non-coding RNA.
6. The system of any of the preceding embodiments, wherein the regulatory sequence results in the upregulation of an endogenous gene or non-coding RNA.
7. The system of any of the preceding embodiments wherein the regulatory sequence results in the downregulation of an endogenous gene or non-coding RNA.
8. A system for modifying DNA comprising:
    (a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
    (b) a template RNA (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain;
    wherein:
    (i) the polypeptide comprises a heterologous targeting domain (e.g., in the DBD or the endonuclease domain) that binds specifically to a sequence comprised in the target site; and/or
    (ii) the template RNA comprises a heterologous homology sequence having at least 85%, 90%, 95%, 96%, 97%, 98%, 99%, or 100% homology to a sequence comprised in a target site.
9. A system for modifying DNA comprising:
    (a) a polypeptide or a nucleic acid (e.g., DNA or mRNA) encoding a polypeptide, wherein the polypeptide comprises (i) a reverse transcriptase domain (e.g., as listed in Table 3B, Table 10, Table 11, Table Z1 or Table X) and (ii) an endonuclease domain, wherein one or both of (i) or (ii) have an amino acid sequence of an element of Table 3B, Table 10, Table 11, or Table X or a sequence having at least 70%, 75%, 80%, 85%, 90%, 95%, 96%, 97%, 98%, or 99% identity thereto; and
    (b) a template RNA (or DNA encoding the template RNA) comprising (i) a sequence that binds the polypeptide and (ii) a heterologous object sequence.
10. A system for modifying DNA comprising:
    (a) a polypeptide or a nucleic acid (e.g., DNA or mRNA) encoding a polypeptide, wherein the polypeptide comprises (i) a reverse transcriptase domain (e.g., as listed in Table 3B, Table 10, Table 11, or Table Z1 or Table X) and (ii) an endonuclease domain, wherein one or both of (i) or (ii) have an amino acid sequence of an element of Table 3B, Table 10, Table 11, or Table X or a sequence having no more than 10, 20, 30, 40, 50, 60, 70, 80, 90, or 100 nucleotide differences therefrom; and (b) a template RNA (or DNA encoding the template RNA) comprising (i) a sequence that binds the polypeptide and (ii) a heterologous object sequence.

11. A system for modifying DNA comprising:
   (a) a polypeptide or a nucleic acid (e.g., DNA or mRNA) encoding a polypeptide, wherein the polypeptide comprises (i) a reverse transcriptase domain (e.g., as listed in Table 3B, Table 10, Table 11, Table Z1 or Table X) and (ii) a target DNA binding domain, wherein one or both of (i) or (ii) have an amino acid sequence encoded by a nucleic acid sequence of an element of Table 3B, Table 10, Table 11, or Table X or a sequence having at least 70%, 75%, 80%, 85%, 90%, 95%, 96%, 97%, 98%, or 99% identity thereto; and
   (b) a template RNA (or DNA encoding the template RNA) comprising (i) a sequence that binds the polypeptide and (ii) a heterologous object sequence.

12. A system for modifying DNA comprising:
   (a) a polypeptide or a nucleic acid (e.g., DNA or mRNA) encoding a polypeptide, wherein the polypeptide comprises (i) a reverse transcriptase domain (e.g., as listed in Table 3B, Table 10, Table 11, Table Z1 or Table X) and (ii) a target DNA binding domain, wherein one or both of (i) or (ii) have an amino acid sequence encoded by a nucleic acid sequence of an element of Table 3B, Table 10, Table 11, or Table X or a sequence having no more than 10, 20, 30, 40, 50, 60, 70, 80, 90, or 100 nucleotide differences therefrom; and
   (b) a template RNA (or DNA encoding the template RNA) comprising (i) a sequence that binds the polypeptide and (ii) a heterologous object sequence.

13. A system for modifying DNA comprising:
   (a) a polypeptide or a nucleic acid (e.g., DNA or mRNA) encoding a polypeptide, wherein the polypeptide comprises (i) a reverse transcriptase domain from a protein other than a retrotransposase, e.g., from a retrovirus, e.g., reverse transcriptase domain as listed in Table Z1 or Z2, or a sequence having at least 70%, 75%, 80%, 85%, 90%, 95%, 96%, 97%, 98%, or 99% identity thereto; and (ii) an endonuclease domain and/or a target DNA binding domain; and
   (b) a template RNA (or DNA encoding the template RNA) comprising (i) a sequence that binds the polypeptide and (ii) a heterologous object sequence.

14. A system for modifying DNA comprising:
   (a) a polypeptide or a nucleic acid (e.g., DNA or mRNA) encoding a polypeptide, wherein the polypeptide comprises (i) a reverse transcriptase domain from a protein other than a retrotransposase, e.g., from a retrovirus, e.g., reverse transcriptase domain as listed in Table Z1 or Z2, or a sequence having no more than 10, 20, 30, 40, 50, 60, 70, 80, 90, or 100 nucleotide differences therefrom; and (ii) an endonuclease domain and/or a target DNA binding domain; and
   (b) a template RNA (or DNA encoding the template RNA) comprising (i) a sequence that binds the polypeptide and (ii) a heterologous object sequence.

15. A system for modifying DNA comprising:
   (a) a polypeptide or a nucleic acid encoding a polypeptide, wherein the polypeptide comprises (i) a reverse transcriptase domain (e.g., as listed in Table Z1 or Z2) and (ii) an endonuclease domain and/or a target DNA binding domain; and
   (b) a template RNA (or DNA encoding the template RNA) comprising (i) a sequence that binds the polypeptide and (ii) a heterologous object sequence;
   wherein the sequence of the template RNA that binds the polypeptide has at least 70%, 75%, 80%, 85%, 90%, 95%, 96%, 97%, 98%, 99%, or 100% identity to a 5' UTR or a 3' UTR of a sequence of an element of Table 10 or Table X.

16. A system for modifying DNA comprising:
   (a) a polypeptide or a nucleic acid encoding a polypeptide, wherein the polypeptide comprises (i) a reverse transcriptase domain (e.g., as listed in Table Z1 or Z2) and (ii) an endonuclease domain and/or a target DNA binding domain; and
   (b) a template RNA (or DNA encoding the template RNA) comprising (i) a sequence that binds the polypeptide and (ii) a heterologous object sequence;
   wherein the sequence of the template RNA that binds the polypeptide has at least 70%, 75%, 80%, 85%, 90%, 95%, 96%, 97%, 98%, 99%, or 100% identity to: (i) the nucleotides located 5' relative to a start codon of a sequence of an element of Table 10 or Table X (e.g., comprising a retrotransposase-binding region), or (ii) the nucleotides located 3' relative to a stop codon of a sequence of an element of Table 10 or Table X (e.g., comprising a retrotransposase-binding region).

17. A system for modifying DNA comprising:
   (a) a polypeptide or a nucleic acid (e.g., DNA or mRNA) encoding a polypeptide, wherein the polypeptide comprises (i) a reverse transcriptase domain (e.g., as listed in Table 3B, Table 10, Table 11, Table Z1, or Z2 or Table X) and (ii) an endonuclease domain and/or a target DNA binding domain;
   (b) a template RNA (or DNA encoding the template RNA) comprising (i) a sequence that binds the polypeptide and (ii) a heterologous object sequence; and
   (c) an intein.

18. The system of any of the preceding embodiments, wherein the polypeptide comprises the intein.

19. The system of any of the preceding embodiments, wherein the intein is a split intein.

20. A system for modifying DNA comprising:
   (a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
   (b) a template RNA (or DNA encoding the template RNA) comprising (e.g., from 5' to 3') (i) optionally a sequence (e.g., a CRISPR spacer) that binds a target site (e.g., a non-edited strand of a site in a target genome), (ii) optionally a sequence that binds the polypeptide, (iii) a heterologous object sequence, and (iv) a 3' homology domain.

21. A system for modifying DNA comprising:
   (a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
   (b) a template RNA (or DNA encoding the template RNA) comprising (e.g., from 5' to 3') (i) optionally a sequence that binds a target site (e.g., a non-edited strand of a site in a target genome), (ii) optionally a sequence that binds the polypeptide, (iii) a heterologous object sequence, and (iv) a 3' homology domain,
wherein the RT domain has an amino acid sequence of Table 3B, Table 10, Table 11, or Table X, or a sequence having at least 70%, 75%, 80%, 85%, 90%, 95%, 96%, 97%, 98%, or 99% identity thereto.

22. A system for modifying DNA comprising:
   (a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
   (b) a template RNA (etRNA) (or DNA encoding the template RNA) comprising (e.g., from 5' to 3') (i) optionally a sequence that binds a target site (e.g., a non-edited strand of a site in a target genome), (ii) optionally a sequence that binds the polypeptide, (iii) a heterologous object sequence, and (iv) a 3' homology domain,
   wherein the system is capable of producing an insertion into the target site of at least 45, 50, 55, 60, 65, 70, 75, 80, 85, 90, 95, or 100 nucleotides.

23. A system for modifying DNA comprising:
   (a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
   (b) a template RNA (or DNA encoding the template RNA) comprising (e.g., from 5' to 3') (i) optionally a sequence that binds a target site (e.g., a non-edited strand of a site in a target genome), (ii) optionally a sequence that binds the polypeptide, (iii) a heterologous object sequence, and (iv) a 3' homology domain,
   wherein the heterologous object sequence is at least 74, 75, 76, 77, 78, 79, 80, 81, 82, 83, 84, 85, 86, 87, 88, 89, 90, 91, 92, 93, 94, 95, 96, 97, 98, 99, 100, 120, 140, 160, 180, 200, 500, or 1,000 nts in length.

24. The system of any of the preceding embodiments, wherein one or more of: the RT domain is heterologous to the DBD; the DBD is heterologous to the endonuclease domain; or the RT domain is heterologous to the endonuclease domain.

25. A system for modifying DNA comprising:
   (a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
   (b) a template RNA (or DNA encoding the template RNA) comprising (e.g., from 5' to 3') (i) optionally a sequence that binds a target site (e.g., a non-edited strand of a site in a target genome), (ii) optionally a sequence that binds the polypeptide, (iii) a heterologous object sequence, and (iv) a 3' homology domain,
   wherein the system is capable of producing a deletion into the target site of at least 81, 85, 90, 95, 100, 110, 120, 130, 140, 150, 160, 170, 180, 190, or 200 nucleotides.

26. A system for modifying DNA comprising:
   (a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
   (b) a template (or DNA encoding the template RNA) comprising (e.g., from 5' to 3') (i) optionally a sequence that binds a target site (e.g., a non-edited strand of a site in a target genome), (ii) optionally a sequence that binds the polypeptide, (iii) a heterologous object sequence, and (iv) a 3' homology domain,
   wherein (a)(ii) and/or (a)(iii) comprises a TALE molecule; a zinc finger molecule; or a CRISPR/Cas molecule chosen from Table 1 or a functional variant (e.g., mutant) thereof.

27. A system for modifying DNA comprising:
   (a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
   (b) a template RNA (or DNA encoding the template RNA) comprising (e.g., from 5' to 3') (i) optionally a sequence (e.g., a CRISPR spacer) that binds a target site (e.g., a non-edited strand of a site in a target genome), (ii) optionally a sequence that binds the polypeptide, (iii) a heterologous object sequence, and (iv) a 3' homology domain,
   wherein the endonuclease domain, e.g., nickase domain, cuts both strands of the target site DNA, and wherein the cuts are separated from one another by at least 2, 3, 4, 5, 6, 7, 8, 9, 10, 15, 20, or 30 nucleotides.

28. A system for modifying DNA comprising:
   (a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
   (b) a template RNA (or DNA encoding the template RNA) comprising (e.g., from 5' to 3') (i) optionally a sequence that binds a target site (e.g., a non-edited strand of a site in a target genome), (ii) a sequence that specifically binds the RT domain, (iii) a heterologous object sequence, and (iv) a 3' homology domain.

29. The system of any of the preceding embodiments, wherein the template RNA further comprises a sequence that binds (a)(ii) and/or (a)(iii).

30. A system for modifying DNA comprising:
   (a) a first polypeptide or a nucleic acid encoding the first polypeptide, wherein the first polypeptide comprises (i) a reverse transcriptase (RT) domain and (ii) optionally a DNA-binding domain,
   (b) a second polypeptide or a nucleic acid encoding the second polypeptide, wherein the second polypeptide comprises (i) a DNA-binding domain (DBD); (ii) an endonuclease domain, e.g., a nickase domain; and
   (c) a template RNA (or DNA encoding the template RNA) comprising (e.g., from 5' to 3') (i) optionally a sequence that binds the second polypeptide (e.g., that binds (b)(i) and/or (b)(ii)), (ii) optionally a sequence that binds the first polypeptide (e.g., that specifically binds the RT domain), (iii) a heterologous object sequence, and (iv) a 3' homology domain.

31. A system for modifying DNA comprising:
   (a) a polypeptide or a nucleic acid encoding the polypeptide, wherein the polypeptide comprises (i) a reverse transcriptase (RT) domain, and (ii) a DNA-binding domain (DBD); and (iii) an endonuclease domain, e.g., a nickase domain;
   (b) a first template RNA (or DNA encoding the RNA) comprising (e.g., from 5' to 3') (i) a sequence that binds the polypeptide (e.g., that binds (a)(ii) and/or (a)(iii)) and (ii) a sequence that binds a target site (e.g., a non-edited strand of a site in a target genome), (e.g., wherein the first RNA comprises a gRNA);
(c) a second template RNA (or DNA encoding the RNA) comprising (e.g., from 5' to 3') (i) optionally a sequence that binds the polypeptide (e.g., that specifically binds the RT domain), (ii) a heterologous object sequence, and (iii) a 3' homology domain.

32. The system of any of the preceding embodiments, wherein the second template RNA comprises (i).

33. The system of any of the preceding embodiments, wherein the first template RNA comprises a first conjugating domain and the second template RNA comprises a second conjugating domain.

34. The system of any of the preceding embodiments, wherein the first and second conjugating domains are capable of hybridizing to one another, e.g., under stringent conditions.

35. The system of any of the preceding embodiments, wherein association of the first conjugating domain and the second conjugating domain colocalizes the first template RNA and the second template RNA.

36. The system of any of the preceding embodiments, wherein the template RNA comprises (i).

37. The system of any of the preceding embodiments, wherein the template RNA comprises (ii).

38. The system of any of the preceding embodiments, wherein the template RNA comprises (i) and (ii).

39. A system for modifying DNA, comprising:
(a) a first polypeptide or a nucleic acid encoding the polypeptide, wherein the polypeptide comprises a reverse transcriptase (RT) domain, wherein the RT domain has a sequence of Table 3B, Table 10, Table 11, or Table X, or a sequence having at least 70%, 75%, 80%, 85%, 90%, 95%, 96%, 97%, 98%, or 99% identity thereto; and optionally a DNA-binding domain (DBD) (e.g., a first DBD); and
(b) a second polypeptide or a nucleic acid encoding the polypeptide, wherein the polypeptide comprises (i) a DBD (e.g., a second DBD); and (ii) an endonuclease domain, e.g., a nickase domain.

40. The system of any of the preceding embodiments, wherein the nucleic acid encoding the first polypeptide and the nucleic acid encoding the second polypeptide are two separate nucleic acids.

41. The system of any of the preceding embodiments, wherein the nucleic acid encoding the first polypeptide and the nucleic acid encoding the second polypeptide are part of the same nucleic acid molecule, e.g., are present on the same vector.

42. The system of any of the preceding embodiments, having one or more (e.g., 1, 2, 3, 4, 5, 6, or all) of the following characteristics:
i. the heterologous object sequence encodes a protein, e.g. an enzyme (e.g., a lysosomal enzyme) or a blood factor (e.g., Factor I, II, V, VII, X, XI, XII or XIII);
ii. the heterologous object sequence comprises a tissue specific promoter or enhancer;
iii. the heterologous object sequence encodes a polypeptide of greater than 50, 100, 150, 200, 250, 300, 400, 500, or 1,000 amino acids, and optionally up to 7,500 amino acids;
iv. the heterologous object sequence encodes a fragment of a mammalian gene but does not encode the full mammalian gene, e.g., encodes one or more exons but does not encode a full-length protein;
v. the heterologous object sequence encodes one or more introns;
vi. the heterologous object sequence is other than a GFP, e.g., is other than a fluorescent protein or is other than a reporter protein; or
vii. the heterologous object sequence comprises only non-coding sequences, e.g., regulatory elements.

43. The system of any of the preceding embodiments, wherein the polypeptide further comprises a target DNA binding domain, e.g., having an amino acid sequence encoded by a sequence of an element of Table 3B, Table 10, Table 11, or Table X, or a sequence having at least 70%, 75%, 80%, 85%, 90%, 95%, 96%, 97%, 98%, or 99% identity thereto.

44. The system of any of the preceding embodiments, wherein the polypeptide further comprises a target DNA binding domain, e.g., having an amino acid sequence encoded by a sequence of an element of Table 3B, Table 10, Table 11, or Table X, or a sequence having no more than 10, 20, 30, 40, 50, 60, 70, 80, 90, or 100 nucleotide differences therefrom.

45. The system of any of the preceding embodiments, wherein the polypeptide further comprises a target DNA binding domain, e.g., having an amino acid sequence of an element of Table 3B, Table 10, Table 11, or Table X, or a sequence having at least 70%, 75%, 80%, 85%, 90%, 95%, 96%, 97%, 98%, or 99% identity thereto.

46. The system of any of the preceding embodiments, wherein the polypeptide further comprises a target DNA binding domain, e.g., having an amino acid sequence of an element of Table 3B, Table 10, Table 11, or Table X, or a sequence having no more than 10, 20, 30, 40, 50, 60, 70, 80, 90, or 100 nucleotide differences therefrom.

47. The system of any of the preceding embodiments, wherein the polypeptide has an activity at 37° C. that is no less than 70%, 75%, 80%, 85%, 90%, or 95% of its activity at 25° C. under otherwise similar conditions.

48. The system of any of the preceding embodiments, wherein the polypeptide is derived from a homoeothermic organism, e.g., a bird or a mammal.

49. The system of any of the preceding embodiments, wherein the polypeptide is derived from one or more of: a CRE retrotransposase, an NeSL retrotransposase, an R4 retrotransposase, an R2 retrotransposase, a Hero retrotransposase, an L1 retrotransposase, an RTE retrotransposase, an I retrotransposase, a Jockey retrotransposase, a CR1 retrotransposase, a Rex1 retrotransposase, an RandI/Dualen retrotransposase, a Penelope or Penelope-like retrotransposase, a Tx1 retrotransposase, an RTEX retrotransposase, a Crack retrotransposase, a Nimb retrotransposase, a Proto1 retrotransposase, a Proto2 retrotransposase, an RTETP retrotransposase, an L2 retrotransposase, a Tad1 retrotransposase, a Loa retrotransposase, an Ingi retrotransposase, an Outcast retrotransposase, an R1 retrotransposase, a Daphne retrotransposase, an L2A retrotransposase, an L2B retrotransposase, an Ambal retrotransposase, a Vingi retrotransposase, and/or a Kiri retrotransposase.

50. The system of any of the preceding embodiments, wherein the polypeptide comprises an endonuclease domain from a transposable element, e.g., a restriction-like endonuclease (RLE), an apurinic/apyrimidinic endonuclease-like endonuclease (APE), a GIY-YIG endonuclease.

51. The system of any of the preceding embodiments, wherein the endonuclease domain is intact.

52. The system of any of the preceding embodiments, wherein the endonuclease domain is inactivated.

53. The system of any of the preceding embodiments, wherein the endonuclease nicks DNA.

54. The system of any of the preceding embodiments, wherein the endonuclease makes a double stranded break.

55. The system of any of the preceding embodiments, wherein the template RNA comprises a sequence of Table 3A or 3B or 10 (e.g., one or both of a 5' untranslated region of column 6 of Table 3A or 3B and a 3' untranslated region of column 7 of Table 3A or 3B), or a sequence having at least 70%, 75%, 80%, 85%, 90%, 95%, 96%, 97%, 98%, or 99% identity thereto.

56. The system of any of the preceding embodiments, wherein the template RNA comprises a sequence of Table 3A or 3B or 11 (e.g., one or both of a 5' untranslated region of column 6 of Table 3A or 3B and a 3' untranslated region of column 7 of Table 3A or 3B), or a sequence having no more than 10, 20, 30, 40, 50, 60, 70, 80, 90, or 100 nucleotide differences therefrom.

57. The system of any of the preceding embodiments, wherein the system has one or more (e.g., 1, 2, 3, or all) of the following characteristics:
  i. the nucleic acid encoding the polypeptide and the template RNA or a nucleic acid encoding the template RNA are separate nucleic acids;
  ii. the template RNA does not encode an active reverse transcriptase, e.g., comprises an inactivated mutant reverse transcriptase, e.g., as described in Examples 1-2, or does not comprise a reverse transcriptase sequence;
  iii. the template RNA does not encode an active endonuclease, e.g., comprises an inactivated endonuclease or does not comprise an endonuclease; or
  iv. the template RNA comprises one or more chemical modifications.

58. The system of any of the preceding embodiments, wherein the template RNA (or DNA encoding the template RNA) comprises (i) a 5' UTR sequence that binds the polypeptide, (ii) a 3' UTR sequence that binds the polypeptide, (iii) a heterologous object sequence, and (iv) a promoter operably linked to the heterologous object sequence,
  wherein the promoter is disposed between the 5' untranslated sequence that binds the polypeptide and the heterologous sequence, or
  wherein the promoter is disposed between the 3' untranslated sequence that binds the polypeptide and the heterologous sequence.

59. The system of any of the preceding embodiments, wherein the template RNA (or DNA encoding the template RNA) comprises (i) a 5' UTR sequence that binds the polypeptide, (ii) a 3' UTR sequence that binds the polypeptide, and (iii) a heterologous object sequence, and
  wherein the heterologous object sequence comprises an open reading frame (or the reverse complement thereof) in a 5' to 3' orientation on the template RNA; or
  wherein the heterologous object sequence comprises an open reading frame (or the reverse complement thereof) in a 3' to 5' orientation on the template RNA.

60. The system of any of the preceding embodiments, wherein the 5' UTR sequence of the template RNA (or DNA encoding the template RNA) has at least 70%, 75%, 80%, 85%, 90%, 95%, 96%, 97%, 98%, 99%, or 100% identity to a 5' UTR sequence of a sequence of an element of Table 3B, Table 10, or Table X.

61. The system of any of the preceding embodiments, wherein the 5' UTR sequence of the template RNA (or DNA encoding the template RNA) has at least 70%, 75%, 80%, 85%, 90%, 95%, 96%, 97%, 98%, 99%, or 100% identity to nucleotides located 5' relative to a start codon of a sequence of an element of Table 3B, Table 10, or Table X (e.g., comprising a retrotransposase-binding region).

62. The system of any of the preceding embodiments, wherein the 5' UTR sequence of the template RNA (or DNA encoding the template RNA) has substantial structural similarity (e.g., substantial secondary structural similarity) to a 5' UTR sequence of a sequence of an element of Table 3B, Table 10, or Table X.

63. The system of any of the preceding embodiments, wherein the 5' UTR sequence of the template RNA (or DNA encoding the template RNA) has at least 70%, 75%, 80%, 85%, 90%, 95%, 96%, 97%, 98%, 99%, or 100% identity to a 5' UTR sequence of column 6 of Table 3A or 3B or 10.

64. The system of any of the preceding embodiments, wherein the 3' UTR sequence of the template RNA (or DNA encoding the template RNA) has at least 70%, 75%, 80%, 85%, 90%, 95%, 96%, 97%, 98%, 99%, or 100% identity to a 3' UTR sequence of a sequence of an element of Table 3B, Table 10, or Table X.

65. The system of any of the preceding embodiments, wherein the 3' UTR sequence of the template RNA (or DNA encoding the template RNA) has substantial structural similarity (e.g., substantial secondary structural similarity) to a 3' UTR sequence of a sequence of an element of Table 3B, Table 10, or Table X.

66. The system of any of any of the preceding embodiments, wherein the 3' UTR sequence of the template RNA (or DNA encoding the template RNA) has at least 70%, 75%, 80%, 85%, 90%, 95%, 96%, 97%, 98%, 99%, or 100% identity to a 3' UTR sequence of Table 10 or column 7 of Table 3A or 3B.

67. The system of any of any of the preceding embodiments, wherein the 3' UTR sequence of the template RNA (or DNA encoding the template RNA) has at least 70%, 75%, 80%, 85%, 90%, 95%, 96%, 97%, 98%, 99%, or 100% identity to the nucleotides located 3' relative to a stop codon of a sequence of an element of Table 3B, Table 10, or Table X (e.g., comprising a retrotransposase-binding region).

68. The system of any of any of the preceding embodiments, wherein the 3' UTR of the template RNA (or DNA encoding the template RNA) is flanked by a homology domain, e.g., as described herein, e.g., a homology domain having at least 5, 10, 20, 50, or 100 bases of at least 80% (e.g., at least 80%, 85%, 90%, 95%, 96%, 97%, 98%, or 100%) identity to a target DNA strand, wherein optionally the homology domain comprises a sequence according to a 3' homology arm of Table 11, or a sequence having at least 80%, 85%, 90%, 95%, 96%, 97%, 98%, or 99% identity thereto.

69. The system of any of any of the preceding embodiments, wherein the 5' UTR is flanked by a homology domain, e.g., as described herein, e.g., a homology domain having at least 10, 20, 50, or 100 bases of at least 80% (e.g., at least 80%, 85%, 90%, 95%, 96%, 97%, 98%, or 100%) identity to a target DNA strand, wherein optionally the homology domain comprises a sequence according to a 5' homology arm of Table 11, or a sequence having at least 80%, 85%, 90%, 95%, 96%, 97%, 98%, or 99% identity thereto.

70. The system of any of the preceding embodiments, wherein at least one of the reverse transcriptase domain, the endonuclease domain, or the target DNA binding domain is heterologous, e.g., relative to the other domains.

71. The system of any of the preceding embodiments, wherein the endonuclease domain is heterologous relative to the reverse transcriptase domain and/or the target DNA binding domain.

72. The system of any of the preceding embodiments, wherein the polypeptide comprises (i) a sequence at least 80% identical (e.g., at least 85%, 90%, 95%, 97%, 98%, 99%, 100% identical) to a reverse transcriptase domain of an apurinic/apyrimidinic endonuclease (APE)-type non-LTR retrotransposon and (ii) a sequence at least 80% identical (e.g., at least 85%, 90%, 95%, 97%, 98%, 99%, 100% identical) to an endonuclease domain of an APE-type non-LTR retrotransposon.

73. The system of any of the preceding embodiments, wherein the polypeptide comprises (i) a sequence at least 80% identical (e.g., at least 85%, 90%, 95%, 97%, 98%, 99%, 100% identical) to a reverse transcriptase domain of a Penelope-like element (PLE)-type retrotransposon and (ii) a sequence at least 80% identical (e.g., at least 85%, 90%, 95%, 97%, 98%, 99%, 100% identical) to an endonuclease domain of a PLE-type retrotransposon, e.g., wherein the PLE-type retrotransposon comprises a GIY-YIG endonuclease.

74. The system of any of the preceding embodiments, wherein the PLE-type retrotransposon does not comprise a functional endonuclease domain.

75. The system of any of the preceding embodiments, wherein the PLE-type retrotransposase comprises a Penelope-like element that naturally lacks an endonuclease domain (e.g., an Athena element, e.g., as described in Gladyshev and Arkhipova PNAS 104, 9352-9357 (2007)).

76. The system of any of the preceding embodiments, wherein the PLE-type retrotransposase lacking a functional endonuclease domain is fused to Cas9, e.g., wherein the PLE-type retrotransposase fused to Cas9 has DBD and/or endonuclease (e.g., nickase) function.

77. The system of any of the preceding embodiments, wherein the polypeptide comprises (i) a sequence at least 80% identical (e.g., at least 85%, 90%, 95%, 97%, 98%, 99%, 100% identical) to a reverse transcriptase domain of a restriction enzyme-like endonuclease (RLE)-type non-LTR retrotransposon, (ii) a sequence at least 80% identical (e.g., at least 85%, 90%, 95%, 97%, 98%, 99%, 100% identical) to an endonuclease domain of a RLE-type non-LTR retrotransposon, and (iii) a target DNA binding domain heterologous to (i) and/or (ii) (e.g., a heterologous zinc-finger DNA binding domain).

78. The system of any of the preceding embodiments, wherein the polypeptide comprises (i) a sequence at least 80% identical (e.g., at least 85%, 90%, 95%, 97%, 98%, 99%, 100% identical) to a reverse transcriptase domain of a restriction enzyme-like endonuclease (RLE)-type non-LTR retrotransposon, and (ii) a heterologous endonuclease domain and/or a heterologous DNA binding domain.

79. The system of any of the preceding embodiments, wherein the polypeptide comprises (i) a sequence at least 80% identical (e.g., at least 85%, 90%, 95%, 97%, 98%, 99%, 100% identical) to a reverse transcriptase domain of an apurinic/apyrimidinic endonuclease (APE)-type non-LTR retrotransposon, (ii) a sequence at least 80% identical (e.g., at least 85%, 90%, 95%, 97%, 98%, 99%, 100% identical) to an endonuclease domain of an APE-type non-LTR retrotransposon, and (iii) a target DNA binding domain heterologous to (i) and/or (ii) (e.g., a heterologous zinc-finger DNA binding domain).

80. The system of any of the preceding embodiments, wherein the polypeptide comprises (i) a sequence at least 80% identical (e.g., at least 85%, 90%, 95%, 97%, 98%, 99%, 100% identical) to a reverse transcriptase domain of an apurinic/apyrimidinic endonuclease (APE)-type non-LTR retrotransposon, and (ii) a heterologous endonuclease domain and/or a heterologous DNA binding domain.

81. The system of any of the preceding embodiments, wherein the polypeptide comprises (i) a sequence at least 80% identical (e.g., at least 85%, 90%, 95%, 97%, 98%, 99%, 100% identical) to a reverse transcriptase domain of a Penelope-like element (PLE)-type retrotransposon, (ii) a sequence at least 80% identical (e.g., at least 85%, 90%, 95%, 97%, 98%, 99%, 100% identical) to an endonuclease domain of a PLE-type retrotransposon, and (iii) a target DNA binding domain heterologous to (i) and/or (ii) (e.g., a heterologous zinc-finger DNA binding domain).

82. The system of any of the preceding embodiments, wherein the polypeptide comprises (i) a sequence at least 80% identical (e.g., at least 85%, 90%, 95%, 97%, 98%, 99%, 100% identical) to a reverse transcriptase domain of a Penelope-like element (PLE)-type retrotransposon, and (ii) a heterologous endonuclease domain and/or a heterologous DNA binding domain.

83. The system of any of the preceding embodiments, wherein the template RNA comprises (iii) a promoter operably linked to the heterologous object sequence.

84. The system of any of the preceding embodiments, wherein the polypeptide further comprises (iii) a DNA-binding domain.

85. The system of any of the preceding embodiments, wherein the DNA binding domain has endonuclease activity.

86. The system of any of the preceding embodiments, wherein the endonuclease domain or endonuclease activity forms a double stranded break in DNA.

87. The system of any of the preceding embodiments, wherein the endonuclease domain or endonuclease activity nicks DNA.

88. The system of any of the preceding embodiments, wherein the polypeptide comprises a sequence at least 80% identical (e.g., at least 85%, 90%, 95%, 97%, 98%, 99%, 100% identical) to a sequence in column 7 of Table 3A or 3B.

89. The system of any of the preceding embodiments, wherein the polypeptide comprises a sequence at least 80% identical (e.g., at least 85%, 90%, 95%, 97%, 98%, 99%, 100% identical) to the sequence of an element listed in Table 10, Table 11, or Table X.

90. The system of any of the preceding embodiments, wherein the nucleic acid encoding the polypeptide and the template RNA or the nucleic acid encoding the template RNA are covalently linked, e.g., are part of a fusion nucleic acid.

91. The system of any of the preceding embodiments, wherein the fusion nucleic acid comprises RNA.

92. The system of any of the preceding embodiments, wherein the fusion nucleic acid comprises DNA.

93. The system of any of the preceding embodiments, wherein (b) comprises template RNA.

94. The system of any of the preceding embodiments, wherein the template RNA further comprises a nuclear localization signal.

95. The system of any of the preceding embodiments, wherein (a) comprises RNA encoding the polypeptide.

96. The system of any of the preceding embodiments, wherein the RNA of (a) and the RNA of (b) are separate RNA molecules.

97. The system of any of the preceding embodiments, wherein the RNA of (a) and the RNA of (b) are present at a ratio of between 100:1 and 10:1, 10:1 and 5:1, 5:1 and 2:1, 2:1 and 1:1, 1:1 and 1:2, 1:2 and 1:5, 1:5 and 1:10, or 1:10 and 1:100.

98. The system of any of the preceding embodiments, wherein the RNA of (a) does not comprise a nuclear localization signal.

99. The system of any of the preceding embodiments, wherein the polypeptide further comprises a nuclear localization signal and/or a nucleolar localization signal.

100. The system of any of the preceding embodiments, wherein (a) comprises an RNA that encodes: (i) the polypeptide and (ii) a nuclear localization signal and/or a nucleolar localization signal.

101. The system of any of the preceding embodiments, wherein the RNA comprises a pseudoknot sequence, e.g., 5' of the heterologous object sequence.

102. The system of any of the preceding embodiments, wherein the RNA comprises a stem-loop sequence or a helix, 5' of the pseudoknot sequence.

103. The system of any of the preceding embodiments, wherein the RNA comprises one or more (e.g., 2, 3, or more) stem-loop sequences or helices 3' of the pseudoknot sequence, e.g. 3' of the pseudoknot sequence and 5' of the heterologous object sequence.

104. The system of any of the preceding embodiments, wherein the template RNA comprising the pseudoknot has catalytic activity, e.g., RNA-cleaving activity, e.g, cis-RNA-cleaving activity.

105. The system of any of the preceding embodiments, wherein the RNA comprises at least one stem-loop sequence or helix, e.g., 3' of the heterologous object sequence, e.g. 1, 2, 3, 4, 5 or more stem-loop sequences, hairpins or helices sequences.

106. The system of any of the preceding embodiments, wherein the reverse transcriptase domain has an amino acid sequence of a reverse transcriptase domain of an element listed in FIG. 10, or a sequence having at least 70%, 75%, 80%, 85%, 90%, 95%, 96%, 97%, 98%, or 99% identity thereto.

107. The system of any of the preceding embodiments, wherein the endonuclease domain has an amino acid sequence of an endonuclease domain of an element listed in FIG. 10, or a sequence having at least 70%, 75%, 80%, 85%, 90%, 95%, 96%, 97%, 98%, or 99% identity thereto.

108. The system of any of the preceding embodiments, wherein the reverse transcriptase domain has an amino acid sequence of a reverse transcriptase domain of R2NS-1_CSi, R4-1_PH, RTE-1_MD, L2-18_ACar, L2-2_DRe, Dong-1_MMa, CR1_AC_1, Vingi-1_Acar, SR2, R4-1_AC, DongAa, CR1-1_PH, RTE-2_LMi, CR1-10_AMi, RTE-2_OL, L1-1_Cho, BovB, Line1-2_ZM, RTE-1_Aip, CR1-3_IS, CR1-54_AAe, Tad1-65B_BG, TART-1_DWi, or RTE_Ele2 as provided herein, or a sequence having at least 70%, 75%, 80%, 85%, 90%, 95%, 96%, 97%, 98%, or 99% identity thereto.

109. The system of any of the preceding embodiments, wherein the endonuclease domain has an amino acid sequence of an endonuclease domain of R2NS-1_CSi, R4-1_PH, RTE-1_MD, L2-18_ACar, L2-2_DRe, Dong-1_MMa, CR1_AC_1, Vingi-1_Acar, SR2, R4-1_AC, DongAa, CR1-1_PH, RTE-2_LMi, CR1-10_AMi, RTE-2_OL, L1-1_Cho, BovB, Line1-2_ZM, RTE-1_Aip, CR1-3_IS, CR1-54_AAe, Tad1-65B_BG, TART-1_DWi, or RTE_Ele2 as provided herein, or a sequence having at least 70%, 75%, 80%, 85%, 90%, 95%, 96%, 97%, 98%, or 99% identity thereto.

110. The system of any of the preceding embodiments, wherein the polypeptide has an amino acid sequence of R2NS-1_CSi, R4-1_PH, RTE-1_MD, L2-18_ACar, L2-2_DRe, Dong-1_MMa, CR1_AC_1, Vingi-1_Acar, SR2, R4-1_AC, DongAa, CR1-1_PH, RTE-2_LMi, CR1-10_AMi, RTE-2_OL, L1-1_Cho, BovB, Line1-2_ZM, RTE-1_Aip, CR1-3_IS, CR1-54_AAe, Tad1-65B_BG, TART-1_DWi, or RTE_Ele2 as provided herein, or a sequence having at least 70%, 75%, 80%, 85%, 90%, 95%, 96%, 97%, 98%, or 99% identity thereto.

111. The system of any of the preceding embodiments, wherein the sequence of the template RNA that binds the polypeptide has at least 70%, 75%, 80%, 85%, 90%, 95%, 96%, 97%, 98%, 99%, or 100% identity to a 5' UTR or R2NS-1_CSi, R4-1_PH, RTE-1_MD, L2-18_ACar, L2-2_DRe, Dong-1_MMa, CR1_AC_1, Vingi-1_Acar, SR2, R4-1_AC, DongAa, CR1-1_PH, RTE-2_LMi, CR1-10_AMi, RTE-2_OL, L1-1_Cho, BovB, Line1-2_ZM, RTE-1_Aip, CR1-3_IS, CR1-54_AAe, Tad1-65B_BG, TART-1_DWi, or RTE_Ele2 as provided herein.

112. The system of any of the preceding embodiments, wherein the sequence of the template RNA that binds the polypeptide has at least 70%, 75%, 80%, 85%, 90%, 95%, 96%, 97%, 98%, 99%, or 100% identity to a 3' UTR or R2NS-1_CSi, R4-1_PH, RTE-1_MD, L2-18_ACar, L2-2_DRe, Dong-1_MMa, CR1_AC_1, Vingi-1_Acar, SR2, R4-1_AC, DongAa, CR1-1_PH, RTE-2_LMi, CR1-10_AMi, RTE-2_OL, L1-1_Cho, BovB, Line1-2_ZM, RTE-1_Aip, CR1-3_IS, CR1-54_AAe, Tad1-65B_BG, TART-1_DWi, or RTE_Ele2 as provided herein.

113. The system of any of the preceding embodiments, wherein the nucleic encoding the polypeptide comprises a coding sequence that is codon-optimized for expression in human cells.

114. The system of any of the preceding embodiments, wherein the template RNA comprises a coding sequence that is codon-optimized for expression in human cells.

115. The system of any of the preceding embodiments, wherein the system comprises one or more circular RNA molecules (circRNAs).

116. The system of any of the preceding embodiments, wherein the circRNA encodes the Gene Writer polypeptide.

117. The system of any of the preceding embodiments, wherein the circRNA comprises a template RNA.

118. The system of any of the preceding embodiments, wherein circRNA is delivered to a host cell.

119. The system of any of the preceding embodiments, wherein the circRNA is capable of being linearized, e.g., in a host cell, e.g., in the nucleus of the host cell.

120. The system of any of the preceding embodiments, wherein the circRNA comprises a cleavage site.

121. The system of any of the preceding embodiments, wherein the circRNA further comprises a second cleavage site.

122. The system of any of the preceding embodiments, wherein the cleavage site can be cleaved by a ribozyme, e.g., a ribozyme comprised in the circRNA (e.g., by autocleavage).

123. The system of any of the preceding embodiments, wherein the circRNA comprises a ribozyme sequence.

124. The system of any of the preceding embodiments, wherein the ribozyme sequence is capable of autocleavage, e.g., in a host cell, e.g., in the nucleus of the host cell.

125. The system of any of the preceding embodiments, wherein the ribozyme is an inducible ribozyme.

126. The system of any of the preceding embodiments, wherein the ribozyme is a protein-responsive ribozyme, e.g., a ribozyme responsive to a nuclear protein, e.g., a genome-interacting protein, e.g., an epigenetic modifier, e.g., EZH2.

127. The system of any of the preceding embodiments, wherein the ribozyme is a nucleic acid-responsive ribozyme.

128. The system of any of the preceding embodiments, wherein the catalytic activity (e.g., autocatalytic activity) of the ribozyme is activated in the presence of a target nucleic acid molecule (e.g., an RNA molecule, e.g., an mRNA, miRNA, ncRNA, lncRNA, tRNA, snRNA, or mtRNA).
129. The system of any of the preceding embodiments, wherein the ribozyme is responsive to a target protein (e.g., an MS2 coat protein).
130. The system of any of the preceding embodiments, wherein the target protein localized to the cytoplasm or localized to the nucleus (e.g., an epigenetic modifier or a transcription factor).
131. The system of any of the preceding embodiments, wherein the ribozyme comprises the ribozyme sequence of a B2 or ALU retrotransposon, or a nucleic acid sequence having at least 85%, 90%, 95%, 96%, 97%, 98%, or 99% sequence identity thereto. 132. The system of any of the preceding embodiments, wherein the ribozyme comprises the sequence of a tobacco ringspot virus hammerhead ribozyme, or a nucleic acid sequence having at least 85%, 90%, 95%, 96%, 97%, 98%, or 99% sequence identity thereto.
133. The system of any of the preceding embodiments, wherein the ribozyme comprises the sequence of a hepatitis delta virus (HDV) ribozyme, or a nucleic acid sequence having at least 85%, 90%, 95%, 96%, 97%, 98%, or 99% sequence identity thereto.
134. The system of any of the preceding embodiments, wherein the ribozyme is activated by a moiety expressed in a target cell or target tissue.
135. The system of any of the preceding embodiments, wherein the ribozyme is activated by a moiety expressed in a target subcellular compartment (e.g., a nucleus, nucleolus, cytoplasm, or mitochondria).
136. The system of any of the preceding embodiments, wherein the ribozyme is comprised in a circular RNA or a linear RNA.
137. A system comprising a first circular RNA encoding the polypeptide of a Gene Writing system; and a second circular RNA comprising the template RNA of a Gene Writing system.
138. The system of any of the preceding embodiments, wherein the template RNA, e.g., the 5' UTR, comprises a ribozyme which cleaves the template RNA (e.g., in the 5' UTR).
139. The system of any of the preceding embodiments, wherein the template RNA comprises a ribozyme that is heterologous to (a)(i) (the a reverse transcriptase domain), (a)(ii) (the endonuclease domain), (b)(i) (a sequence of the template RNA that binds the polypeptide), or a combination thereof.
140. The system of any of the preceding embodiments, wherein the heterologous ribozyme is capable of cleaving RNA comprising the ribozyme, e.g., 5' of the ribozyme, 3' of the ribozyme, or within the ribozyme.
141. A lipid nanoparticle (LNP) comprising the system, polypeptide (or RNA encoding the same), nucleic acid molecule, or DNA encoding the system or polypeptide, of any of the preceding embodiments.
142. A system comprising a first lipid nanoparticle comprising the polypeptide (or DNA or RNA encoding the same) of a Gene Writing system (e.g., as described herein); and
  a second lipid nanoparticle comprising a nucleic acid molecule of a Gene Writing System (e.g., as described herein).
143. The system or polypeptide, of any of the preceding embodiments, wherein the system, nucleic acid molecule, polypeptide, and/or DNA encoding the same, is formulated as a lipid nanoparticle (LNP).
144. The LNP of any of the preceding embodiments, comprising a cationic lipid.
145. The LNP of any of the preceding embodiments, wherein the cationic lipid having a following structure:

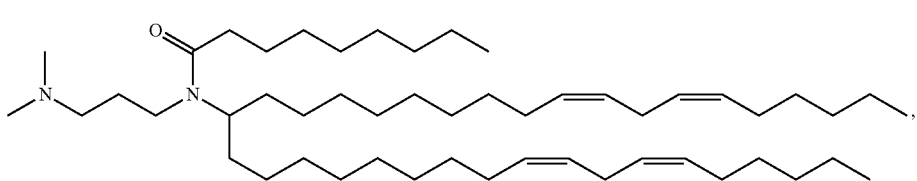

(i)

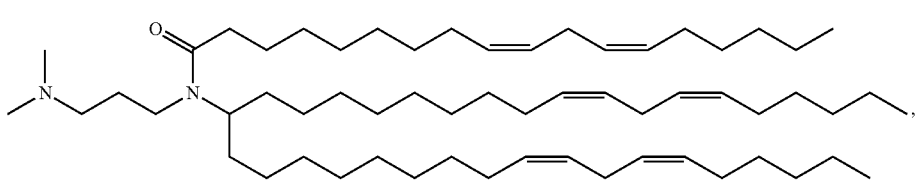

(ii)

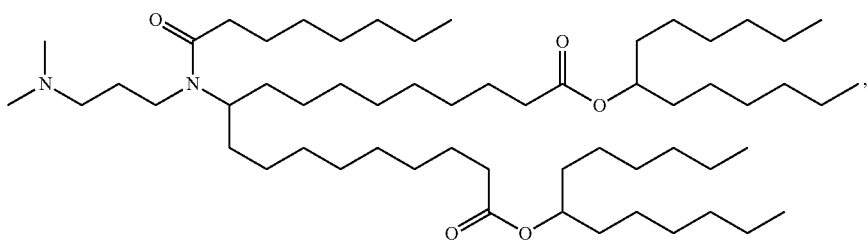

(iii)

-continued

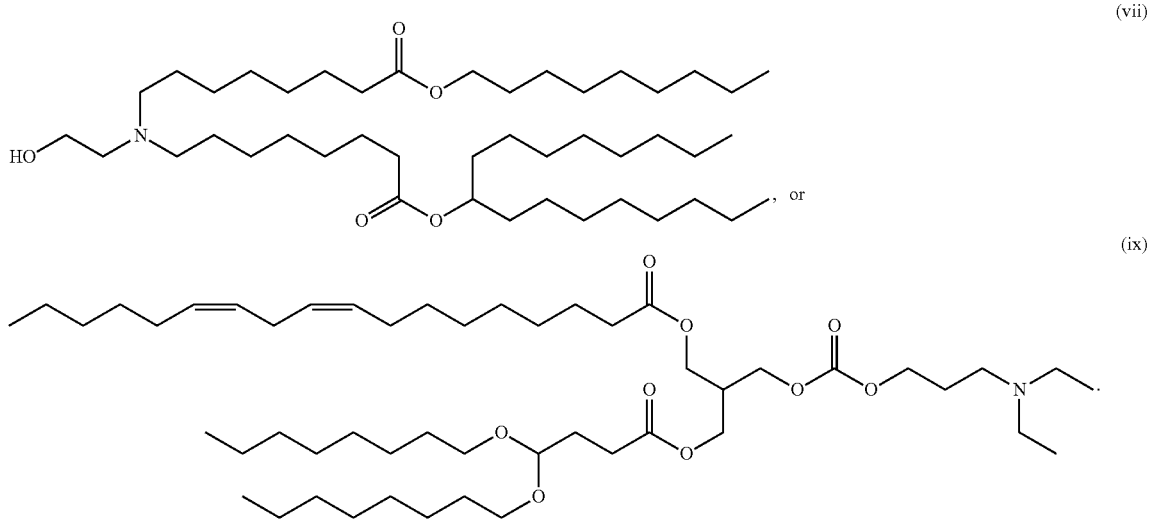

146. The LNP of any of the preceding embodiments, further comprising one or more neutral lipid, e.g., DSPC, DPPC, DMPC, DOPC, POPC, DOPE, SM, a steroid, e.g., cholesterol, and/or one or more polymer conjugated lipid, e.g., a pegylated lipid, e.g., PEG-DAG, PEG-PE, PEG-S-DAG, PEG-cer or a PEG dialkyoxypropylcarbamate.
147. The system, kit, or polypeptide, of any of the preceding embodiments, wherein the system, polypeptide, and/or DNA encoding the same, is formulated as a lipid nanoparticle (LNP).
148. The system, kit, or polypeptide of any of the preceding embodiments, wherein the lipid nanoparticle (or a formulation comprising a plurality of the lipid nanoparticles) lacks reactive impurities (e.g., aldehydes), or comprises less than a preselected level of reactive impurities (e.g., aldehydes).
149. The system, kit, or polypeptide of any of the preceding embodiments, wherein the lipid nanoparticle (or a formulation comprising a plurality of the lipid nanoparticles) lacks aldehydes, or comprises less than a preselected level of aldehydes.
150. The system, kit, or polypeptide of any of the preceding embodiments, wherein the lipid nanoparticle is comprised in a formulation comprising a plurality of the lipid nanoparticles.
151. The system, kit, or polypeptide of any of the preceding embodiments, wherein the lipid nanoparticle formulation is produced using one or more lipid reagents comprising less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content.
152. The system, kit, or polypeptide of any of the preceding embodiments, wherein the lipid nanoparticle formulation is produced using one or more lipid reagents comprising less than 3% total reactive impurity (e.g., aldehyde) content.
153. The system, kit, or polypeptide of any of the preceding embodiments, wherein the lipid nanoparticle formulation is produced using one or more lipid reagents comprising less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.
154. The system, kit, or polypeptide of any of the preceding embodiments, wherein the lipid nanoparticle formulation is produced using one or more lipid reagent comprising less than 0.3% of any single reactive impurity (e.g., aldehyde) species.
155. The system, kit, or polypeptide of any of the preceding embodiments, wherein the lipid nanoparticle formulation is produced using one or more lipid reagents comprising less than 0.1% of any single reactive impurity (e.g., aldehyde) species.
156. The system, kit, or polypeptide of any of the preceding embodiments, wherein the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content.
157. The system, kit, or polypeptide of any of the preceding embodiments, wherein the lipid nanoparticle formulation comprises less than 3% total reactive impurity (e.g., aldehyde) content.
158. The system, kit, or polypeptide of any of the preceding embodiments, wherein the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.
159. The system, kit, or polypeptide of any of the preceding embodiments, wherein the lipid nanoparticle formulation comprises less than 0.3% of any single reactive impurity (e.g., aldehyde) species.
160. The system, kit, or polypeptide of any of the preceding embodiments, wherein the lipid nanoparticle formulation comprises less than 0.1% of any single reactive impurity (e.g., aldehyde) species.
161. The system, kit, or polypeptide of any of the preceding embodiments, wherein one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content.
162. The system, kit, or polypeptide of any of the preceding embodiments, wherein one or more, or optionally all, of the lipid reagents used for a lipid nanoparticle as described herein or a formulation thereof comprise less than 3% total reactive impurity (e.g., aldehyde) content.

163. The system, kit, or polypeptide of any of the preceding embodiments, wherein one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

164. The system, kit, or polypeptide of any of the preceding embodiments, wherein one or more, or optionally all, of the lipid reagents used for a lipid nanoparticle as described herein or a formulation thereof comprise less than 0.3% of any single reactive impurity (e.g., aldehyde) species.

165. The system, kit, or polypeptide of any of the preceding embodiments, wherein one or more, or optionally all, of the lipid reagents used for a lipid nanoparticle as described herein or a formulation thereof comprise less than 0.1% of any single reactive impurity (e.g., aldehyde) species.

166. The system, kit, or polypeptide of any of the preceding embodiments, wherein the total aldehyde content and/or quantity of any single reactive impurity (e.g., aldehyde) species is determined by liquid chromatography (LC), e.g., coupled with tandem mass spectrometry (MS/MS), e.g., according to the method described in Example 7.

167. The system, kit, or polypeptide of any of the preceding embodiments, wherein the total aldehyde content and/or quantity of reactive impurity (e.g., aldehyde) species is determined by detecting one or more chemical modifications of a nucleic acid molecule (e.g., as described herein) associated with the presence of reactive impurities (e.g., aldehydes), e.g., in the lipid reagents.

168. The system, kit, or polypeptide of any of the preceding embodiments, wherein the total aldehyde content and/or quantity of aldehyde species is determined by detecting one or more chemical modifications of a nucleotide or nucleoside (e.g., a ribonucleotide or ribonucleoside, e.g., comprised in or isolated from a nucleic acid molecule, e.g., as described herein) associated with the presence of reactive impurities (e.g., aldehydes), e.g., in the lipid reagents, e.g., as described in Example 8.

169. The system, kit, or polypeptide of any of the preceding embodiments, wherein the chemical modifications of a nucleic acid molecule, nucleotide, or nucleoside are detected by determining the presence of one or more modified nucleotides or nucleosides, e.g., using LC-MS/MS analysis, e.g., as described in Example 8.

170. Any above-numbered system, wherein the polypeptide comprises a sequence of at least 50 amino acids (e.g., at least 100, 150, 200, 300, 500 amino acids) having at least 80% identity (e.g., at least 85%, 90%, 95%, 97%, 98%, 99%, 100% identity) to a sequence of a polypeptide encoded by a sequence of an element of Table 10, Table 11, or Table X, or a reverse transcriptase domain or endonuclease domain thereof.

171. Any above-numbered system, wherein the polypeptide comprises a sequence of at least 50 amino acids (e.g., at least 100, 150, 200, 300, 500 amino acids) having no more than 10, 20, 30, 40, 50, 60, 70, 80, 90, or 100 amino acid differences to a sequence of a polypeptide encoded by a sequence of an element of Table 10, Table 11, or Table X, or a reverse transcriptase domain or endonuclease domain thereof.

172. Any above-numbered system, wherein the polypeptide comprises a sequence of at least 50 amino acids (e.g., at least 100, 150, 200, 300, 500 amino acids) having at least 80% identity (e.g., at least 85%, 90%, 95%, 97%, 98%, 99%, 100% identity) to a sequence of a polypeptide listed in Table 3A or 3B or a reverse transcriptase domain, endonuclease domain, or DNA binding domain thereof.

173. Any above-numbered system, wherein the polypeptide comprises a sequence of at least 50 amino acids (e.g., at least 100, 150, 200, 300, 500 amino acids) having no more than 10, 20, 30, 40, 50, 60, 70, 80, 90, or 100 amino acid differences to a sequence of a polypeptide listed in Table 3A or 3B or a reverse transcriptase domain, endonuclease domain, or DNA binding domain thereof.

174. Any above-numbered system, wherein the polypeptide comprises a sequence of at least 50 amino acids (e.g., at least 100, 150, 200, 300, 500 amino acids) having at least 80% identity (e.g., at least 85%, 90%, 95%, 97%, 98%, 99%, 100% identity) to the amino acid sequence of column 7 of Table 3A or 3B, or a reverse transcriptase domain, endonuclease domain, or DNA binding domain thereof.

175. Any above-numbered system, wherein the polypeptide comprises a sequence of at least 50 amino acids (e.g., at least 100, 150, 200, 300, 500 amino acids) having no more than 10, 20, 30, 40, 50, 60, 70, 80, 90, or 100 amino acid differences to the amino acid sequence of column 7 of Table 3A or 3B, or a reverse transcriptase domain, endonuclease domain, or DNA binding domain thereof.

176. Any above-numbered system, wherein the template RNA comprises a sequence of an element of Table 10 or Table X (e.g., one or both of a 5' UTR of Table X or 10 and a 3' UTR of Table X or 10), or a sequence having at least 70%, 75%, 80%, 85%, 90%, 95%, 96%, 97%, 98%, or 99% identity thereto.

177. Any above-numbered system, wherein the template RNA comprises a sequence of an element of Table 10 or Table X (e.g., one or both of a 5' UTR of Table X or 10 and a 3' UTR of Table X or 10), or a sequence having no more than 10, 20, 30, 40, 50, 60, 70, 80, 90, or 100 nucleotide differences therefrom.

178. Any above-numbered system, wherein the template RNA comprises a sequence of Table 3A or 3B (e.g., one or both of a 5' UTR of column 5 of Table 3A or 3B and a 3' UTR of column 6 of Table 3A or 3B), or a sequence having at least 70%, 75%, 80%, 85%, 90%, 95%, 96%, 97%, 98%, or 99% identity thereto.

179. Any above-numbered system, wherein the template RNA comprises a sequence of Table 3A or 3B (e.g., one or both of a 5' UTR of column 5 of Table 3A or 3B and a 3' UTR of column 6 of Table 3A or 3B), or a sequence having no more than 10, 20, 30, 40, 50, 60, 70, 80, 90, or 100 nucleotide differences therefrom.

180. Any above-numbered system, wherein the template RNA comprises a sequence having at least 70%, 75%, 80%, 85%, 90%, 95%, 96%, 97%, 98%, 99%, or 100% identity to: (i) the nucleotides located 5' relative to a start codon of a sequence of an element of Table 10 or Table X (e.g., comprising a retrotransposase-binding region).

181. Any above-numbered system, wherein the template RNA comprises a sequence having at least 70%, 75%, 80%, 85%, 90%, 95%, 96%, 97%, 98%, 99%, or 100% identity to: (i) the nucleotides located 3' relative to a stop codon of a sequence of an element of Table 10 or Table X (e.g., comprising a retrotransposase-binding region).

182. The system of any of the preceding embodiments, wherein the template RNA comprises a sequence of about 100-125 bp from a 3' UTR of Table 10 or 11 or column 6 of Table 3A or 3B, e.g., wherein the sequence comprises nucleotides 1-100, 101-200, or 201-325 of the 3' UTR of column 6 of Table 3A or 3B, or a sequence having at least 70%, 75%, 80%, 85%, 90%, 95%, 96%, 97%, 98%, or 99% identity thereto.

183. The system of any of the preceding embodiments, wherein the template RNA comprises a sequence of about 100-125 bp from a 3' UTR of Table 10 or 11 or column 6 of Table 3A or 3B, e.g., wherein the sequence comprises nucleotides 1-100, 101-200, or 201-325 of the 3' UTR of column 6 of Table 3A or 3B, or a sequence having no more than 10, 20, 30, 40, 50, 60, 70, 80, 90, or 100 nucleotide differences therefrom.
184. Any above-numbered system, wherein (a) comprises RNA and (b) comprises RNA.
185. Any above-numbered system, which comprises only RNA, or which comprises more RNA than DNA by an RNA:DNA ratio of at least 10:1, 20:1, 30:1, 40:1, 50:1, 60:1, 70:1, 80:1, 90:1, or 100:1.
186. Any above-numbered system, which does not comprise DNA, or which does not comprise more than 10%, 5%, 4%, 3%, 2%, or 1% DNA by mass or by molar amount.
187. Any above-numbered system, which is capable of modifying DNA by insertion of the heterologous object sequence without an intervening DNA-dependent RNA polymerization of (b).
188. Any above-numbered system, which is capable of modifying DNA by insertion of the heterologous object sequence via target primed reverse transcription.
189. Any above-numbered system, which is capable of modifying DNA by insertion of a heterologous object sequence in the presence of an inhibitor of a DNA repair pathway (e.g., SCR7, a PARP inhibitor), or in a cell line deficient for a DNA repair pathway (e.g., a cell line deficient for the nucleotide excision repair pathway or the homology-directed repair pathway).
190. Any above-numbered system, which does not cause formation of a detectable level of double stranded breaks in a target cell.
191. Any above-numbered system, which is capable of modifying DNA using reverse transcriptase activity, and optionally in the absence of homologous recombination activity.
192. Any above-numbered system, wherein the template RNA has been treated to reduce secondary structure, e.g., was heated, e.g., to a temperature that reduces secondary structure, e.g., to at least 70, 75, 80, 85, 90, or 95° C.
193. The system of any of the preceding embodiments, wherein the template RNA was subsequently cooled, e.g., to a temperature that allows for secondary structure, e.g, to less than or equal to 37, 30, 25, or 20° C.
194. The system of any of the preceding embodiments, wherein the template RNA (or DNA encoding the template RNA) comprises a first homology domain having at least 5 or at least 10 bases of 100% identity to a target DNA strand, at the 5' end of the template RNA, and a second homology domain having at least 5 or at least 10 bases of 100% identity to a target DNA strand, at the 3' end of the template RNA.
195. The system of any of the preceding embodiments, wherein (a) and (b) are part of the same nucleic acid.
196. The system of any of the preceding embodiments, wherein (a) and (b) are separate nucleic acids.
197. The system of any of the preceding embodiments, wherein the template RNA comprises at least 5 or at least 10 bases of 100% identity to a target DNA strand (e.g., wherein the target DNA strand is a human DNA sequence), at the 5' end of the template RNA.
198. The system of any of the preceding embodiments, wherein the template RNA comprises at least 5 or at least 10 bases of 100% identity to a target DNA strand (e.g., wherein the target DNA strand is a human DNA sequence), at the 3' end of the template RNA.
199. The system of any of the preceding embodiments, wherein the polypeptide comprises an active RNase H domain.
200. The system of any of the preceding embodiments, wherein the polypeptide does not comprise an active RNase H domain.
201. The system of any of the preceding embodiments, wherein an endogenous RNase H domain of the polypeptide is inactivated.
202. The system of any of the preceding embodiments, wherein the transposase polypeptide comprises a mutation inactivating and/or deleting a nucleolar localization signal.
203. The system of any of the preceding embodiments, wherein the polypeptide does not comprise a functional nucleolar localization signal, e.g., does not comprise a nucleolar localization signal.
204. The system of any of the preceding embodiments, wherein activity of the nucleolar localization signal is reduced by at least 50%, 60%, 70%, 80%, 90%, 95%, or 99%.
205. The system of any of the preceding embodiments, wherein the polypeptide comprises a nuclear localization signal (NLS), e.g., an endogenous NLS or an exogenous NLS.
206. The system of any of the preceding embodiments, wherein:
the polypeptide comprises (i) a first target DNA binding domain, e.g., comprising a first Zn finger domain, (ii) a reverse transcriptase domain, (iii) an endonuclease domain, and (iv) a second target DNA binding domain, e.g., comprising a second Zn finger domain, heterologous to the first target DNA binding domain; and
wherein (a) binds to a smaller number of target DNA sequences in a target cell than a similar polypeptide that comprises only the first target DNA binding domain, e.g., wherein the presence of the second target DNA binding domain in the polypeptide with the first DNA binding domain refines the target sequence specificity of the polypeptide relative to the polypeptide target sequence specificity of the polypeptide comprising only the first target DNA binding domain.
207. The system of any of the preceding embodiments, wherein (iii) comprises (iv).
208. The system of any of the preceding embodiments, wherein the second target DNA binding domain binds to a genomic DNA sequence that is less than 100, 90, 80, 70, 60, 50, 40, 30, 20, 15, 10, 9, 8, 7, 6, 5, 4, 3, 2, or 1 nucleotides away from a genomic sequence to which the first target DNA binding domain binds.
209. The system of any of the preceding embodiments, wherein the second target DNA binding domain binds to a genomic DNA sequence that is 1-100, 1-90, 1-80, 1-70, 1-60, 1-50, 1-40, 1-30, 1-20, 1-10, 1-5, 5-100, 5-90, 5-80, 5-70, 5-60, 5-50, 5-40, 5-30, 5-20, 5-10, 10-100, 10-90, 10-80, 10-70, 10-60, 10-50, 10-40, 10-30, 10-20, 20-100, 20-90, 20-80, 20-70, 20-60, 20-50, 20-40, 20-30, 30-100, 30-90, 30-80, 30-70, 30-60, 30-50, 30-40, 40-100, 40-90, 40-80, 40-70, 40-60, 40-50, 50-100, 50-90, 50-80, 50-70, 50-60, 60-100, 60-90, 60-80, 60-70, 70-100, 70-90, 70-80, 80-100, 80-90, or 90-100 nucleotides away from a genomic sequence to which the first target DNA binding domain binds.
210. The system of any of the preceding embodiments, wherein the first or second target DNA binding domain comprises a CRISPR/Cas protein, a TAL Effector domain, a Zn finger domain, or a meganuclease domain.

211. The system of any of the preceding embodiments, wherein the system is capable of cutting the first strand of the target DNA at least twice (e.g., twice), and optionally wherein the cuts are at least 2, 3, 4, 5, 6, 7, 8, 9, 10, 15, 20, 25, 30, 40, 50, 60, 70, 80, 90, 100, or 200 nucleotides away one another (and optionally no more than 500, 400, 300, 200, or 100 nucleotides away from one another).

212. The system of any of the preceding embodiments, wherein the system is capable of cutting the first strand and the second strand of the target DNA, and wherein the distance between the cuts is the same as the distance between cuts made by the reverse transcriptase domain, e.g., the reverse transcriptase domain when situated in its endogenous polypeptide.

213. The system of any of the preceding embodiments, wherein the cuts are 1-500, 1-400, 1-300, 1-200, 1-100, 1-90, 1-80, 1-70, 1-60, 1-50, 1-40, 1-30, 1-20, 1-10, 1-5, 5-500, 5-400, 5-300, 5-200, 5-100, 5-90, 5-80, 5-70, 5-60, 5-50, 5-40, 5-30, 5-20, 5-10, 10-500, 10-400, 10-300, 10-200, 10-100, 10-90, 10-80, 10-70, 10-60, 10-50, 10-40, 10-30, 10-20, 20-500, 20-400, 20-300, 20-200, 20-100, 20-90, 20-80, 20-70, 20-60, 20-50, 20-40, 20-30, 30-500, 30-400, 30-300, 30-200, 30-100, 30-90, 30-80, 30-70, 30-60, 30-50, 30-40, 40-500, 40-400, 40-300, 40-200, 40-100, 40-90, 40-80, 40-70, 40-60, 40-50, 50-500, 50-400, 50-300, 50-200, 50-100, 50-90, 50-80, 50-70, 50-60, 60-500, 60-400, 60-300, 60-200, 60-100, 60-90, 60-80, 60-70, 70-500, 70-400, 70-300, 70-200, 70-100, 70-90, 70-80, 80-500, 80-400, 80-300, 80-200, 80-100, 80-90, 90-500, 90-400, 90-300, 90-200, 90-100, 100-500, 100-400, 100-300, 100-200, 200-500, 200-400, 200-300, 300-500, 300-400, or 400-500 nucleotides away from one another.

214. The system of any of the preceding embodiments, wherein the distance between the cuts is the same as the distance between cuts made by the reverse transcriptase domain, e.g., the reverse transcriptase domain when situated in its endogenous polypeptide.

215. The system of any of the preceding embodiments, wherein the two cuts are both made by the same endonuclease domain (e.g., a CRISPR/Cas protein, e.g., directed by a plurality of gRNAs, e.g., disposed in the template RNA).

216. The system of any of the preceding embodiments, wherein the polypeptide further comprises a second endonuclease domain.

217. The system of any of the preceding embodiments, wherein:

i) the first endonuclease domain (e.g., nickase) cuts the to-be-edited strand of the target DNA and the second endonuclease domain (e.g., nickase) cuts the non-edited strand of the target DNA, or ii) the first endonuclease domain (e.g., nickase) makes one of the two cuts to the to-be-edited strand of the target DNA and the second endonuclease domain (e.g., nickase) makes the other cut to the to-be-edited strand of the target DNA.

218. The system of any of the preceding embodiments, wherein (a), (b), or (a) and (b) further comprises a 5' UTR and/or 3' UTR operably linked to the sequence encoding the polypeptide, the heterologous object sequence (e.g., a coding sequence contained in the heterologous object sequence), or both.

219. The system of any of the preceding embodiments, wherein the 5' UTR and/or 3' UTR increase expression of the operably linked sequence(s) by at least 10%, 20%, 30%, 40%, 50%, 70%, 70%, 80%, 90%, or 100% relative to an otherwise similar nucleic acid comprising the endogenous UTR(s) associated with the heterologous object sequence or a minimal 5' UTR and a minimal 3' UTR.

220. The system of any of the preceding embodiments, wherein the template RNA (or DNA encoding the template RNA) comprises (i) a sequence that binds the polypeptide, (ii) a heterologous object sequence, and (iii) a ribozyme that is heterologous to (a)(i), (a)(ii), (b)(i), or a combination thereof.

221. The system of any of the preceding embodiments, wherein (a), (b), or (a) and (b) comprise an intron that increases the expression of the polypeptide, the heterologous object sequence (e.g., a coding sequence situated in the heterologous object sequence), or both.

222. A host cell (e.g., a mammalian cell, e.g., a human cell) comprising any preceding numbered system.

223. A method of modifying a target DNA strand in a cell, tissue or subject, comprising administering any preceding numbered system to the cell, tissue or subject, wherein the system reverse transcribes the template RNA sequence into the target DNA strand, thereby modifying the target DNA strand.

224. The method of any of the preceding embodiments, wherein the cell, tissue or subject is a mammalian (e.g., human) cell, tissue or subject.

225. The method of any of the preceding embodiments, wherein the tissue is liver, lung, skin, blood, immune, or muscle tissue.

226. The method of any of the preceding embodiments, wherein the cell is a fibroblast.

227. The method of any of the preceding embodiments, wherein the cell is a primary cell.

228. The method of any of the preceding embodiments, where in the cell is not immortalized.

229. A method of modifying the genome of a mammalian cell, comprising contacting the cell with:

(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; wherein one, two, or three of (i), (ii), and/or (iii) have an amino acid sequence encoded by a sequence of an element of Table 3B, Table 10, Table 11, or Table X or a sequence having at least 70%, 75%, 80%, 85%, 90%, 95%, 96%, 97%, 98%, or 99% identity thereto; and (b) a template RNA (or DNA encoding the template RNA) comprising (i) a sequence that binds the polypeptide and (ii) a heterologous object sequence.

230. A method of modifying the genome of a mammalian cell, comprising contacting the cell with:

(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; wherein one, two, or three of (i), (ii), and/or (iii) have an amino acid sequence encoded by a sequence having no more than 10, 20, 30, 40, 50, 60, 70, 80, 90, or 100 nucleotide differences therefrom; and (b) a template RNA (or DNA encoding the template RNA) comprising (i) a sequence that binds the polypeptide and (ii) a heterologous object sequence.

231. A method of modifying the genome of a mammalian cell, comprising contacting the cell with:

(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; wherein one, two, or three of (i), (ii), and/or (iii) have an amino acid sequence of an element of Table 3B, Table 10, Table 11, or Table X or a sequence having at least 70%, 75%, 80%, 85%, 90%, 95%, 96%, 97%, 98%, or 99% identity thereto; and (b) a template RNA (or DNA encoding the template RNA) comprising (i) a sequence that binds the polypeptide and (ii) a heterologous object sequence.

232. A method of modifying the genome of a mammalian cell, comprising contacting the cell with:
(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; wherein one, two, or three of (i), (ii), and/or (iii) have an amino acid sequence of an element of Table 3B, Table 10, Table 11, or Table X or a sequence having no more than 10, 20, 30, 40, 50, 60, 70, 80, 90, or 100 nucleotide differences therefrom; and
(b) a template RNA (or DNA encoding the template RNA) comprising (i) a sequence that binds the polypeptide and (ii) a heterologous object sequence.

233. A method of modifying the genome of a mammalian cell, comprising contacting the cell with:
(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; and
(b) a template RNA (or DNA encoding the template RNA) comprising (i) a sequence that binds the polypeptide and (ii) a heterologous object sequence;
wherein the sequence of the template RNA that binds the polypeptide has at least 70%, 75%, 80%, 85%, 90%, 95%, 96%, 97%, 98%, 99%, or 100% identity to a 5' UTR sequence or a 3' UTR sequence of a sequence of an element of Table 3B, Table 10, or Table X.

234. A method of modifying the genome of a mammalian cell, comprising contacting the cell with:
(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; and
(b) a template RNA (or DNA encoding the template RNA) comprising (i) a sequence that binds the polypeptide and (ii) a heterologous object sequence;
wherein the sequence of the template RNA that binds the polypeptide has at least 70%, 75%, 80%, 85%, 90%, 95%, 96%, 97%, 98%, 99%, or 100% identity to: (i) the nucleotides located 5' relative to a start codon of a sequence of an element of Table 3B, Table 10, or Table X (e.g., comprising a retrotransposase-binding region), or (ii) the nucleotides located 3' relative to a stop codon of a sequence of an element of Table 3B, Table 10, or Table X (e.g., comprising a retrotransposase-binding region).

235. A method of modifying the genome of a mammalian cell, comprising contacting the cell with:
(a) a polypeptide or a nucleic acid (e.g., DNA or mRNA) encoding a polypeptide, wherein the polypeptide comprises (i) a reverse transcriptase domain from a protein other than a retrotransposase, e.g., from a retrovirus, e.g., reverse transcriptase domain as listed in Table Z1 or Z2, or a sequence having at least 70%, 75%, 80%, 85%, 90%, 95%, 96%, 97%, 98%, or 99% identity thereto; and (ii) an endonuclease domain; and
(b) a template RNA (or DNA encoding the template RNA) comprising (i) a sequence that binds the polypeptide and (ii) a heterologous object sequence.

236. A method of modifying the genome of a mammalian cell, comprising contacting the cell with:
(a) a polypeptide or a nucleic acid (e.g., DNA or mRNA) encoding a polypeptide, wherein the polypeptide comprises (i) a reverse transcriptase domain from a protein other than a retrotransposase, e.g., from a retrovirus, e.g., reverse transcriptase domain as listed in Table Z1 or Z2, or a sequence having no more than 10, 20, 30, 40, 50, 60, 70, 80, 90, or 100 nucleotide differences therefrom; and (ii) an endonuclease domain; and
(b) a template RNA (or DNA encoding the template RNA) comprising (i) a sequence that binds the polypeptide and (ii) a heterologous object sequence.

237. A method of modifying the genome of a mammalian cell, comprising contacting the cell with:
(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain;
(b) a template RNA (or DNA encoding the template RNA) comprising (i) a sequence that binds the polypeptide and (ii) a heterologous object sequence; and
(c) an intein.

238. The method of any of the preceding embodiments, wherein the polypeptide comprises the intein.

239. The system of any of the preceding embodiments, wherein the intein is a split intein.

240. The method of any of the preceding embodiments, wherein the polypeptide does not comprise a target DNA binding domain.

241. The method of any of the preceding embodiments, wherein the polypeptide is derived from an APE-type retrotransposon reverse transcriptase.

242. The method of any of the preceding embodiments, wherein the polypeptide further comprises a target DNA binding domain, e.g., having an amino acid sequence encoded by a sequence of an element of Table 3B, Table 10, Table 11, or Table X, or a sequence having at least 70%, 75%, 80%, 85%, 90%, 95%, 96%, 97%, 98%, or 99% identity thereto.

243. The method of any of the preceding embodiments, wherein the polypeptide further comprises a target DNA binding domain, e.g., having an amino acid sequence encoded by a sequence of an element of Table 3B, Table 10, Table 11, or Table X, or a sequence having no more than 10, 20, 30, 40, 50, 60, 70, 80, 90, or 100 nucleotide differences therefrom.

244. The method of any of the preceding embodiments, wherein the polypeptide further comprises a target DNA binding domain, e.g., having an amino acid sequence of an element of Table 3B, Table 10, Table 11, or Table X, or a sequence having at least 70%, 75%, 80%, 85%, 90%, 95%, 96%, 97%, 98%, or 99% identity thereto.

245. The method of any of the preceding embodiments, wherein the polypeptide further comprises a target DNA binding domain, e.g., having an amino acid sequence of an element of Table 3B, Table 10, Table 11, or Table X, or a sequence having no more than 10, 20, 30, 40, 50, 60, 70, 80, 90, or 100 nucleotide differences therefrom.

246. A method of modifying the genome of a mammalian cell, comprising contacting the cell with:
  (a) an RNA encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; wherein one, two, or three of (i), (ii), and/or (iii) have an amino acid sequence encoded by a sequence of an element of Table 3B, Table 10, Table 11, or Table X or a sequence having at least 70%, 75%, 80%, 85%, 90%, 95%, 96%, 97%, 98%, or 99% identity thereto; and
  (b) a template RNA comprising (i) a sequence that binds the polypeptide and (ii) a heterologous object sequence, wherein the method does not comprise contacting the mammalian cell with DNA, or
  wherein the compositions of (a) and (b) do not comprise more than 1%, 0.5%, 0.2%, 0.1%, 0.05%, 0.02%, or 0.01% DNA by mass or by molar amount of nucleic acid.

247. A method of modifying the genome of a mammalian cell, comprising contacting the cell with:
  (a) an RNA encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; wherein one, two, or three of (i), (ii), and/or (iii) have an amino acid sequence encoded by a sequence of an element of Table 3B, Table 10, Table 11, or Table X or a sequence having no more than 10, 20, 30, 40, 50, 60, 70, 80, 90, or 100 nucleotide differences therefrom; and
  (b) a template RNA comprising (i) a sequence that binds the polypeptide and (ii) a heterologous object sequence, wherein the method does not comprise contacting the mammalian cell with DNA, or wherein the compositions of (a) and (b) do not comprise more than 1%, 0.5%, 0.2%, 0.1%, 0.05%, 0.02%, or 0.01% DNA by mass or by molar amount of nucleic acid.

248. A method of modifying the genome of a mammalian cell, comprising contacting the cell with:
  (a) an RNA encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; wherein one, two, or three of (i), (ii), and/or (iii) have an amino acid sequence of an element of Table 3B, Table 10, Table 11, or Table X or a sequence having at least 70%, 75%, 80%, 85%, 90%, 95%, 96%, 97%, 98%, or 99% identity thereto; and
  (b) a template RNA comprising (i) a sequence that binds the polypeptide and (ii) a heterologous object sequence, wherein the method does not comprise contacting the mammalian cell with DNA, or wherein the compositions of (a) and (b) do not comprise more than 1%, 0.5%, 0.2%, 0.1%, 0.05%, 0.02%, or 0.01% DNA by mass or by molar amount of nucleic acid.

249. A method of modifying the genome of a mammalian cell, comprising contacting the cell with:
  (a) an RNA encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; wherein one, two, or three of (i), (ii), and/or (iii) have an amino acid sequence of an element of Table 3B, Table 10, Table 11, or Table X or a sequence having no more than 10, 20, 30, 40, 50, 60, 70, 80, 90, or 100 nucleotide differences therefrom; and
  (b) a template RNA comprising (i) a sequence that binds the polypeptide and (ii) a heterologous object sequence, wherein the method does not comprise contacting the mammalian cell with DNA, or wherein the compositions of (a) and (b) do not comprise more than 1%, 0.5%, 0.2%, 0.1%, 0.05%, 0.02%, or 0.01% DNA by mass or by molar amount of nucleic acid.

250. The method of any of the preceding embodiments, which results in the addition of at least 1, 5, 10, 20, 50, 100, 200, 500, 1,000, 2,000, or 5,000 base pairs of exogenous DNA sequence to the genome of the mammalian cell.

251. The method of any of the preceding embodiments, which results in the deletion of at least 1, 2, 3, 4, 5, 10, 20, 50, 100, 200, 500, 1,000, 2,000, or 5,000 base pairs of DNA sequence from the genome of the mammalian cell.

252. The method of any of the preceding embodiments, which results in the alteration of at least 1, 2, 3, 4, 5, 10, 20, 50, 100, 200, 500, 1,000, 2,000, or 5,000 base pairs of DNA sequence from the genome of the mammalian cell.

253. The method of any of the preceding embodiments, which results in the addition of a protein coding sequence to the genome of the mammalian cell.

254. The method of any of the preceding embodiments, which results in the deletion of a protein coding sequence to the genome of the mammalian cell.

255. The method of any of the preceding embodiments, which results in the alteration of a protein coding sequence to the genome of the mammalian cell.

256. The method of any of the preceding embodiments, which results in the addition of a non-coding sequence to the genome of the mammalian cell, e.g., encoding a non-coding RNA, e.g., a miRNA.

257. The method of any of the preceding embodiments, which results in the deletion of a non-coding sequence to the genome of the mammalian cell, e.g., encoding a non-coding RNA, e.g., a miRNA.

258. The method of any of the preceding embodiments, which results in the alteration of a non-coding sequence to the genome of the mammalian cell, e.g., encoding a non-coding RNA, e.g., a miRNA.

259. The method of any of the preceding embodiments, which results in the addition of a regulatory sequence to the genome of the mammalian cell, e.g., a promoter, an enhancer, a miRNA binding site.

260. The method of any of the preceding embodiments, which results in the deletion of a regulatory sequence to the genome of the mammalian cell, e.g., a promoter, an enhancer, a miRNA binding site.

261. The method of any of the preceding embodiments, which results in the alteration of a regulatory sequence to the genome of the mammalian cell, e.g., a promoter, an enhancer, a miRNA binding site.

262. The method of any of the preceding embodiments, wherein the addition, deletion, or alteration of the regulatory sequence to the genome of the mammalian cell results in increased expression of a coding or non-coding sequence in the genome of the mammalian cell.

263. The method of any of the preceding embodiments, wherein the addition, deletion, or alteration of the regulatory sequence to the genome of the mammalian cell results in decreased expression of a coding or non-coding sequence in the genome of the mammalian cell.

264. A method of inserting DNA into the genome of a mammalian cell, comprising contacting the cell with an RNA composition, wherein the RNA composition comprises:
   (a) a first RNA that directs insertion of a template RNA into the genome, and
   (b) a template RNA comprising a heterologous sequence, wherein the method does not comprise contacting the mammalian cell with DNA, or wherein the compositions of (a) and (b) do not comprise more than 1%, 0.5%, 0.2%, 0.1%, 0.05%, 0.02%, or 0.01% DNA by mass or by molar amount of nucleic acid,
   wherein the method results in the addition of at least 1, 5, 10, 20, 50, 100, 200, 500, 1,000, 2,000, or 5,000 base pairs of DNA (e.g., exogenous DNA) sequence to the genome of the mammalian cell; and
   wherein the first RNA encodes a polypeptide encoded by a sequence of an element of Table 3B, Table 10, Table 11, or Table X, or a sequence having at least 70%, 75%, 80%, 85%, 90%, 95%, 96%, 97%, 98%, or 99% identity thereto, wherein the polypeptide directs insertion of the template RNA into the genome.

265. A method of inserting DNA into the genome of a mammalian cell, comprising contacting the cell with an RNA composition, wherein the RNA composition comprises:
   (a) a first RNA that directs insertion of a template RNA into the genome, and
   (b) a template RNA comprising a heterologous sequence, wherein the method does not comprise contacting the mammalian cell with DNA, or wherein the compositions of (a) and (b) do not comprise more than 1%, 0.5%, 0.2%, 0.1%, 0.05%, 0.02%, or 0.01% DNA by mass or by molar amount of nucleic acid,
   wherein the method results in the addition of at least 1, 5, 10, 20, 50, 100, 200, 500, 1,000, 2,000, or 5,000 base pairs of DNA (e.g., exogenous DNA) sequence to the genome of the mammalian cell; and
   wherein the first RNA encodes a polypeptide encoded by a sequence of an element of Table 3B, Table 10, Table 11, or Table X, or a sequence having no more than 10, 20, 30, 40, 50, 60, 70, 80, 90, or 100 nucleotide differences therefrom, wherein the polypeptide directs insertion of the template RNA into the genome.

266. A method of inserting DNA into the genome of a mammalian cell, comprising contacting the cell with an RNA composition, wherein the RNA composition comprises:
   (a) a first RNA that directs insertion of a template RNA into the genome, and
   (b) a template RNA comprising a heterologous sequence, wherein the method does not comprise contacting the mammalian cell with DNA, or wherein the compositions of (a) and (b) do not comprise more than 1%, 0.5%, 0.2%, 0.1%, 0.05%, 0.02%, or 0.01% DNA by mass or by molar amount of nucleic acid,
   wherein the method results in the addition of at least 5, 10, 20, 50, 100, 200, 500, 1,000, 2,000, or 5,000 base pairs of DNA (e.g., exogenous DNA) sequence to the genome of the mammalian cell; and
   wherein the first RNA encodes a polypeptide of an element of Table 3B, Table 10, Table 11, or Table X, or a sequence having at least 70%, 75%, 80%, 85%, 90%, 95%, 96%, 97%, 98%, or 99% identity thereto, wherein the polypeptide directs insertion of the template RNA into the genome.

267. A method of inserting DNA into the genome of a mammalian cell, comprising contacting the cell with an RNA composition, wherein the RNA composition comprises:
   (a) a first RNA that directs insertion of a template RNA into the genome, and
   (b) a template RNA comprising a heterologous sequence, wherein the method does not comprise contacting the mammalian cell with DNA, or wherein the compositions of (a) and (b) do not comprise more than 1%, 0.5%, 0.2%, 0.1%, 0.05%, 0.02%, or 0.01% DNA by mass or by molar amount of nucleic acid,
   wherein the method results in the addition of at least 5, 10, 20, 50, 100, 200, 500, 1,000, 2,000, or 5,000 base pairs of DNA (e.g., exogenous DNA) sequence to the genome of the mammalian cell; and
   wherein the first RNA encodes a polypeptide of an element of Table 3B, Table 10, Table 11, or Table X, or a sequence having no more than 10, 20, 30, 40, 50, 60, 70, 80, 90, or 100 nucleotide differences therefrom, wherein the polypeptide directs insertion of the template RNA into the genome.

268. A method of inserting DNA into the genome of a mammalian cell, comprising contacting the cell with an RNA composition, wherein the RNA composition comprises:
   (a) a first RNA that directs insertion of a template RNA into the genome, and
   (b) a template RNA comprising a heterologous sequence and (i) a flanking sequence having at least 70%, 75%, 80%, 85%, 90%, 95%, 96%, 97%, 98%, 99%, or 100% identity to a 5' UTR sequence of a sequence of an element of Table 3B, Table 10, or Table X, and/or (ii) a flanking sequence having at least 70%, 75%, 80%, 85%, 90%, 95%, 96%, 97%, 98%, 99%, or 100% identity to a 3' UTR sequence of a sequence of an element of Table 3B, Table 10, or Table X,
   wherein the method does not comprise contacting the mammalian cell with DNA, or wherein the compositions of (a) and (b) do not comprise more than 1%, 0.5%, 0.2%, 0.1%, 0.05%, 0.02%, or 0.01% DNA by mass or by molar amount of nucleic acid,
   wherein the method results in the addition of at least 1, 5, 10, 20, 50, 100, 200, 500, 1,000, 2,000, or 5,000 base pairs of DNA (e.g., exogenous DNA) sequence to the genome of the mammalian cell.

269. A method of inserting DNA into the genome of a mammalian cell, comprising contacting the cell with an RNA composition, wherein the RNA composition comprises:
   (a) a first RNA that directs insertion of a template RNA into the genome, and
   (b) a template RNA comprising a heterologous sequence and (i) a flanking sequence having at least 70%, 75%, 80%, 85%, 90%, 95%, 96%, 97%, 98%, 99%, or 100% identity to the nucleotides located 5' relative to a start codon of a sequence of an element of Table 3B, Table 10, or Table X (e.g., comprising a retrotransposase-binding region), and/or (ii) a flanking sequence having at least 70%, 75%, 80%, 85%, 90%, 95%, 96%, 97%, 98%, 99%, or 100% identity to the nucleotides located 3' relative to a stop codon of a sequence of an element of Table 3B, Table 10, or Table X (e.g., comprising a retrotransposase-binding region), wherein the method does not comprise contacting the mammalian cell with DNA, or wherein the compositions of (a) and (b) do not comprise more than 1%, 0.5%, 0.2%, 0.1%, 0.05%, 0.02%, or 0.01% DNA by mass or by molar amount of nucleic acid, wherein the method results in the addition of at least 1, 5, 10, 20, 50, 100, 200, 500, 1,000, 2,000, or 5,000 base pairs of DNA (e.g., exogenous DNA) sequence to the genome of the mammalian cell.

270. The method of any of the preceding embodiments, wherein the template RNA further comprises a sequence that binds the polypeptide; optionally wherein the sequence that binds the polypeptide has:

(a) at least 70%, 75%, 80%, 85%, 90%, 95%, 96%, 97%, 98%, 99%, or 100% identity to a 5' UTR sequence or a 3' UTR sequence of a sequence of an element of Table 3B, Table 10, or Table X; or (b) at least 70%, 75%, 80%, 85%, 90%, 95%, 96%, 97%, 98%, 99%, or 100% identity to: (i) the nucleotides located 5' relative to a start codon of a sequence of an element of Table 3B, Table 10, or Table X (e.g., comprising a retrotransposase-binding region), or (ii) the nucleotides located 3' relative to a stop codon of a sequence of an element of Table X (e.g., comprising a retrotransposase-binding region).

271. The method of any of the preceding embodiments, wherein at least 1, 5, 10, 15, 20, 25, 30, 35, 40, 45, 50, 60, 70, 80, 90, 100, 150, 200, 250, 300, 350, 400, 500, 1000 bp of exogenous DNA are added to the genome of a mammalian cell, without delivery of DNA to the cell.

272. The method of any of the preceding embodiments, wherein at least 1, 5, 10, 15, 20, 25, 30, 35, 40, 45, 50, 60, 70, 80, 90, 100, 150, 200, 250, 300, 350, 400, 500, 1000 bp of exogenous DNA are added to the genome of a mammalian cell, wherein the method does not comprise contacting the mammalian cell with DNA, or wherein the method comprises contacting the mammalian cell with a composition comprising less than 1%, 0.5%, 0.2%, 0.1%, 0.05%, 0.02%, or 0.01% DNA by mass or by molar amount of nucleic acid.

273. The method of any of the preceding embodiments, wherein at least 1, 5, 10, 15, 20, 25, 30, 35, 40, 45, 50, 60, 70, 80, 90, 100, 150, 200, 250, 300, 350, 400, 500, 1000 bp of exogenous DNA are added to the genome of a mammalian cell, wherein the only RNA is delivered to the mammalian cell.

274. The method of any of the preceding embodiments, wherein at least at least 1, 5, 10, 15, 20, 25, 30, 35, 40, 45, 50, 60, 70, 80, 90, 100, 150, 200, 250, 300, 350, 400, 500, 1000 bp of exogenous DNA are added to the genome of a mammalian cell, wherein RNA and protein are delivered to the mammalian cell.

275. The method of any of the preceding embodiments, wherein the template RNA serves as the template for insertion of the exogenous DNA.

276. The method of any of the preceding embodiments, which does not comprise DNA-dependent RNA polymerization of exogenous DNA.

277. The method of any of the preceding embodiments, which results in the addition of at least 1, 5, 10, 20, 50, 100, 200, 500, 1,000, 2,000, or 5,000 base pairs of DNA to the genome of the mammalian cell.

278. The methods of any of the preceding embodiments, wherein the RNA of (a) and the RNA of (b) are covalently linked, e.g., are part of the same transcript.

279. The methods of any of the preceding embodiments, wherein the RNA of (a) and the RNA of (b) are separate RNAs.

280. The method of any of the preceding embodiments, which does not comprise contacting the mammalian cell with a template DNA.

281. A method of modifying the genome of a human cell, comprising contacting the cell with:

(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or 72), (ii) an endonuclease domain, and optionally (iii) a DNA-binding domain; wherein one, two, or three of (i), (ii), and/or (iii) have an amino acid sequence encoded by a sequence of an element of Table 3B, Table 10, Table 11, or Table X or a sequence having at least 70%, 75%, 80%, 85%, 90%, 95%, 96%, 97%, 98%, or 99% identity thereto; and (b) a template RNA (or DNA encoding the template RNA) comprising (i) a sequence that binds the polypeptide and (ii) a heterologous object sequence, wherein the method results in insertion of the heterologous object sequence into the human cell's genome, wherein the human cell does not show upregulation of any DNA repair genes and/or tumor suppressor genes, or wherein no DNA repair gene and/or tumor suppressor gene is upregulated by more than 50%, 25%, 10%, 5%, 2%, or 1%, e.g., wherein upregulation is measured by RNA-seq.

282. A method of modifying the genome of a human cell, comprising contacting the cell with:

(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; wherein one, two, or three of (i), (ii), and/or (iii) have an amino acid sequence encoded by a sequence of an element of Table 3B, Table 10, Table 11, or Table X or a sequence having no more than 10, 20, 30, 40, 50, 60, 70, 80, 90, or 100 nucleotide differences therefrom; and (b) a template RNA (or DNA encoding the template RNA) comprising (i) a sequence that binds the polypeptide and (ii) a heterologous object sequence, wherein the method results in insertion of the heterologous object sequence into the human cell's genome, wherein the human cell does not show upregulation of any DNA repair genes and/or tumor suppressor genes, or wherein no DNA repair gene and/or tumor suppressor gene is upregulated by more than 50%, 25%, 10%, 5%, 2%, or 1%, e.g., wherein upregulation is measured by RNA-seq, e.g., as described in Example 14 of PCT/US2019/048607, herein incorporated by reference in its entirety.

283. A method of modifying the genome of a human cell, comprising contacting the cell with:

(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; wherein one, two, or three of (i), (ii), and/or (iii) have an amino acid sequence of an element of Table 3B, Table 10, Table 11, or Table X or a sequence having at least 70%, 75%, 80%, 85%, 90%, 95%, 96%, 97%, 98%, or 99% identity thereto; and (b) a template RNA (or DNA encoding the template RNA) comprising (i) a sequence that binds the polypeptide and (ii) a heterologous object sequence, wherein the method results in insertion of the heterologous object sequence into the human cell's genome, wherein the human cell does not show upregulation of any DNA repair genes and/or tumor suppressor genes, or wherein no DNA repair gene and/or tumor suppressor gene is upregulated by more than 50%, 25%, 10%, 5%, 2%, or 1%, e.g., wherein upregulation is measured by RNA-seq.

284. A method of modifying the genome of a human cell, comprising contacting the cell with:

(a) a polypeptide or a nucleic acid encoding a polypeptide, wherein the polypeptide comprises (i) a reverse transcriptase domain (e.g., as listed in Table 3B, Table 10, Table 11, Table X, or Z1 or Z2), (ii) an endonuclease domain, and optionally (iii) a DNA-binding domain; wherein one, two, or three of (i), (ii), and/or (iii) have an amino acid sequence of an element of Table 3B, Table 10, Table 11, or Table X or a sequence having no more than 10, 20, 30, 40, 50, 60, 70, 80, 90, or 100 nucleotide differences therefrom; and (b) a template RNA (or DNA encoding the template RNA) comprising (i) a sequence that binds the polypeptide and (ii) a heterologous object sequence, wherein the method results in insertion of the heterologous object sequence into the human cell's genome, wherein the human cell does not show upregulation of any DNA repair genes and/or tumor suppressor genes, or wherein no DNA repair gene and/or tumor suppressor gene is upregulated by more than 50%, 25%, 10%, 5%, 2%, or 1%, e.g., wherein upregulation is measured by RNA-seq.

285. A method of modifying the genome of a human cell, comprising contacting the cell with:

(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; and (b) a template RNA (or DNA encoding the template RNA) comprising (i) a sequence that binds the polypeptide having at least 70%, 75%, 80%, 85%, 90%, 95%, 96%, 97%, 98%, 99%, or 100% identity to a 5' UTR sequence or a 3' UTR sequence of a sequence of an element of Table 3B, Table 10, Table 11, or Table X, and (ii) a heterologous object sequence, wherein the method results in insertion of the heterologous object sequence into the human cell's genome, wherein the human cell does not show upregulation of any DNA repair genes and/or tumor suppressor genes, or wherein no DNA repair gene and/or tumor suppressor gene is upregulated by more than 50%, 25%, 10%, 5%, 2%, or 1%, e.g., wherein upregulation is measured by RNA-seq.

286. A method of modifying the genome of a human cell, comprising contacting the cell with:

(a) a polypeptide or a nucleic acid encoding a polypeptide, wherein the polypeptide comprises (i) a reverse transcriptase domain (e.g., as listed in Table 3B, Table 10, Table 11, Table X, or Table Z1 or Z2), (ii) an endonuclease domain, and optionally (iii) a DNA-binding domain; and (b) a template RNA (or DNA encoding the template RNA) comprising (i) a sequence that binds the polypeptide having at least 70%, 75%, 80%, 85%, 90%, 95%, 96%, 97%, 98%, 99%, or 100% identity to: (i) the portion of a sequence of an element of Table 3B, Table 10, or Table X consisting of the nucleotides located 5' relative to the start codon, or (ii) the portion of a sequence of an element of Table 3B, Table 10, or Table X consisting of the nucleotides located 3' relative to the stop codon, wherein the method results in insertion of the heterologous object sequence into the human cell's genome, wherein the human cell does not show upregulation of any DNA repair genes and/or tumor suppressor genes, or wherein no DNA repair gene and/or tumor suppressor gene is upregulated by more than 50%, 25%, 10%, 5%, 2%, or 1%, e.g., wherein upregulation is measured by RNA-seq.

287. A method of adding an exogenous coding region to the genome of a cell (e.g., a mammalian cell), comprising contacting the cell with: (i) an RNA comprising the non-coding strand of the exogenous coding region, wherein optionally the RNA does not comprise a coding strand of the exogenous coding region, and (ii) a polypeptide comprising a sequence of an element of Table 3B, Table 10, Table 11, or Table X or a sequence having at least 70%, 75%, 80%, 85%, 90%, 95%, 96%, 97%, 98%, or 99% identity thereto, wherein optionally the delivery comprises non-viral delivery.

288. A method of adding an exogenous coding region to the genome of a cell (e.g., a mammalian cell), comprising contacting the cell with: (i) an RNA comprising the non-coding strand of the exogenous coding region, wherein optionally the RNA does not comprise a coding strand of the exogenous coding region, and (ii) a polypeptide comprising a sequence of an element of Table 3B, Table 10, Table 11, or Table X or a sequence having no more than 10, 20, 30, 40, 50, 60, 70, 80, 90, or 100 nucleotide differences therefrom, wherein optionally the delivery comprises non-viral delivery.

289. A method of expressing a polypeptide of interest in a cell (e.g., a mammalian cell), comprising contacting the cell with: (i) an RNA, wherein the RNA comprises a non-coding strand that is the reverse complement of a sequence that would encoding the polypeptide of interest, wherein optionally the RNA does not comprise a coding strand encoding the polypeptide of interest, and (ii) and a retrotransposase polypeptide comprising an amino acid sequence encoded by a sequence of an element of Table 3B, Table 10, Table 11, or Table X, or a sequence having at least 70%, 75%, 80%, 85%, 90%, 95%, 96%, 97%, 98%, or 99% identity thereto, wherein optionally the delivery comprises non-viral delivery.

290. A method of expressing a polypeptide of interest in a cell (e.g., a mammalian cell), comprising contacting the cell with: (i) an RNA, wherein the RNA comprises a non-coding strand that is the reverse complement of a sequence that would encoding the polypeptide of interest, wherein optionally the RNA does not comprise a coding strand encoding the polypeptide of interest, and (ii) and a retrotransposase polypeptide comprising an amino acid sequence encoded by a sequence of an element of Table 3B, Table 10, Table 11, or Table X, or a sequence having no more than 10, 20, 30, 40, 50, 60, 70, 80, 90, or 100 nucleotide differences therefrom, wherein optionally the delivery comprises non-viral delivery.

291. A method of expressing a polypeptide of interest in a cell (e.g., a mammalian cell), comprising contacting the cell with: (i) an RNA, wherein the RNA comprises a non-coding strand that is the reverse complement of a sequence that would encoding the polypeptide of interest, wherein optionally the RNA does not comprise a coding strand encoding the polypeptide of interest, and (ii) a retrotransposase polypeptide comprising an amino acid sequence encoded by a sequence of an element of Table 3B, Table 10, Table 11, or Table X, or a sequence having at least 70%, 75%, 80%, 85%, 90%, 95%, 96%, 97%, 98%, or 99% identity thereto, wherein optionally the delivery comprises non-viral delivery.

292. A method of expressing a polypeptide of interest in a cell (e.g., a mammalian cell), comprising contacting the cell with: (i) an RNA, wherein the RNA comprises a non-coding strand that is the reverse complement of a sequence that would encoding the polypeptide of interest, wherein optionally the RNA does not comprise a coding strand encoding the polypeptide of interest, and (ii) a retrotransposase polypeptide comprising an amino acid sequence encoded by a sequence of an element of Table 3B, Table 10, Table 11, or Table X, or a sequence having no more than 10, 20, 30, 40, 50, 60, 70, 80, 90, or 100 nucleotide differences therefrom, wherein optionally the delivery comprises non-viral delivery.

293. The method of any of the preceding embodiments, wherein the sequence that is inserted into the mammalian genome is a sequence that is exogenous to the mammalian genome.

294. The method of any of the preceding embodiments, wherein the exogenous sequence inserted into the mammalian genome does not naturally occur elsewhere in the mammalian genome.

295. The method of any of the preceding embodiments, wherein the exogenous sequence inserted into the mammalian genome naturally occurs elsewhere in the mammalian genome.

296. The method of any of the preceding embodiments, which operates independently of a DNA template.

297. The method of any of the preceding embodiments, wherein the cell is part of a tissue.

298. The method of any of the preceding embodiments, wherein the mammalian cell is euploid, is not immortalized, is part of an organism, is a primary cell, is non-dividing, is a hepatocyte, or is from a subject having a genetic disease.

299. The method of any of the preceding embodiments, wherein the mammalian cell is in a subject does not have a disease, e.g., for supplementing the genome of the subject.

300. The method of any of the preceding embodiments, wherein the contacting comprises contacting the cell with a plasmid, virus, viral-like particle, virosome, liposome, vesicle, exosome, fusosome, or lipid nanoparticle.

301. The method of any of the preceding embodiments, wherein the contacting comprises using non-viral delivery.

302. The method of any of the preceding embodiments, which comprises comprising contacting the cell with the template RNA (or DNA encoding the template RNA), wherein the template RNA comprises the non-coding strand of an exogenous coding region, wherein optionally the template RNA does not comprise a coding strand of the exogenous coding region, wherein optionally the delivery comprises non-viral delivery, thereby adding the exogenous coding region to the genome of the cell.

303. The method of any of the preceding embodiments, which comprises contacting the cell with the template RNA (or DNA encoding the template RNA), wherein the template RNA comprises a non-coding strand that is the reverse complement of a sequence encoding the polypeptide, wherein optionally the template RNA does not comprise a coding strand encoding the polypeptide, wherein optionally the delivery comprises non-viral delivery, thereby adding the exogenous coding region to the genome of the cell and expressing the polypeptide in the cell.

304. The method of any of the preceding embodiments, wherein the contacting comprises administering (a) and (b) to a subject, e.g., intravenously.

305. The method of any of the preceding embodiments, wherein the contacting comprises administering a dose of (a) and (b) to a subject at least twice.

306. The method of any of the preceding embodiments, wherein the polypeptide reverse transcribes the template RNA sequence into the target DNA strand, thereby modifying the target DNA strand.

307. The method of any of the preceding embodiments, wherein (a) and (b) are administered separately.

308. The method of any of the preceding embodiments, wherein (a) and (b) are administered together.

309. The method of any of the preceding embodiments, wherein the nucleic acid of (a) is not integrated into the genome of the host cell.

310. The method of any of the preceding embodiments, wherein the tissue is liver, lung, skin, muscle tissue (e.g., skeletal muscle), eye or ocular tissue, or central nervous system.

311. The method of any of the preceding embodiments, wherein the cell is a hematopoietic stem cell (HSC), a T-cell, or a Natural Killer (NK) cell.

312. Any preceding numbered method, wherein the sequence that binds the polypeptide has one or more of the following characteristics:
    (a) is at the 3' end of the template RNA;
    (b) is at the 5' end of the template RNA;
    (b) is a non-coding sequence;
    (c) is a structured RNA;
    (d) forms at least 1 hairpin loop structures; and/or
    (e) is a guide RNA.

313. Any preceding numbered method, wherein the template RNA further comprises a sequence comprising at least 20 nucleotides of at least 80% identity (e.g., at least 85%, 90%, 95%, 97%, 98%, 99%, 100% identity) to a target DNA strand.

314. Any preceding numbered method, wherein the template RNA further comprises a sequence comprising at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150 nucleotides of at least 80% identity (e.g., at least 85%, 90%, 95%, 97%, 98%, 99%, 100% identity) to a target DNA strand.

315. Any preceding numbered method, wherein the sequence comprising at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150 nucleotides, or about: 2-10, 10-20, 20-30, 30-40, 40-50, 50-60, 60-70, 70-80, 80-90, 90-100, 10-100, or 2-100 nucleotides, of at least 80% identity to a target DNA strand is at the 3' end of the template RNA.

316. Any preceding numbered method, wherein the template RNA further comprises a sequence comprising at least 100 nucleotides of at least 80% identity (e.g., at least 85%, 90%, 95%, 97%, 98%, 99%, 100% identity) to a target DNA strand, e.g., at the 3' end of the template RNA.

317. The method of any of the preceding embodiments, wherein the site in the target DNA strand to which the sequence comprises at least 80% identity is proximal to (e.g., within about: 0-10, 10-20, 20-30, 30-50, or 50-100 nucleotides of) a target site on the target DNA strand that is recognized (e.g., bound and/or cleaved) by the polypeptide comprising the endonuclease.

318. Any preceding numbered method, wherein the target RNA comprises a homology domain that comprises a sequence according to a 3' homology arm of Table 11, or a sequence having at least 80%, 85%, 90%, 95%, 96%, 97%, 98%, or 99% identity thereto.

319. Any preceding numbered method, wherein the target RNA comprises a homology domain that comprises a sequence according to a 5' homology arm of Table 11, or a sequence having at least 80%, 85%, 90%, 95%, 96%, 97%, 98%, or 99% identity thereto.

320. Any preceding numbered method, wherein the sequence comprising at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150 nucleotides, or about: 2-10, 10-20, 20-30, 30-40, 40-50, 50-60, 60-70, 70-80, 80-90, 90-100, 10-100, or 2-100 nucleotides, of at least 80% identity to a target DNA strand is at the 3' end of the template RNA;
optionally wherein the site in the target DNA strand to which the sequence comprises at least 80% identity is proximal to (e.g., within about: 0-10, 10-20, or 20-30 nucleotides of) a target site on the target DNA strand that is recognized (e.g., bound and/or cleaved) by the polypeptide comprising the endonuclease.

321. The method of any of the preceding embodiments, wherein the target site is the site in the human genome that has the closest identity to a native target site of the polypeptide comprising the endonuclease, e.g., wherein the target site in the human genome has at least about: 16, 17, 18, 19, or 20 nucleotides identical to the native target site.

322. Any preceding numbered method, wherein the template RNA has at least 3, 4, 5, 6, 7, 8, 9, or 10 bases of 100% identity to the target DNA strand.

323. Any preceding numbered method, wherein the at least 3, 4, 5, 6, 7, 8, 9, or 10 bases of 100% identity to the target DNA strand are at the 3' end of the template RNA.

324. Any preceding numbered method, wherein the at least 3, 4, 5, 6, 7, 8, 9, or 10 bases of 100% identity to the target DNA strand are at the 5' end of the template RNA.

325. Any preceding numbered method, wherein the template RNA comprises at least 3, 4, 5, 6, 7, 8, 9, or 10 bases of 100% identity to the target DNA strand at the 5' end of the template RNA and at least 3, 4, 5, 6, 7, 8, 9, or 10 bases of 100% identity to the target DNA strand at the 3' end of the template RNA.

326. Any preceding numbered method, wherein the heterologous object sequence is between 50-50,000 base pairs (e.g., between 50-40,000 bp, between 500-30,000 bp between 500-20,000 bp, between 100-15,000 bp, between 500-10,000 bp, between 50-10,000 bp, between 50-5,000 bp).

327. Any preceding numbered method, wherein the heterologous object sequence is at least 1, 10, 25, 50, 100, 150, 200, 250, 300, 400, 500, 600, or 700 bp.

328. Any preceding numbered method, wherein the heterologous object sequence is at least 715, 750, 800, 950, 1,000, 2,000, 3,000, or 4,000 bp.

329. Any preceding numbered method, wherein the heterologous object sequence is less than 5,000, 10,000, 15,000, 20,000, 30,000, or 40,000 bp.

330. Any preceding numbered method, wherein the heterologous object sequence is less than 700, 600, 500, 400, 300, 200, 150, or 100 bp.

331. Any preceding numbered method, wherein the heterologous object sequence comprises one or more of:

(a) an open reading frame, e.g., a sequence encoding a polypeptide, e.g., an enzyme (e.g., a lysosomal enzyme), a membrane protein, a blood factor, an exon, an intracellular protein (e.g., a cytoplasmic protein, a nuclear protein, an organellar protein such as a mitochondrial protein or lysosomal protein), an extracellular protein, a structural protein, a signaling protein, a regulatory protein, a transport protein, a sensory protein, a motor protein, a defense protein, a storage protein, or an immune receptor protein (e.g., a chimeric antigen receptor (CAR) protein, a T cell receptor, a B cell receptor), or an antibody;

(b) a non-coding and/or regulatory sequence, e.g., a sequence that binds a transcriptional modulator, e.g., a promoter, an enhancer, an insulator;

(c) a splice acceptor site;

(d) a polyA site;

(e) an epigenetic modification site; or (f) a gene expression unit.

332. Any preceding numbered method, wherein the target DNA is a genomic safe harbor (GSH) site.

333. Any preceding numbered method, wherein the target DNA is a genomic Natural Harbor™ site.

334. Any preceding numbered method, which results in insertion of the heterologous object sequence into the genome at an average copy number of at least 0.01, 0.025, 0.05, 0.075, 0.1, 0.15, 0.2, 0.25, 0.3, 0.4, 0.5, 0.75, 1, 1.25, 1.5, 1.75, 2, 2.5, 3, 4, or 5 copies per genome.

335. Any preceding numbered method, which results in about 25-100%, 50-100%, 60-100%, 70-100%, 75-95%, 80%-90%, of integrants into a target site in the genome being non-truncated, as measured by an assay described herein, e.g., an assay of Example 6 of PCT Application No. PCT/US2019/048607.

336. Any preceding numbered method, which results in insertion of the heterologous object sequence only at one target site in the genome of the cell.

337. Any preceding numbered method, which results in insertion of the heterologous object sequence into a target site in a cell, wherein the inserted heterologous sequence comprises less than 10%, 5%, 2%, 1%, 0.5%, 0.2%, or 0.1% mutations (e.g., SNPs or one or more deletions, e.g., truncations or internal deletions) relative to the heterologous sequence prior to insertion, e.g., as measured by an assay of Example 12 of PCT Application No. PCT/US2019/048607.

338. Any preceding numbered method, which results in insertion of the heterologous object sequence into a target site in a plurality of cells, wherein less than 10%, 5%, 2%, or 1% of copies of the inserted heterologous sequence comprise a mutation (e.g., a SNP or a deletion, e.g., a truncation or an internal deletion), e.g., as measured by an assay of Example 12 of PCT Application No. PCT/US2019/048607.

339. Any preceding numbered method, which results in insertion of the heterologous object sequence into a target cell genome, and wherein the target cell does not show upregulation of p53, or shows upregulation of p53 by less than 50%, 25%, 10%, 5%, 2%, or 1%, e.g., wherein upregulation of p53 is measured by p53 protein level, e.g., according to the method described in Example 30, or by the level of p53 phosphorylated at Ser15 and Ser20.

340. Any preceding numbered method, which results in insertion of the heterologous object sequence into a target cell genome, and wherein the target cell does not show upregulation of any DNA repair genes and/or tumor suppressor genes, or wherein no DNA repair gene and/or tumor suppressor gene is upregulated by more than 50%, 25%, 10%, 5%, 2%, or 1%, e.g., wherein upregulation is measured by RNA-seq.

341. Any preceding numbered method, which results in insertion of the heterologous object sequence into the target site (e.g., at a copy number of 1 insertion or more than one insertion) in about 1-80% of cells in a population of cells contacted with the system, e.g., about: 1-10%, 10-20%, 20-30%, 30-40%, 40-50%, 50-60%, 60-70%, or 70-80% of cells, e.g., as measured using single cell ddPCR, e.g., as described in Example 17.

342. Any preceding numbered method, which results in insertion of the heterologous object sequence into the target site at a copy number of 1 insertion in about 1-80% of cells in a population of cells contacted with the system, e.g., about: 1-10%, 10-20%, 20-30%, 30-40%, 40-50%, 50-60%, 60-70%, or 70-80% of cells, e.g., as measured using colony isolation and ddPCR, e.g., as described in Example 18.

343. Any preceding numbered method, which results in insertion of the heterologous object sequence into the target site (on-target insertions) at a higher rate that insertion into a non-target site (off-target insertions) in a population of cells, wherein the ratio of on-target insertions to off-target insertions is greater than 10:1, 20:1, 30:1, 40:1, 50:1, 60:1, 70:1, 80:1. 90:1, 100:1, 200:1, 500:1, or 1,000:1, e.g., using an assay of Example 11 of PCT Application No. PCT/US2019/048607.

344. Any above-numbered method, which results in insertion of a heterologous object sequence in the presence of an inhibitor of a DNA repair pathway (e.g., SCR7, a PARP inhibitor), or in a cell line deficient for a DNA repair pathway (e.g., a cell line deficient for the nucleotide excision repair pathway or the homology-directed repair pathway).

345. The method of any of the preceding embodiments, wherein the cell has decreased Rad51 repair pathway activity, decreased expression of Rad51 or a component of the Rad51 repair pathway, or does not comprise a functional Rad51 repair pathway, e.g., does not comprise a functional Rad51 gene, e.g., comprises a mutation (e.g., deletion) inactivating one or both copies of the Rad51 gene or another gene in the Rad51 repair pathway.

346. Any preceding numbered system, formulated as a pharmaceutical composition.

347. Any preceding numbered system, disposed in a pharmaceutically acceptable carrier (e.g., a vesicle, a liposome, a natural or synthetic lipid bilayer, a lipid nanoparticle, an exosome).

348. Any preceding numbered method, which results in a plurality of (e.g., at least 2, 3, 4, 5, 6, 7, 8, 9, or 10) insertions of a heterologous object sequence into a target cell genome.

349. The method of any of the preceding embodiments, wherein the plurality of insertions occur simultaneously or sequentially.

350. Any preceding numbered method, which results in a plurality of (e.g., at least 2, 3, 4, 5, 6, 7, 8, 9, or 10) deletions of a heterologous object sequence into a target cell genome.

351. The method of any of the preceding embodiments, wherein the plurality of deletions occur simultaneously or sequentially.

352. Any preceding numbered method, which results in a plurality of (e.g., at least 2, 3, 4, 5, 6, 7, 8, 9, or 10) base changes of a heterologous object sequence into a target cell genome.

353. The method of any of the preceding embodiments, wherein the plurality of base changes occur simultaneously or sequentially.

354. Any preceding numbered method, comprising contacting the cell with a plurality of distinct template RNAs each comprising a heterologous object sequence.

355. The method ofany of the preceding embodiments, wherein the distinct template RNAs comprise at least two (e.g., at least 2, 3, 4, 5, 6, 7, 8, 9, or 10) distinct heterologous object sequences.

356. The method of any of the preceding embodiments, wherein the at least two distinct heterologous object sequences each comprise a distinct payload.

357. The method of any of the preceding embodiments, wherein the at least two distinct heterologous object sequences each comprise the same payload.

358. Any preceding numbered embodiment, in which the target cell of a Gene Writing system has been previously modified at one or more loci.

359. Any preceding numbered embodiment, wherein the previously edited cell is a T-cell.

360. Any preceeding numbered embodiment, wherein the one or more previous modifications are selected from gene knockouts, e.g., of an endogenous TCR (e.g., TRAC, TRBC), HLA Class I (B2M), PD1, CD52, CTLA-4, TIM-3, LAG-3, or DGK.

361. Any preceding numbered embodiment, wherein the heterologous object sequence comprises a TCR or a CAR.

362. A method of making a system for modifying the genome of a mammalian cell, comprising:
  a) providing a template RNA comprising (i) a sequence that binds a polypeptide comprising a reverse transcriptase domain and an endonuclease domain, the sequence having at least 70%, 75%, 80%, 85%, 90%, 95%, 96%, 97%, 98%, 99%, or 100% identity to a 5' UTR sequence or a 3' UTR sequence of a sequence of an element of Table X; and (ii) a heterologous object sequence.

363. The method of any of the preceding embodiments, further comprising:
  b) treating the template RNA to reduce secondary structure, e.g., heating the template RNA, e.g., to at least 70, 75, 80, 85, 90, or 95 C, and/orc) subsequently cooling the template RNA, e.g., to a temperature that allows for secondary structure, e.g, to less than or equal to 37, 30, 25, or 20 C.

364. A method of making a system for modifying DNA (e.g., as described herein), the method comprising:
  (a) providing a template nucleic acid (e.g., a template RNA or DNA) comprising a heterologous homology sequence having at least 85%, 90%, 95%, 96%, 97%, 98%, 99%, or 100% homology to a sequence comprised in a target DNA molecule, and/or
  (b) providing a polypeptide of the system (e.g., comprising a DNA-binding domain (DBD) and/or an endonuclease domain) comprising a heterologous targeting domain that binds specifically to a sequence comprised in the target DNA molecule.

365. The method of any of the preceding embodiments, wherein:
  (a) comprises introducing into the template nucleic acid (e.g., a template RNA or DNA) a heterologous homology sequence having at least 85%, 90%, 95%, 96%, 97%, 98%, 99%, or 100% homology to the sequence comprised in a target DNA molecule, and/or
  (b) comprises introducing into the polypeptide of the system (e.g., comprising a DNA-binding domain (DBD) and/or an endonuclease domain) the heterologous targeting domain that binds specifically to a sequence comprised in the target DNA molecule.

366. The method of any of the preceding embodiments, wherein the introducing of (a) comprises inserting the homology sequence into the template nucleic acid.

367. The method of any of the preceding embodiments, wherein the introducing of (a) comprises replacing a segment of the template nucleic acid with the homology sequence.

368. The method of any of the preceding embodiments, wherein the introducing of (a) comprises mutating one or more nucleotides (e.g., at least 2, 3, 4, 5, 10, 15, 20, 25, 30, 35, 40, 50, 60, 70, 80, 90, or 100 nucleotides) of the template nucleic acid, thereby producing a segment of the template nucleic acid having the sequence of the homology sequence.

369. The method of any of the preceding embodiments, wherein the introducing of (b) comprises inserting the amino acid sequence of the targeting domain into the amino acid sequence of the polypeptide.

370. The method of any of the preceding embodiments, wherein the introducing of (b) comprises inserting a nucleic acid sequence encoding the targeting domain into a coding sequence of the polypeptide comprised in a nucleic acid molecule.

371. The method of any of the preceding embodiments, wherein the introducing of (b) comprises replacing at least a portion of the polypeptide with the targeting domain.

372. The method of any of the preceding embodiments, wherein the introducing of (a) comprises mutating one or more amino acids (e.g., at least 1, 2, 3, 4, 5, 6, 7, 8, 9, 10, 15, 20, 25, 30, 40, 50, 60, 70, 80, 90, 100, 150, 200, 250, 300, 400, 500, or more amino acids) of the polypeptide.

373. A method for modifying a target site in genomic DNA in a cell, the method comprising contacting the cell with:
  (a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
  (b) a template RNA (or DNA encoding the template RNA) comprising (e.g., from 5' to 3') (i) optionally a sequence that binds the target site (e.g., a second strand of a site in a target genome), (ii) optionally a sequence that binds the polypeptide, (iii) a heterologous object sequence, and (iv) a 3' target homology domain,
  wherein:
  (i) the polypeptide comprises a heterologous targeting domain (e.g., in the DBD or the endonuclease domain) that binds specifically to a sequence comprised in or adjacent to the target site of the genomic DNA; and/or
  (ii) the template RNA comprises a heterologous homology sequence having at least 85%, 90%, 95%, 96%, 97%, 98%, 99%, or 100% homology to a sequence comprised in or adjacent to the target site of the genomic DNA;
  thereby modifying the target site in genomic DNA in a cell.

374. A method of making a system for modifying the genome of a mammalian cell, comprising:
  a) providing a template RNA comprising (i) a sequence that binds a polypeptide comprising a reverse transcriptase domain and an endonuclease domain, the sequence having at least 70%, 75%, 80%, 85%, 90%, 95%, 96%, 97%, 98%, 99%, or 100% identity to: (i) the nucleotides located 5' relative to a start codon of a sequence of an element of Table 3B, Table 10, or Table X (e.g., comprising a retrotransposase-binding region), or (ii) the nucleotides located 3' relative to a stop codon of a sequence of an element of Table 3B, Table 10, or Table X (e.g., comprising a retrotransposase-binding region)

375. The method of any of the preceding embodiments, further comprising:
  b) treating the template RNA to reduce secondary structure, e.g., heating the template RNA, e.g., to at least 70, 75, 80, 85, 90, or 95 C, and/or
  c) subsequently cooling the template RNA, e.g., to a temperature that allows for secondary structure, e.g, to less than or equal to 37, 30, 25, or 20 C.

376. The method of any of the preceding embodiments, wherein the system is the system of any of the preceding embodiments.

377. The method of any of the preceding embodiments, which further comprises contacting the template RNA with a polypeptide that comprises (i) a reverse transcriptase domain and (ii) an endonuclease domain, or with a nucleic acid (e.g., RNA) encoding the polypeptide.

378. The method of any of the preceding embodiments, which further comprises contacting the template RNA with a cell.

379. The system or method of any of the preceding embodiments, wherein the heterologous object sequence encodes a therapeutic polypeptide.

380. The system or method of any of the preceding embodiments, wherein the heterologous object sequence encodes a mammalian (e.g., human) polypeptide, or a fragment or variant thereof.

381. The system or method of any of the preceding embodiments, wherein the heterologous object sequence encodes an enzyme (e.g., a lysosomal enzyme), a blood factor (e.g., Factor I, II, V, VII, X, XI, XII or XIII), a membrane protein, an exon, an intracellular protein (e.g., a cytoplasmic protein, a nuclear protein, an organellar protein such as a mitochondrial protein or lysosomal protein), an extracellular protein, a structural protein, a signaling protein, a regulatory protein, a transport protein, a sensory protein, a motor protein, a defense protein, a storage protein, an immune receptor protein (e.g., a chimeric antigen receptor (CAR) protein, a T cell receptor, a B cell receptor), or an antibody.

382. The system or method of any of the preceding embodiments, wherein the heterologous object sequence comprises a tissue specific promoter or enhancer.

383. The system or method of any of the preceding embodiments, wherein the heterologous object sequence encodes a polypeptide of greater than 250, 300, 400, 500, or 1,000 amino acids, and optionally up to 1300 amino acids.

384. The system or method of any of the preceding embodiments, wherein the heterologous object sequence encodes a fragment of a mammalian gene but does not encode the full mammalian gene, e.g., encodes one or more exons but does not encode a full-length protein.

385. The system or method of any of the preceding embodiments, wherein the heterologous object sequence encodes one or more introns.

386. The system or method of any of the preceding embodiments, wherein the heterologous object sequence is other than a GFP, e.g., is other than a fluorescent protein or is other than a reporter protein.

387. The system or method of any of the preceding embodiments, wherein the polypeptide has an activity at 37° C. that is no less than 70%, 75%, 80%, 85%, 90%, or 95% of its activity at 25° C. under otherwise similar conditions.

388. The system or method of any of the preceding embodiments, wherein the nucleic acid encoding the polypeptide and the template RNA or a nucleic acid encoding the template RNA are separate nucleic acids.

389. The system or method of any of the preceding embodiments, wherein the template RNA does not encode an active reverse transcriptase, e.g., comprises an inactivated mutant reverse transcriptase, e.g., as described in Example 1 or 2, or does not comprise a reverse transcriptase sequence.

390. The system or method of any of the preceding embodiments, wherein the template RNA comprises one or more chemical modifications.

391. The system or method of any of the preceding embodiments, wherein the heterologous object sequence is disposed between the promoter and the sequence that binds the polypeptide.

392. The system or method of any of the preceding embodiments, wherein the promoter is disposed between the heterologous object sequence and the sequence that binds the polypeptide.

393. The system or method of any of the preceding embodiments, wherein the heterologous object sequence comprises an open reading frame (or the reverse complement thereof) in a 5' to 3' orientation on the template RNA.

394. The system or method of any of the preceding embodiments, wherein the heterologous object sequence comprises an open reading frame (or the reverse complement thereof) in a 3' to 5' orientation on the template RNA.

395. The system or method of any of the preceding embodiments, wherein the polypeptide comprises (a) a reverse transcriptase domain and (b) an endonuclease domain, wherein at least one of (a) or (b) is heterologous.

396. The system or method of any of the preceding embodiments, wherein the polypeptide comprises (a) a target DNA binding domain, (b) a reverse transcriptase domain and (c) an endonuclease domain, wherein at least one of (a), (b) or (c) is heterologous.

397. A substantially pure polypeptide comprising (a) a reverse transcriptase domain and (b) a heterologous endonuclease domain; wherein one or both of (a) or (b) have an amino acid sequence encoded by a sequence of an element of Table 3B, Table 10, Table 11, or Table X or a sequence having at least 70%, 75%, 80%, 85%, 90%, 95%, 96%, 97%, 98%, or 99% identity thereto.

398. A substantially pure polypeptide comprising (a) a reverse transcriptase domain and (b) a heterologous endonuclease domain; wherein one or both of (a) or (b) have an amino acid sequence encoded by a sequence of an element of Table 3B, Table 10, Table 11, or Table X or a sequence having no more than 10, 20, 30, 40, 50, 60, 70, 80, 90, or 100 nucleotide differences therefrom.

399. A substantially pure polypeptide comprising (a) a reverse transcriptase domain and (b) a heterologous endonuclease domain; wherein one or both of (a) or (b) have an amino acid sequence of an element of Table 3B, Table 10, Table 11, or Table X or a sequence having at least 70%, 75%, 80%, 85%, 90%, 95%, 96%, 97%, 98%, or 99% identity thereto.

400. A substantially pure polypeptide comprising (a) a reverse transcriptase domain and (b) a heterologous endonuclease domain; wherein one or both of (a) or (b) have an amino acid sequence of an element of Table 3B, Table 10, Table 11, or Table X or a sequence having no more than 10, 20, 30, 40, 50, 60, 70, 80, 90, or 100 nucleotide differences therefrom.

401. A substantially pure polypeptide comprising (a) a reverse transcriptase domain encoded by a first sequence of an element listed in Table 3B, Table 10, Table 11, or Table X or a sequence having at least 70%, 75%, 80%, 85%, 90%, 95%, 96%, 97%, 98%, or 99% identity thereto, and (b) a endonuclease domain encoded by a second sequence of an element listed in Table 3B, Table 10, Table 11, or Table X or a sequence having at least 70%, 75%, 80%, 85%, 90%, 95%, 96%, 97%, 98%, or 99% identity thereto; wherein the first sequence and the second sequences are selected from elements of different rows of Table 3B, Table 10, Table 11, or Table X.

402. A substantially pure polypeptide comprising (a) a reverse transcriptase domain encoded by a first sequence of an element listed in Table 3B, Table 10, Table 11, or Table X or a sequence having no more than 10, 20, 30, 40, 50, 60, 70, 80, 90, or 100 nucleotide differences therefrom, and (b) a endonuclease domain encoded by a second sequence of an element listed in Table 3B, Table 10, Table 11, or Table X or a sequence having no more than 10, 20, 30, 40, 50, 60, 70, 80, 90, or 100 nucleotide differences therefrom; wherein the first sequence and the second sequences are selected from elements of different rows of Table 3B, Table 10, Table 11, or Table X.

403. A substantially pure polypeptide comprising (a) a reverse transcriptase domain of a first sequence of an element listed in Table 3B, Table 10, Table 11, or Table X or a sequence having at least 70%, 75%, 80%, 85%, 90%, 95%, 96%, 97%, 98%, or 99% identity thereto, and (b) a endonuclease domain of a second sequence of an element listed in Table 3B, Table 10, Table 11, or Table X or a sequence having at least 70%, 75%, 80%, 85%, 90%, 95%, 96%, 97%, 98%, or 99% identity thereto; wherein the first sequence and the second sequences are selected from elements of different rows of Table 3B, Table 10, Table 11, or Table X.

404. A substantially pure polypeptide comprising (a) a reverse transcriptase domain of a first sequence of an element listed in Table 3B, Table 10, Table 11, or Table X or a sequence having no more than 10, 20, 30, 40, 50, 60, 70, 80, 90, or 100 nucleotide differences therefrom, and (b) a endonuclease domain of a second sequence of an element listed in Table 3B, Table 10, Table 11, or Table X or a sequence having no more than 10, 20, 30, 40, 50, 60, 70, 80, 90, or 100 nucleotide differences therefrom; wherein the first sequence and the second sequences are selected from elements of different rows of Table 3B, Table 10, Table 11, or Table X.

405. The substantially pure polypeptide of any of the preceding embodiments, further comprising a target DNA binding domain encoded by a sequence of an element of Table 3B, Table 10, Table 11, or Table X or a sequence having at least 70%, 75%, 80%, 85%, 90%, 95%, 96%, 97%, 98%, or 99% identity thereto.

406. The substantially pure polypeptide of any of the preceding embodiments, further comprising a target DNA binding domain encoded by a sequence of an element of Table 3B, Table 10, Table 11, or Table X or a sequence having no more than 10, 20, 30, 40, 50, 60, 70, 80, 90, or 100 nucleotide differences therefrom.

407. The substantially pure polypeptide of any of the preceding embodiments, further comprising a target DNA binding domain of an element of Table 3B, Table 10, Table 11, or Table X or a sequence having at least 70%, 75%, 80%, 85%, 90%, 95%, 96%, 97%, 98%, or 99% identity thereto.

408. The substantially pure polypeptide of any of the preceding embodiments, further comprising a target DNA binding domain of an element of Table 3B, Table 10, Table 11, or Table X or a sequence having no more than 10, 20, 30, 40, 50, 60, 70, 80, 90, or 100 nucleotide differences therefrom.

409. A substantially pure polypeptide comprising (a) a reverse transcriptase domain and (b) a heterologous endonuclease domain; wherein (a) has an amino acid sequence listed in Table 3B, Table 10, Table 11, or Table Z1 or Z2 or Table X or a sequence having at least 70%, 75%, 80%, 85%, 90%, 95%, 96%, 97%, 98%, or 99% identity thereto, optionally wherein (b) has an amino acid sequence of an element listed in Table 3B, Table 10, Table 11, or Table X or a sequence having at least 70%, 75%, 80%, 85%, 90%, 95%, 96%, 97%, 98%, or 99% identity thereto.

410. A substantially pure polypeptide comprising (a) a reverse transcriptase domain and (b) a heterologous endonuclease domain; wherein (a) has an amino acid sequence listed in Table 3B, Table 10, Table 11, or Table Z1 or Z2 or Table X or a sequence having no more than 10, 20, 30, 40, 50, 60, 70, 80, 90, or 100 nucleotide differences therefrom, optionally wherein (b) has an amino acid sequence of an element listed in Table 3B, Table 10, Table 11, or Table X or a sequence having no more than 10, 20, 30, 40, 50, 60, 70, 80, 90, or 100 nucleotide differences therefrom.

411. The substantially pure polypeptide of any of the preceding embodiments, further comprising a target DNA binding domain comprising an amino acid sequence of an element listed in Table 3B, Table 10, Table 11, or Table X or a sequence having at least 70%, 75%, 80%, 85%, 90%, 95%, 96%, 97%, 98%, or 99% identity thereto.

412. The substantially pure polypeptide of any of the preceding embodiments, further comprising a target DNA binding domain comprising an amino acid sequence of an element listed in Table 3B, Table 10, Table 11, or Table X or a sequence having no more than 10, 20, 30, 40, 50, 60, 70, 80, 90, or 100 nucleotide differences therefrom.

413. A substantially pure polypeptide comprising (a) a target DNA binding domain encoded by a first sequence listed in Table 3B, Table 10, Table 11, or Table X, (b) a reverse transcriptase domain encoded by a second sequence listed in Table 3B, Table 10, Table 11, or Table X, and (c) an endonuclease domain encoded by a third sequence listed in Table 3B, Table 10, Table 11, or Table X; wherein:
(i) the first sequence and the second sequence are selected from different rows of Table 3B, Table 10, Table 11, or Table X;
(ii) the first sequence and the third sequence are selected from different rows of Table 3B, Table 10, Table 11, or Table X;
(iii) the second sequence and the third sequence are selected from different rows of Table 3B, Table 10, Table 11, or Table X; or
(iv) the first sequence, second sequence, and third sequence are each selected from different rows of Table 3B, Table 10, Table 11, or Table X.

414. A substantially pure polypeptide comprising (a) a target DNA binding domain of a first sequence listed in Table 3B, Table 10, Table 11, or Table X, (b) a reverse transcriptase domain of a second sequence listed in Table 3B, Table 10, Table 11, or Table X, and (c) an endonuclease domain of a third sequence listed in Table 3B, Table 10, Table 11, or Table X; wherein:
(i) the first sequence and the second sequence are selected from different rows of Table 3B, Table 10, Table 11, or Table X;
(ii) the first sequence and the third sequence are selected from different rows of Table 3B, Table 10, Table 11, or Table X;
(iii) the second sequence and the third sequence are selected from different rows of Table 3B, Table 10, Table 11, or Table X; or
(iv) the first sequence, second sequence, and third sequence are each selected from different rows of Table 3B, Table 10, Table 11, or Table X.

415. A substantially pure polypeptide comprising (a) a target DNA binding domain, e.g., comprising a first amino acid sequence of an element listed in Table 3B, Table 10, Table 11, or Table X or a sequence having at least 70%, 75%, 80%, 85%, 90%, 95%, 96%, 97%, 98%, or 99% identity thereto, (b) a reverse transcriptase domain comprising a second amino acid sequence listed in Table Z1 or Z2 or a sequence having at least 70%, 75%, 80%, 85%, 90%, 95%, 96%, 97%, 98%, or 99% identity thereto, and (c) an endonuclease domain comprising a third amino acid sequence of an element listed in Table 3B, Table 10, Table 11, or Table X or a sequence having at least 70%, 75%, 80%, 85%, 90%, 95%, 96%, 97%, 98%, or 99% identity thereto;
optionally wherein the elements of the first amino acid sequence and the third amino acid sequence are selected from different rows of Table 3B, Table 10, Table 11, or Table X.

416. A substantially pure polypeptide comprising (a) a target DNA binding domain, e.g., comprising a first amino acid sequence of an element listed in Table 3B, Table 10, Table 11, or Table X or a sequence having no more than 10, 20, 30, 40, 50, 60, 70, 80, 90, or 100 nucleotide differences therefrom, (b) a reverse transcriptase domain comprising a second amino acid sequence listed in Table Z1 or Z2 or a sequence having no more than 10, 20, 30, 40, 50, 60, 70, 80, 90, or 100 nucleotide differences therefrom, and (c) an endonuclease domain comprising a third amino acid sequence of an element listed in Table 3B, Table 10, Table 11, or Table X or a sequence having no more than 10, 20, 30, 40, 50, 60, 70, 80, 90, or 100 nucleotide differences therefrom;
optionally wherein the elements of the first amino acid sequence and the third amino acid sequence are selected from different rows of Table 3B, Table 10, Table 11, or Table X.

417. A substantially pure polypeptide comprising (a) a target DNA binding domain comprising a first amino acid sequence, (b) a reverse transcriptase domain comprising a second amino acid sequence, and (c) an endonuclease domain comprising a third amino acid sequence; wherein the first, second, and third amino acid sequences are each encoded by a sequence listed in Table 3B, Table 10, Table 11, or Table X or comprise an amino acid sequence listed in Table Z1 or an amino acid sequence of a domain listed in Table Z2.

418. The substantially pure polypeptide of any of the preceding embodiments, wherein the first amino acid sequence is encoded by a sequence listed in Table 3B, Table 10, Table 11, or Table X.

419. The substantially pure polypeptide of any of the preceding embodiments, wherein the first amino acid sequence comprises an amino acid sequence listed in Table Z1 or Z2.

420. The substantially pure polypeptide of any of the preceding embodiments, wherein the second amino acid sequence is encoded by a sequence listed in Table 3B, Table 10, Table 11, or Table X.

421. The substantially pure polypeptide of any of the preceding embodiments, wherein the second amino acid sequence comprises an amino acid sequence listed in Table Z1 or Z2.

422. The substantially pure polypeptide of any of the preceding embodiments, wherein the third amino acid sequence is encoded by a sequence listed in Table 3B, Table 10, Table 11, or Table X.

423. The substantially pure polypeptide of any of the preceding embodiments, wherein the third amino acid sequence comprises an amino acid sequence listed in Table Z1 or Z2.

424. A polypeptide or a nucleic acid encoding the polypeptide, wherein the polypeptide comprises (a) a reverse transcriptase domain and (b) an endonuclease domain, wherein one or both of (a) or (b) have an amino acid sequence encoded by a sequence of an element of Table 3B, Table 10, Table 11, or Table X or a sequence having at least 70%, 75%, 80%, 85%, 90%, 95%, 96%, 97%, 98%, or 99% identity thereto, and wherein at least one of (a) or (b) is heterologous to the other.

425. A polypeptide or a nucleic acid encoding the polypeptide, wherein the polypeptide comprises (a) a reverse transcriptase domain and (b) an endonuclease domain, wherein one or both of (a) or (b) have an amino acid sequence encoded by a sequence of an element of Table 3B, Table 10, Table 11, or Table X or a sequence having no more than 10, 20, 30, 40, 50, 60, 70, 80, 90, or 100 nucleotide differences therefrom, and wherein at least one of (a) or (b) is heterologous to the other.

426. A polypeptide or a nucleic acid encoding the polypeptide, wherein the polypeptide is a fusion protein comprising (a) a reverse transcriptase domain encoded by a first sequence of an element listed in Table 3B, Table 10, Table 11, or Table X, and (b) a endonuclease domain encoded by a second sequence of an element listed in Table 3B, Table 10, Table 11, or Table X; wherein the first sequence and the second sequences are selected from elements of different rows of Table 3B, Table 10, Table 11, or Table X.

427. A polypeptide or a nucleic acid encoding the polypeptide, wherein the polypeptide comprises (a) a target DNA binding domain, (b) a reverse transcriptase domain and (c) an endonuclease domain, wherein at least one (e.g., 1, 2, or all) of (a), (b) or (c) comprises an amino acid sequence encoded by a sequence of an element of Table 3B, Table 10, Table 11, or Table X or a sequence having at least 70%, 75%, 80%, 85%, 90%, 95%, 96%, 97%, 98%, or 99% identity thereto, and wherein at least one of (a), (b) or (c) is heterologous to the other.

428. A polypeptide or a nucleic acid encoding the polypeptide, wherein the polypeptide comprises (a) a target DNA binding domain, (b) a reverse transcriptase domain and (c) an endonuclease domain, wherein at least one (e.g., 1, 2, or all) of (a), (b) or (c) comprises an amino acid sequence encoded by a sequence of an element of Table 3B, Table 10, Table 11, or Table X or a sequence having no more than 10, 20, 30, 40, 50, 60, 70, 80, 90, or 100 nucleotide differences therefrom, and wherein at least one of (a), (b) or (c) is heterologous to the other.

429. A polypeptide or a nucleic acid encoding the polypeptide, wherein the polypeptide is a fusion protein comprising (a) a target DNA binding domain encoded by a first sequence listed in Table 3B, Table 10, Table 11, or Table X, (b) a reverse transcriptase domain encoded by a second sequence listed in Table 3B, Table 10, Table 11, or Table X, and (c) an endonuclease domain encoded by a third sequence listed in Table 3B, Table 10, Table 11, or Table X; wherein:
  (i) the first sequence and the second sequence are selected from different rows of Table 3B, Table 10, Table 11, or Table X;
  (ii) the first sequence and the third sequence are selected from different rows of Table 3B, Table 10, Table 11, or Table X;
  (iii) the second sequence and the third sequence are selected from different rows of Table 3B, Table 10, Table 11, or Table X; or
  (iv) the first sequence, second sequence, and third sequence are each selected from different rows of Table 3B, Table 10, Table 11, or Table X.

430. Any polypeptide of any of the preceding embodiments, wherein the reverse transcriptase domain has at least 80% identity (e.g., at least 85%, 90%, 95%, 97%, 98%, 99%, 100% identity) to a reverse transcriptase domain encoded by a sequence of an element of Table 3B, Table 10, Table 11, or Table X.

431. Any polypeptide of any of the preceding embodiments, wherein the endonuclease domain has at least 80% identity e.g., at least 85%, 90%, 95%, 97%, 98%, 99%, 100% identity, to a endonuclease domain encoded by a sequence of an element of Table 3B, Table 10, Table 11, or Table X.

432. Any polypeptide or method of any of the preceding embodiments, wherein the DNA binding domain has at least 80% identity e.g., at least 85%, 90%, 95%, 97%, 98%, 99%, 100% identity, to a DNA binding domain encoded by a sequence of an element of Table 3B, Table 10, Table 11, or Table X.

433. A polypeptide or a nucleic acid encoding the polypeptide, wherein the polypeptide comprises (a) a reverse transcriptase domain and (b) an endonuclease domain, wherein one or both of (a) or (b) have an amino acid sequence of a sequence of an element of Table 3B, Table 10, Table 11, or Table X or a sequence having at least 70%, 75%, 80%, 85%, 90%, 95%, 96%, 97%, 98%, or 99% identity thereto, and wherein at least one of (a) or (b) is heterologous to the other.

434. A polypeptide or a nucleic acid encoding the polypeptide, wherein the polypeptide comprises (a) a reverse transcriptase domain and (b) an endonuclease domain, wherein one or both of (a) or (b) have an amino acid sequence of a sequence of an element of Table 3B, Table 10, Table 11, or Table X or a sequence having no more than 10, 20, 30, 40, 50, 60, 70, 80, 90, or 100 nucleotide differences therefrom, and wherein at least one of (a) or (b) is heterologous to the other.

435. A polypeptide or a nucleic acid encoding the polypeptide, wherein the polypeptide is a fusion protein comprising (a) a reverse transcriptase domain of a first sequence listed in Table 3B, Table 10, Table 11, or Table X, and (b) an endonuclease domain of a second sequence listed in Table 3B, Table 10, Table 11, or Table X; wherein the first sequence and the second sequences are selected from different rows of Table 3B, Table 10, Table 11, or Table X.

436. A polypeptide or a nucleic acid encoding the polypeptide, wherein the polypeptide comprises (a) a target DNA binding domain, (b) a reverse transcriptase domain and (c) an endonuclease domain, wherein at least one (e.g., 1, 2, or all) of (a), (b) or (c) comprises an amino acid sequence of a sequence of an element of Table 3B, Table 10, Table 11, or Table X or a sequence having at least 70%, 75%, 80%, 85%, 90%, 95%, 96%, 97%, 98%, or 99% identity thereto, and wherein at least one of (a), (b) or (c) is heterologous to the other.

437. A polypeptide or a nucleic acid encoding the polypeptide, wherein the polypeptide comprises (a) a target DNA binding domain, (b) a reverse transcriptase domain and (c) an endonuclease domain, wherein at least one (e.g., 1, 2, or all) of (a), (b) or (c) comprises an amino acid sequence of a sequence of an element of Table 3B, Table 10, Table 11, or Table X or a sequence having no more than 10, 20, 30, 40, 50, 60, 70, 80, 90, or 100 nucleotide differences therefrom, and wherein at least one of (a), (b) or (c) is heterologous to the other.

438. A polypeptide or a nucleic acid encoding the polypeptide, wherein the polypeptide is a fusion protein comprising (a) a target DNA binding domain of a first sequence listed in Table 3B, Table 10, Table 11, or Table X, (b) a reverse transcriptase domain of a second sequence listed in Table 3B, Table 10, Table 11, or Table X, and (c) an endonuclease domain of a third sequence listed in Table 3B, Table 10, Table 11, or Table X; wherein:
  (i) the first sequence and the second sequence are selected from different rows of Table 3B, Table 10, Table 11, or Table X;
  (ii) the first sequence and the third sequence are selected from different rows of Table 3B, Table 10, Table 11, or Table X;
  (iii) the second sequence and the third sequence are selected from different rows of Table 3B, Table 10, Table 11, or Table X; or
  (iv) the first sequence, second sequence, and third sequence are each selected from different rows of Table 3B, Table 10, Table 11, or Table X.

439. A polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain, wherein the RT domain has a sequence of Table 3B, Table 10, Table 11, or Table X, or a sequence having at least 70%, 75%, 80%, 85%, 90%, 95%, 96%, 97%, 98%, or 99% identity thereto.

440. Any polypeptide of any of the preceding embodiments, wherein the reverse transcriptase domain has at least 80% identity (e.g., at least 85%, 90%, 95%, 97%, 98%, 99%, 100% identity) to a reverse transcriptase domain of a sequence of an element of Table 3B, Table 10, Table 11, or Table X.

441. Any polypeptide of any of the preceding embodiments, wherein the endonuclease domain has at least 80% identity e.g., at least 85%, 90%, 95%, 97%, 98%, 99%, 100% identity, to an endonuclease domain of a sequence of an element of Table 3B, Table 10, Table 11, or Table X.

442. Any polypeptide or method of any of the preceding embodiments, wherein the DNA binding domain has at least 80% identity e.g., at least 85%, 90%, 95%, 97%, 98%, 99%, 100% identity, to a DNA binding domain of a sequence of an element of Table 3B, Table 10, Table 11, or Table X.

443. A nucleic acid encoding the polypeptide of any of the preceding embodiments.

444. A vector comprising the nucleic acid of any of the preceding embodiments.

445. A host cell comprising the nucleic acid of any of the preceding embodiments.

446. A host cell comprising the polypeptide of any of the preceding embodiments.

447. A host cell comprising the vector of any of the preceding embodiments.

448. A host cell (e.g., a human cell) comprising:
  a heterologous object sequence (e.g., a sequence encoding a therapeutic polypeptide) at a target site in a chromosome, and one or both of:
  (a) one or both of an untranslated region (e.g., a retrotransposon untranslated sequence, e.g., a sequence of Table 10 or column 5 of Table 3A or 3B) on one side (e.g., upstream) of the heterologous object sequence, and an untranslated region (e.g., a retrotransposon untranslated sequence, e.g., a sequence of Table 10 or column 6 of Table 3A or 3B) on the other side (e.g., downstream) of the heterologous object sequence; and/or
  (b) a polypeptide or a nucleic acid encoding a polypeptide, wherein the polypeptide comprises (i) a reverse transcriptase domain and (ii) an endonuclease domain, wherein one or both of (i) or (ii) have an amino acid sequence encoded by a sequence of an element of Table 3B, Table 10, Table 11, or Table X or a sequence having at least 70%, 75%, 80%, 85%, 90%, 95%, 96%, 97%, 98%, or 99% identity thereto.

449. A host cell (e.g., a human cell) comprising:
  a heterologous object sequence (e.g., a sequence encoding a therapeutic polypeptide) at a target site in a chromosome, and one or both of:
  (a) one or both of an untranslated region (e.g., a retrotransposon untranslated sequence, e.g., a sequence of Table 10 or column 5 of Table 3A or 3B) on one side (e.g., upstream) of the heterologous object sequence, and an untranslated region (e.g., a retrotransposon untranslated sequence, e.g., a sequence of Table 10 or column 6 of Table 3A or 3B) on the other side (e.g., downstream) of the heterologous object sequence; and/or
  (b) a polypeptide or a nucleic acid encoding a polypeptide, wherein the polypeptide comprises (i) a reverse transcriptase domain and (ii) an endonuclease domain, wherein one or both of (i) or (ii) have an amino acid sequence encoded by a sequence of an element of Table 3B, Table 10, Table 11, or Table X or a sequence having no more than 10, 20, 30, 40, 50, 60, 70, 80, 90, or 100 nucleotide differences therefrom.

450. A host cell (e.g., a human cell) comprising:
  a heterologous object sequence (e.g., a sequence encoding a therapeutic polypeptide) at a target site in a chromosome, and one or both of:
  (a) one or both of an untranslated region (e.g., a retrotransposon untranslated sequence, e.g., a sequence of Table 10 or column 5 of Table 3A or 3B) on one side (e.g., upstream) of the heterologous object sequence, and an untranslated region (e.g., a retrotransposon untranslated sequence, e.g., a sequence of Table 10 or column 6 of Table 3A or 3B) on the other side (e.g., downstream) of the heterologous object sequence; and/or
  (b) a polypeptide or a nucleic acid encoding a polypeptide, wherein the polypeptide comprises (i) a reverse transcriptase domain and (ii) an endonuclease domain, wherein one or both of (i) or (ii) have an amino acid sequence of a sequence of an element of Table 3B, Table 10, Table 11, or Table X or a sequence having at least 70%, 75%, 80%, 85%, 90%, 95%, 96%, 97%, 98%, or 99% identity thereto.

451. A host cell (e.g., a human cell) comprising:
  a heterologous object sequence (e.g., a sequence encoding a therapeutic polypeptide) at a target site in a chromosome, and one or both of:
  (a) one or both of an untranslated region (e.g., a retrotransposon untranslated sequence, e.g., a sequence of column 5 of Table 10 or Table 3A or 3B) on one side (e.g., upstream) of the heterologous object sequence, and an untranslated region (e.g., a retrotransposon untranslated sequence, e.g., a sequence of column 6 of Table 10 or Table 3A or 3B) on the other side (e.g., downstream) of the heterologous object sequence; and/or
  (b) a polypeptide or a nucleic acid encoding a polypeptide, wherein the polypeptide comprises (i) a reverse transcriptase domain and (ii) an endonuclease domain, wherein one or both of (i) or (ii) have an amino acid sequence of a sequence of an element of Table 3B, Table 10, Table 11, or Table X or a sequence having no more than 10, 20, 30, 40, 50, 60, 70, 80, 90, or 100 nucleotide differences therefrom.

452. The host cell of any of the preceding embodiments, comprising: (i) a heterologous object sequence (e.g., a sequence encoding a therapeutic polypeptide) at a target site in a chromosome, wherein the target locus is a Natural Harbor™ site, e.g., a site of Table 4 herein.

453. The host cell of any of the preceding embodiments, which further comprises (ii) one or both of an untranslated region 5' of the heterologous object sequence, and an untranslated region 3' of the heterologous object sequence.

454. The host cell of any of the preceding embodiments, which further comprises (ii) one or both of an untranslated region (e.g., a retrotransposon untranslated sequence, e.g., a sequence of Table 10 or column 5 of Table 3A or 3B) on one side (e.g., upstream) of the heterologous object sequence, and an untranslated region (e.g., a retrotransposon untranslated sequence, e.g., a sequence of Table 10 or column 6 of Table 3A or 3B) on the other side (e.g., downstream) of the heterologous object sequence.

455. The host cell of any of the preceding embodiments, which comprises a heterologous object sequence at only the target site.

456. A pharmaceutical composition, comprising any preceding numbered system, nucleic acid, polypeptide, or vector; and a pharmaceutically acceptable excipient or carrier.

457. The pharmaceutical composition of any of the preceding embodiments, wherein the pharmaceutically acceptable excipient or carrier is selected from a vector (e.g., a viral or plasmid vector), a vesicle (e.g., a liposome, an exosome, a natural or synthetic lipid bilayer), a fusosome, a lipid nanoparticle.

458. A polypeptide of any of the preceding embodiments, wherein the polypeptide further comprises a nuclear localization sequence.

459. A template RNA (or DNA encoding the template RNA) comprising (e.g., from 5' to 3') (i) optionally a sequence that binds a target site (e.g., a non-edited strand of a site in a target genome), (ii) optionally a sequence that binds an endonuclease and/or a DNA-binding domain of a polypeptide, (iii) a heterologous object sequence, and (iv) a 3' homology domain.

460. The template RNA of any of the preceding embodiments, wherein the template RNA comprises (i).

461. The template RNA of any of the preceding embodiments, wherein the template RNA comprises (ii).

462. A template RNA (or DNA encoding the template RNA) comprising (e.g., from 5' to 3') (i) a sequence that binds a target site (e.g., a non-edited strand of a site in a target genome), (ii) a sequence that specifically binds an RT domain of a polypeptide, (iii) a heterologous object sequence, and (iv) a 3' homology domain.

463. The template RNA of any of the preceding embodiments, wherein the RT domain comprises a sequence selected of Table 3B, Table 10, Table 11, or Table X or a sequence that has at least 70%, 75%, 80%, 85%, 90%, 95%, 96%, 97%, 98%, or 99% identity thereto.

464. The template RNA of any of the preceding embodiments, further comprising (v) a sequence that binds an endonuclease and/or a DNA-binding domain of a polypeptide (e.g., the same polypeptide comprising the RT domain).

465. The template RNA of any of the preceding embodiments, wherein the sequence of (ii) specifically binds an RT domain of Table 3B, Table 10, Table 11, or Table X or an RT domain sequence that has at least 70, 75, 80, 85, 90, 95, or 99% identity thereto.

466. The template RNA of any of the preceding embodiments, wherein the sequence that specifically binds the RT domain is a sequence of Table 10, Table 11, or Table X, 3A, or 3B, or a sequence having at least 70, 75, 80, 85, 90, 95, or 99% identity thereto.

467. A template RNA (or DNA encoding the template RNA) comprising from 5' to 3': (ii) a sequence that binds an endonuclease and/or a DNA-binding domain of a polypeptide, (i) a sequence that binds a target site (e.g., a non-edited strand of a site in a target genome), (iii) a heterologous object sequence, and (iv) a 3' homology domain.

468. A template RNA (or DNA encoding the template RNA) comprising from 5' to 3': (iii) a heterologous object sequence, (iv) a 3' homology domain, (i) a sequence that binds a target site (e.g., a non-edited strand of a site in a target genome), and (ii) a sequence that binds an endonuclease and/or a DNA-binding domain of a polypeptide.

469. The system or template RNA of any of the preceding embodiments, wherein the template RNA, first template RNA, or second template RNA comprises a sequence that specifically binds the RT domain.

470. The system or template RNA of any of the preceding embodiments, wherein the sequence that specifically binds the RT domain is disposed between (i) and (ii).

471. The system or template RNA of any of the preceding embodiments, wherein the sequence that specifically binds the RT domain is disposed between (ii) and (iii).

472. The system or template RNA of any of the preceding embodiments, wherein the sequence that specifically binds the RT domain is disposed between (iii) and (iv).

473. The system or template RNA of any of the preceding embodiments, wherein the sequence that specifically binds the RT domain is disposed between (iv) and (i).

474. The system or template RNA of any of the preceding embodiments, wherein the sequence that specifically binds the RT domain is disposed between (i) and (iii).

475. A system for modifying DNA, comprising:
  (a) a first template RNA (or DNA encoding the first template RNA) comprising (i) sequence that binds an endonuclease domain, e.g., a nickase domain, and/or a DNA-binding domain (DBD) of a polypeptide, and (ii) a sequence that binds a target site (e.g., a non-edited strand of a site in a target genome), (e.g., wherein the first RNA comprises a gRNA);
  (b) a second template RNA (or DNA encoding the second template RNA) comprising (i) a sequence that specifically binds a reverse transcriptase (RT) domain of a polypeptide (e.g., the polypeptide of (a)), (ii) a target site binding sequence (TSBS), and (iii) an RT template sequence.

476. The system of any of the preceding embodiments, wherein the nucleic acid encoding the first template RNA and the nucleic acid encoding the second template RNA are two separate nucleic acids.

477. The system of any of the preceding embodiments, wherein the nucleic acid encoding the first template RNA and the nucleic acid encoding the second template RNA are part of the same nucleic acid molecule, e.g., are present on the same vector.

478. A method of modifying a target DNA strand in a cell, tissue or subject, comprising administering any preceding numbered system to the cell, tissue or subject, thereby modifying the target DNA strand.

479. Any preceding numbered embodiment, wherein the sequence of an element of Table X is selected from Vingi-1 EE, BovB, AviRTE_Brh, Penelope_SM, and Utopia_Dyak retrotransposases.

480. Any preceding numbered embodiment, wherein the template RNA comprises the 5' UTR and 3' UTR of the same sequence of an element of Table 3B, Table 10, or Table X.
481. Any preceeding numbered embodiment, wherein the sequence of an element of Table X comprises Vingi-1 EE retrotransposase and wherein the template RNA comprises the 5' UTR and 3' UTR of Vingi-1EE.
482. Any preceding numbered embodiment, wherein the sequence of an element of Table X belongs to the restriction-endonuclease-like (RLE) clade.
483. Any preceding numbered embodiment, wherein the sequence of an element of Table X belongs to the apurinic-endonuclease-like (APE) clade.
484. Any preceding numbered embodiment, wherein the sequence of an element of Table X belongs to the Penelope-like element (PLE) clade, optionally wherein the sequence of the element of Table X comprises a GIY-YIG domain (e.g., a GIY-YIG endonuclease domain).
485. Any preceding numbered embodiment, wherein the sequence of an element of Table X belongs to a clade selected from the CRE, NeSL, R4, R2, Hero, L1, RTE (e.g., AviRTE_Brh or BovB), I, Jockey, CR1, Rex1, RandI/Dualen, Penelope (e.g., Penelope_SM), Tx1, RTEX, Crack, Nimb, Proto1, Proto2, RTETP, L2, Tad1, *Loa*, Ingi, Outcast, R1, Daphne, L2A, L2B, Ambal, Vingi (e.g., Vingi-1_EE), and Kiri clades.
486. Any preceding numbered embodiment, wherein the target DNA binding domain is heterologous relative to one or more other domains of the polypeptide (e.g., a reverse transcriptase domain and/or an endonuclease domain).
487. Any preceeding numbered embodiment, wherein the heterologous target DNA binding domain comprises a Cas9, Cas9 nickase, dCas9, zinc finger, or TAL domain.
488. Any preceeding numbered embodiment, wherein the heterologous target DNA binding domain comprises a Cas domain according to Table 9 or Table 37, or a sequence having at least 70%, 75%, 80%, 85%, 90%, 95%, 96%, 97%, 98%, or 99% identity thereto.
489. Any preceeding numbered embodiment, wherein the heterologous target DNA binding domain comprises an N-terminal dCas9 domain.
490. Any preceeding numbered embodiment, wherein the system further comprises a guide RNA (e.g., a U6-driven gRNA) comprising at least 10, 15, 16, 17, 18, 19, 20, 21, 22, 23, 24, or 25 nucleotides of homology to a target DNA sequence.
491. Any preceeding numbered embodiment, wherein the template RNA further comprises a gRNA region comprising at least 10, 15, 16, 17, 18, 19, 20, 21, 22, 23, 24, or 25 nucleotides of homology to a target DNA sequence.
492. Any preceeding numbered embodiment, wherein the gRNA sequence is at the 5' end of the template.
493. Any preceeding numbered embodiment, wherein the gRNA sequence is at the 3' end of the template.
494. Any preceeding numbered embodiment, wherein the gRNA sequence comprises a scaffold capable of recruiting Cas9.
495. Any preceeding numbered embodiment, wherein the gRNA sequence comprises a homology domain, e.g., as described herein.
496. Any preceeding numbered embodiment, wherein the endonuclease domain is heterologous relative to one or more other domains of the polypeptide (e.g., a reverse transcriptase domain and/or a target DNA binding domain).
497. Any preceeding numbered embodiment, wherein the heterologous endonuclease domain comprises a Cas9, Cas9 nickase, or FokI domain.

498. Any preceding numbered embodiment, wherein the polypeptide comprises an RNase H domain.
499. Any preceding numbered embodiment, wherein the polypeptide does not comprise an RNase H domain or comprises an inactivated RNase H domain.
500. Any preceding numbered embodiment, wherein the nucleic acid encoding the polypeptide further comprises a second open reading frame.
501. Any preceding numbered embodiment, wherein the nucleic acid encoding the polypeptide comprises a 2A sequence, e.g., positioned between an ORF1 sequence and an ORF2 sequence, optionally wherein the 2A sequence is selected from T2A (EGRGSLLTCGDVEENPGP (SEQ ID NO: 1538)), P2A (ATNFSLLKQAGDVEENPGP (SEQ ID NO: 1539)), E2A (QCTNYALLKLAGDVESNPGP (SEQ ID NO: 1540)), or F2A (VKQTLNFDLLKLAGDVESNPGP (SEQ ID NO: 1541)).
502. Any preceding numbered embodiment, wherein the polypeptide comprises an intein.
503. Any preceding numbered embodiment, wherein the system comprises an intein (e.g., comprised in a second polypeptide).
504. Any preceding numbered embodiment, wherein the polypeptide is encoded by two or more separate open reading frames each encoding a polypeptide fragment.
505. Any preceding numbered embodiment, wherein the intein (e.g., a trans-splicing intein) joins the two or more polypeptide fragments to form the polypeptide.
506. Any preceding numbered embodiment, wherein the system comprises: (i) a first polypeptide fragment comprising at least one of a reverse transcriptase domain, an endonuclease domain, and a target DNA binding domain, and (ii) a second polypeptide fragment comprising at least one of a reverse transcriptase domain, an endonuclease domain, and a target DNA binding domain, wherein the first polypeptide fragment does not comprise the same type of domain as the second polypeptide fragment.
507. Any preceding numbered embodiment, wherein:
  (a) the first polypeptide fragment comprises a reverse transcriptase domain and the second polypeptide fragment comprises an endonuclease domain, optionally wherein the first polypeptide fragment further comprises a target DNA binding domain or wherein the second polypeptide fragment further comprises a target DNA binding domain;
  (b) the first polypeptide fragment comprises a reverse transcriptase domain and the second polypeptide fragment comprises a target DNA binding domain, optionally wherein the first polypeptide fragment further comprises an endonuclease domain or wherein the second polypeptide fragment further comprises an endonuclease domain; or
  (a) the first polypeptide fragment comprises an endonuclease domain and the second polypeptide fragment comprises a target DNA binding domain, optionally wherein the first polypeptide fragment further comprises a reverse transcriptase domain or wherein the second polypeptide fragment further comprises a reverse transcriptase domain.
508. Any preceding numbered embodiment, wherein the intein joins the first polypeptide fragment to the second polypeptide to form the polypeptide.
509. Any preceding numbered embodiment, wherein the intein induces fusion of:
  (i) a reverse transcriptase domain to an endonuclease domain, (ii) a reverse transcriptase domain to a target DNA binding domain, or (iii) an endonuclease domain to a target DNA binding domain.

510. Any preceding numbered embodiment, wherein the intein is heterologous relative to one or more (e.g., 1, 2, or all) of the reverse transcriptase domain, the endonuclease domain, and the target DNA binding domain.

511. Any preceding numbered embodiment, wherein the intein is a split intein.

512. Any of the preceding embodiments, wherein the DNA encoding the polypeptide comprises a plasmid, minicircle, a Doggybone DNA (dbDNA), or a ceDNA.

513. Any of the preceding embodiments, wherein the RNA encoding the polypeptide comprises one or more of the following: a cap region, a poly-A tail, and/or a chemical modification, e.g., one or more chemically modified nucleotides.

514. Any of the preceding embodiments, wherein the RNA encoding the polypeptide comprises a circRNA.

515. Any of the preceding embodiments, wherein the nucleic acid encoding the polypeptide is comprised within a virus (e.g., AAV, adenovirus, or lentivirus, e.g., integration-deficient lentivirus).

516. Any of the preceding embodiments, wherein the nucleic acid encoding the polypeptide is comprised within a nanoparticle (e.g., a lipid nanoparticle), vesicle, or fusosome.

517. Any preceding numbered embodiment, wherein the polypeptide comprises an amino acid sequence having at least 70%, 75%, 80%, 85%, 90%, 95%, 96%, 97%, 98%, 99%, or 100% sequence identity to an amino acid sequence encoded by a sequence of an element of Table X. 518. Any preceding numbered embodiment, wherein the reverse transcriptase domain comprises an amino acid sequence having at least 70%, 75%, 80%, 85%, 90%, 95%, 96%, 97%, 98%, 99%, or 100% sequence identity to the reverse transcriptase domain of an amino acid sequence encoded by a sequence of an element of Table 3B, Table 10, Table 11, or Table X.

519. Any preceding numbered embodiment, wherein the retrotransposase comprises an amino acid sequence having at least 70%, 75%, 80%, 85%, 90%, 95%, 96%, 97%, 98%, 99%, or 100% sequence identity to an amino acid sequence encoded by a sequence of an element of Table 3B, Table 10, Table 11, or Table X.

520. Any preceding numbered embodiment, wherein the polypeptide comprises an amino acid sequence having at least 70%, 75%, 80%, 85%, 90%, 95%, 96%, 97%, 98%, 99%, or 100% sequence identity to an amino acid sequence of a sequence of an element of Table 3B, Table 10, Table 11, or Table X.

521. Any preceding numbered embodiment, wherein the reverse transcriptase domain comprises an amino acid sequence having at least 70%, 75%, 80%, 85%, 90%, 95%, 96%, 97%, 98%, 99%, or 100% sequence identity to the reverse transcriptase domain of an amino acid sequence of a sequence of an element of Table 3B, Table 10, Table 11, or Table X.

522. Any preceding numbered embodiment, wherein the retrotransposase comprises an amino acid sequence having at least 70%, 75%, 80%, 85%, 90%, 95%, 96%, 97%, 98%, 99%, or 100% sequence identity to an amino acid sequence of a sequence of an element of Table 3B, Table 10, Table 11, or Table X.

523. Any preceding numbered embodiment, wherein the polypeptide comprises an amino acid sequence having at least 70%, 75%, 80%, 85%, 90%, 95%, 96%, 97%, 98%, 99%, or 100% sequence identity to the amino acid sequence SGSETPGTSESATPES (SEQ ID NO: 1023) or GGGS (SEQ ID NO: 1024).

524. Any preceding numbered embodiment, wherein the reverse transcriptase domain comprises an amino acid sequence having at least 70%, 75%, 80%, 85%, 90%, 95%, 96%, 97%, 98%, 99%, or 100% sequence identity to the amino acid sequence SGSETPGTSESATPES (SEQ ID NO: 1023) or GGGS (SEQ ID NO: 1024).

525. Any preceding numbered embodiment, wherein the retrotransposase comprises an amino acid sequence having at least 70%, 75%, 80%, 85%, 90%, 95%, 96%, 97%, 98%, 99%, or 100% sequence identity to the amino acid sequence SGSETPGTSESATPES (SEQ ID NO: 1023) or GGGS (SEQ ID NO: 1024).

526. Any preceding numbered embodiment, wherein the polypeptide, reverse transcriptase domain, or retrotransposase comprises a linker comprising an amino acid sequence having at least 70%, 75%, 80%, 85%, 90%, 95%, 96%, 97%, 98%, 99%, or 100% sequence identity to the amino acid sequence SGSETPGTSESATPES (SEQ ID NO: 1023) or GGGS (SEQ ID NO: 1024).

527. Any preceding numbered embodiment, wherein the polypeptide comprises a DNA binding domain covalently attached to the remainder of the polypeptide by a linker, e.g., a linker comprising at least 1, 2, 3, 4, 5, 6, 7, 8, 9, 10, 11, 12, 13, 14, 15, 16, 17, 18, 19, 20, 25, 30, 35, 40, 45, 50, 60, 70, 80, 90, 100, 125, 150, 200, 300, 400, or 500 amino acids.

528. Any preceding numbered embodiment, wherein the linker is attached to the remainder of the polypeptide at a position in the DNA binding domain, RNA binding domain, reverse transcriptase domain, or endonuclease domain (e.g., as shown in any of FIGS. 17A-17F of PCT Application No. PCT/US2019/048607).

529. Any preceding numbered embodiment, wherein the linker is attached to the remainder of the polypeptide at a position in the N-terminal side of an alpha helical region of the polypeptide, e.g., at a position corresponding to version v1 as described in Example 26 of PCT Application No. PCT/US2019/048607.

530. Any preceding numbered embodiment, wherein the linker is attached to the remainder of the polypeptide at a position in the C-terminal side of an alpha helical region of the polypeptide, e.g., preceding an RNA binding motif (e.g., a −1 RNA binding motif), e.g., at a position corresponding to version v2 as described in Example 26 of PCT Application No. PCT/US2019/048607.

531. Any preceding numbered embodiment, wherein the linker is attached to the remainder of the polypeptide at a position in the C-terminal side of a random coil region of the polypeptide, e.g., N-terminal relative to a DNA binding motif (e.g., a c-myb DNA binding motif), e.g., at a position corresponding to version v3 as described in Example 26 of PCT Application No. PCT/US2019/048607.

532. Any preceding numbered embodiment, wherein the linker comprises an amino acid sequence having at least 70%, 75%, 80%, 85%, 90%, 95%, 96%, 97%, 98%, 99%, or 100% sequence identity to the amino acid sequence SGSETPGTSESATPES (SEQ ID NO: 1023) or GGGS (SEQ ID NO: 1024).

533. Any preceding numbered embodiment, wherein a polynucleotide sequence comprising at least about 500, 1000, 2000, 3000, 3500, 3600, 3700, 3800, 3900, or 4000 contiguous nucleotides from the 5' end of the template RNA sequence are integrated into a target cell genome.

534. Any preceding numbered embodiment, wherein a polynucleotide sequence comprising at least about 500, 1000, 2000, 2500, 2600, 2700, 2800, 2900, or 3000 contiguous nucleotides from the 3' end of the template RNA sequence are integrated into a target cell genome.

535. Any preceding numbered embodiment, wherein the nucleic acid sequence of the template RNA, or a portion thereof (e.g., a portion comprising at least about 100, 200, 300, 400, 500, 1000, 2000, 2500, 3000, 3500, or 4000 nucleotides) integrates into the genomes of a population of target cells at a copy number of at least about 0.1, 0.2, 0.3, 0.4, 0.5, 0.6, 0.7, 0.8, 0.9, or 1.0 integrants/genome.

536. Any preceding numbered embodiment, wherein the nucleic acid sequence of the template RNA, or a portion thereof (e.g., a portion comprising at least about 100, 200, 300, 400, 500, 1000, 2000, 2500, 3000, 3500, or 4000 nucleotides) integrates into the genomes of a population of target cells at a copy number of at least about 0.01, 0.02, 0.03, 0.04, 0.05, 0.75, or 0.1 integrants/genome.

537. Any preceding numbered embodiment, wherein the polypeptide comprises a functional endonuclease domain (e.g., wherein the endonuclease domain does not comprise a mutation that abolishes endonuclease activity, e.g., as described herein).

538. Any preceding numbered embodiment, wherein introduction of the system into a target cell does not result in alteration (e.g., upregulation) of p53 and/or p21 protein levels, H2AX phosphorylation (e.g., gamma H2AX), ATM phosphorylation, ATR phosphorylation, Chk1 phosphorylation, Chk2 phosphorylation, and/or p53 phosphorylation.

539. Any preceding numbered embodiment, wherein introduction of the system into a target cell results in upregulation of p53 protein level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the p53 protein level induced by introducing a site-specific nuclease, e.g., Cas9, that targets the same genomic site as said system.

540. Any preceding numbered embodiment, wherein the p53 protein level is determined according to the method described in Example 30.

541. Any preceding numbered embodiment, wherein introduction of the system into a target cell results in upregulation of p53 phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the p53 phosphorylation level induced by introducing a site-specific nuclease, e.g., Cas9, that targets the same genomic site as said system.

542. Any preceding numbered embodiment, wherein introduction of the system into a target cell results in upregulation of p21 protein level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the p53 protein level induced by introducing a site-specific nuclease, e.g., Cas9, that targets the same genomic site as said system.

543. Any preceding numbered embodiment, wherein the p21 protein level is determined according to the method described in Example 30.

544. Any preceding numbered embodiment, wherein introduction of the system into a target cell results in upregulation of H2AX phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the H2AX phosphorylation level induced by introducing a site-specific nuclease, e.g., Cas9, that targets the same genomic site as said system.

545. Any preceding numbered embodiment, wherein introduction of the system into a target cell results in upregulation of ATM phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the ATM phosphorylation level induced by introducing a site-specific nuclease, e.g., Cas9, that targets the same genomic site as said system.

546. Any preceding numbered embodiment, wherein introduction of the system into a target cell results in upregulation of ATR phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the ATR phosphorylation level induced by introducing a site-specific nuclease, e.g., Cas9, that targets the same genomic site as said system.

547. Any preceding numbered embodiment, wherein introduction of the system into a target cell results in upregulation of Chk1 phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the Chk1 phosphorylation level induced by introducing a site-specific nuclease, e.g., Cas9, that targets the same genomic site as said system.

548. Any preceding numbered embodiment, wherein introduction of the system into a target cell results in upregulation of Chk2 phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the Chk2 phosphorylation level induced by introducing a site-specific nuclease, e.g., Cas9, that targets the same genomic site as said system.

549. Any preceding numbered embodiment, wherein the target DNA binding domain recognizes a specific target DNA sequence.

550. Any preceding numbered embodiment, wherein the target DNA binding domain binds to a plurality of (e.g., random) target DNA sequences.

551. Any preceding numbered embodiment, wherein the template RNA comprises a guide RNA (e.g., a U6-driven gRNA).

552. Any preceding numbered embodiment, wherein the target DNA binding domain comprises one or more of a DNA binding domain of a retrotransposase as described herein (e.g., a retrotransposase of an element of Table X, 10, 11, 3A, or 3B), Cas9, nickase Cas9, dCas9, a zinc finger, a TAL, a meganuclease, and/or a transcription factor.

553. Any preceding numbered embodiment, wherein the reverse transcriptase domain comprises a reverse transcriptase domain of a retrotransposase as described herein (e.g., a retrotransposase of an element of Table X, 10, 11, Z1, Z2, 3A, or 3B).

554. Any preceding numbered embodiment, wherein the endonuclease domain comprises an endonuclease domain of a retrotransposase as described herein (e.g., a retrotransposase of an element of Table X, 10, 11, 3A, or 3B), Cas9, nickase Cas9, a type II restriction enzyme (e.g., FokI), a Holliday junction resolvase, an RLE endonuclease domain, an APE endonuclease domain, or a GIY-YIG endonuclease domain.

555. A polypeptide or a nucleic acid encoding the polypeptide, wherein the polypeptide comprises (i) a reverse transcriptase (RT) domain, (ii) a DNA-binding domain (DBD); and (iii) an endonuclease domain; wherein the DBD and/or the endonuclease domain comprise a heterologous targeting domain that binds specifically to a sequence comprised in a target DNA molecule (e.g., a genomic DNA).

556. A template RNA (or DNA encoding the template RNA) comprising a targeting domain (e.g., a heterologous targeting domain) that binds specifically to a sequence comprised in the target DNA molecule (e.g., a genomic DNA), a sequence that specifically binds an RT domain of a polypeptide, and a heterologous object sequence.

557. The system, method, or template RNA of any of the preceding embodiments, wherein the polypeptide comprises a heterologous targeting domain that binds specifically to a sequence comprised in the target DNA molecule (e.g., a genomic DNA).

558. The system, method, or template RNA of any of the preceding embodiments, wherein the heterologous targeting domain binds to a different nucleic acid sequence than the unmodified polypeptide.

559. The system, method, or template RNA of any of the preceding embodiments, wherein the polypeptide does not comprise a functional endogenous targeting domain (e.g., wherein the polypeptide does not comprise an endogenous targeting domain).

560. The system, method, or template RNA of any of the preceding embodiments, wherein the heterologous targeting domain comprises a zinc finger (e.g., a zinc finger that binds specifically to the sequence comprised in the target DNA molecule).

561. The system, method, or template RNA of any of the preceding embodiments, wherein the heterologous targeting domain comprises a Cas domain (e.g., a Cas9 domain, or a mutant or variant thereof, e.g., a Cas9 domain that binds specifically to the sequence comprised in the target DNA molecule).

562. The system, method, or template RNA of any of the preceding embodiments, wherein the Cas domain is associated with a guide RNA (gRNA).

563. The system, method, or template RNA of any of the preceding embodiments, wherein the heterologous targeting domain comprises an endonuclease domain (e.g., a heterologous endonuclease domain).

564. The system, method, or template RNA of any of the preceding embodiments, wherein the endonuclease domain comprises a Cas domain (e.g., a Cas9 or a mutant or variant thereof).

565. The system, method, or template RNA of any of the preceding embodiments, wherein the Cas domain is associated with a guide RNA (gRNA).

566. The system, method, or template RNA of any of the preceding embodiments, wherein the endonuclease domain comprises a Fok1 domain.

567. The system, method, or template RNA of any of the preceding embodiments, wherein the template nucleic acid molecule comprises at least one (e.g., one or two) heterologous homology sequence having at least 85%, 90%, 95%, 96%, 97%, 98%, 99%, or 100% homology to a sequence comprised in a target DNA molecule (e.g., a genomic DNA).

568. The system, method, or template RNA of any of the preceding embodiments, wherein one of the at least one heterologous homology sequences is positioned at or within about 1, 2, 3, 4, 5, 6, 7, 8, 9, 10, 15, 20, 25, 30, 35, 40, 45, 50, 60, 70, 80, 90, or 100 nucleotides of the 5' end of the template nucleic acid molecule.

569. The system, method, or template RNA of any of the preceding embodiments, wherein one of the at least one heterologous homology sequences is positioned at or within about 1, 2, 3, 4, 5, 6, 7, 8, 9, 10, 15, 20, 25, 30, 35, 40, 45, 50, 60, 70, 80, 90, or 100 nucleotides of the 3' end of the template nucleic acid molecule.

570. The system, method, or template RNA of any of the preceding embodiments, wherein the heterologous homology sequence binds within 1, 2, 3, 4, 5, 6, 7, 8, 9, or 10 nucleotides of a nick site (e.g., produced by a nickase, e.g., an endonuclease domain, e.g., as described herein) in the target DNA molecule.

571. The system, method, or template RNA of any of the preceding embodiments, wherein the heterologous homology sequence has less than 50%, 40%, 30%, 20%, 10%, 5%, 4%, 3%, 2%, or 1% sequence identity with a nucleic acid sequence complementary to an endogenous homology sequence of an unmodified form of the template RNA.

572. The system, method, or template RNA of any of the preceding embodiments, wherein the heterologous homology sequence has having at least 85%, 90%, 95%, 96%, 97%, 98%, 99%, or 100% homology to a sequence of the target DNA molecule that is different the sequence bound by an endogenous homology sequence (e.g., replaced by the heterologous homology sequence).

573. The system, method, or template RNA of any of the preceding embodiments, wherein the heterologous homology sequence comprises a sequence (e.g., at its 3' end) having at least 85%, 90%, 95%, 96%, 97%, 98%, 99%, or 100% homology to a sequence positioned 5' to a nick site of the target DNA molecule (e.g., a site nicked by a nickase, e.g., an endonuclease domain as described herein).

574. The system, method, or template RNA of any of the preceding embodiments, wherein the heterologous homology sequence comprises a sequence (e.g., at its 5' end) suitable for priming target-primed reverse transcription (TPRT) initiation.

575. The system, method, or template RNA of any of the preceding embodiments, wherein the heterologous homology sequence has at least 85%, 90%, 95%, 96%, 97%, 98%, 99%, or 100% homology to a sequence positioned within about 1, 2, 3, 4, 5, 6, 7, 8, 9, 10, 15, 20, 25, 30, 35, 40, 45, 50, 60, 70, 80, 90, or 100 nucleotides of (e.g., 3' relative to) a target insertion site, e.g., for a heterologous object sequence (e.g., as described herein), in the target DNA molecule.

576. The system, method, or template RNA of any of the preceding embodiments, wherein the template nucleic acid molecule comprises a guide RNA (gRNA), e.g., as described herein.

577. The system, method, or template RNA of any of the preceding embodiments, wherein the template nucleic acid molecule comprises a gRNA spacer sequence (e.g., at or within 1, 2, 3, 4, 5, 10, 15, 20, 25, 30, 40, 50, 60, 70, 80, 90, or 100 nucleotides of its 5' end).

578. A template RNA (or DNA encoding the template RNA) comprising (e.g., from 5' to 3') (i) a sequence that binds a target site (e.g., a second strand of a site in a target genome), (ii) a sequence that specifically binds an RT domain of a polypeptide, (iii) a heterologous object sequence, and (iv) a 3' target homology domain.

579. The template RNA of any of the preceding embodiments, further comprising (v) a sequence that binds an endonuclease and/or a DNA-binding domain of a polypeptide (e.g., the same polypeptide comprising the RT domain).

580. The template RNA of any of the preceding embodiments, wherein the RT domain comprises a sequence selected of Table 3B, 10, 11, or X or a sequence that has at least 70%, 75%, 80%, 85%, 90%, 95%, 96%, 97%, 98%, or 99% identity thereto.

581. The template RNA of any of the preceding embodiments, wherein the RT domain comprises a sequence selected of Table 3B, 10, 11, or X, wherein the RT domain further comprises a number of substitutions relative to the natural sequence, e.g., at least 1, 2, 3, 4, 5, 10, 20, 30, 40, 50, 60, 70, 80, 90, or 100 substitutions.

582. The template RNA of any of the preceding embodiments, wherein the sequence of (ii) specifically binds the RT domain.

583. The template RNA of any of the preceding embodiments, wherein the sequence that specifically binds the RT domain is a sequence, e.g., a UTR sequence, of Table 3B or 10, or a sequence having at least 70, 75, 80, 85, 90, 95, or 99% identity thereto.

584. A template RNA (or DNA encoding the template RNA) comprising from 5' to 3': (ii) a sequence that binds an endonuclease and/or a DNA-binding domain of a polypeptide, (i) a sequence that binds a target site (e.g., a second strand of a site in a target genome), (iii) a heterologous object sequence, and (iv) a 3' target homology domain.

585. A template RNA (or DNA encoding the template RNA) comprising from 5' to 3': (iii) a heterologous object sequence, (iv) a 3' target homology domain, (i) a sequence that binds a target site (e.g., a second strand of a site in a target genome), and (ii) a sequence that binds an endonuclease and/or a DNA-binding domain of a polypeptide.

586. The system, method, kit, template RNA, or reaction mixture of any of the preceding embodiments, wherein an RNA of the system (e.g., template RNA, the RNA encoding the polypeptide of (a), or an RNA expressed from a heterologous object sequence integrated into a target DNA) comprises a microRNA binding site, e.g., in a 3' UTR.

587. The system, method, kit, template RNA, or reaction mixture of any of the preceding embodiments wherein the microRNA binding site is recognized by a miRNA that is present in a non-target cell type, but that is not present (or is present at a reduced level relative to the non-target cell) in a target cell type.

588. The system, method, kit, template RNA, or reaction mixture of any of the preceding embodiments, wherein the miRNA is miR-142, and/or wherein the non-target cell is a Kupffer cell or a blood cell, e.g., an immune cell. 144. The system, method, kit, template RNA, or reaction mixture of any of the preceding embodiments, wherein the miRNA is miR-182 or miR-183, and/or wherein the non-target cell is a dorsal root ganglion neuron.

588. The system, method, kit, template RNA, or reaction mixture of any of the preceding embodiments, wherein the system comprises a first miRNA binding site that is recognized by a first miRNA (e.g., miR-142) and the system further comprises a second miRNA binding site that is recognized by a second miRNA (e.g., miR-182 or miR-183), wherein the first miRNA binding site and the second miRNA binding site are situated on the same RNA or on different RNAs of the system.

589. The system, method, kit, template RNA, or reaction mixture of any of the preceding embodiments, wherein the template RNA comprises at least 2, 3, or 4 miRNA binding sites, e.g., wherein the miRNA binding sites are recognized by the same or different miRNAs.

590. The system, method, kit, template RNA, or reaction mixture of any of the preceding embodiments, wherein the RNA encoding the polypeptide of (a) comprises at least 2, 3, or 4 miRNA binding sites, e.g., wherein the miRNA binding sites are recognized by the same or different miRNAs.

591. The system, method, kit, template RNA, or reaction mixture of any of the preceding embodiments, wherein the RNA expressed from a heterologous object sequence integrated into a target DNA comprises at least 2, 3, or 4 miRNA binding sites, e.g., wherein the miRNA binding sites are recognized by the same or different miRNAs.

Definitions

Domain: The term "domain" as used herein refers to a structure of a biomolecule that contributes to a specified function of the biomolecule. A domain may comprise a contiguous region (e.g., a contiguous sequence) or distinct, non-contiguous regions (e.g., non-contiguous sequences) of a biomolecule. Examples of protein domains include, but are not limited to, an endonuclease domain, a DNA binding domain, a reverse transcription domain; an example of a domain of a nucleic acid is a regulatory domain, such as a transcription factor binding domain.

Exogenous: As used herein, the term exogenous, when used with reference to a biomolecule (such as a nucleic acid sequence or polypeptide) means that the biomolecule was introduced into a host genome, cell or organism by the hand of man. For example, a nucleic acid that is as added into an existing genome, cell, tissue or subject using recombinant DNA techniques or other methods is exogenous to the existing nucleic acid sequence, cell, tissue or subject.

Genomic safe harbor site (GSH site): A genomic safe harbor site is a site in a host genome that is able to accommodate the integration of new genetic material, e.g., such that the inserted genetic element does not cause significant alterations of the host genome posing a risk to the host cell or organism. A GSH site generally meets 1, 2, 3, 4, 5, 6, 7, 8 or 9 of the following criteria: (i) is located >300 kb from a cancer-related gene; (ii) is >300 kb from a miRNA/other functional small RNA; (iii) is >50 kb from a 5' gene end; (iv) is >50 kb from a replication origin; (v) is >50 kb away from any ultraconservered element; (vi) has low transcriptional activity (i.e. no mRNA+/−25 kb); (vii) is not in copy number variable region; (viii) is in open chromatin; and/or (ix) is unique, with 1 copy in the human genome. Examples of GSH sites in the human genome that meet some or all of these criteria include (i) the adeno-associated virus site 1 (AAVS1), a naturally occurring site of integration of AAV virus on chromosome 19; (ii) the chemokine (C-C motif) receptor 5 (CCR5) gene, a chemokine receptor gene known as an HIV-1 coreceptor; (iii) the human ortholog of the mouse Rosa26 locus; (iv) the rDNA locus. Additional GSH sites are known and described, e.g., in Pellenz et al. epub Aug. 20, 2018 (doi.org/10.1101/396390).

Heterologous: The term heterologous, when used to describe a first element in reference to a second element means that the first element and second element do not exist in nature disposed as described. For example, a heterologous polypeptide, nucleic acid molecule, construct or sequence refers to (a) a polypeptide, nucleic acid molecule or portion of a polypeptide or nucleic acid molecule sequence that is not native to a cell in which it is expressed, (b) a polypeptide or nucleic acid molecule or portion of a polypeptide or nucleic acid molecule that has been altered or mutated relative to its native state, or (c) a polypeptide or nucleic acid molecule with an altered expression as compared to the native expression levels under similar conditions. For example, a heterologous regulatory sequence (e.g., promoter, enhancer) may be used to regulate expression of a gene or a nucleic acid molecule in a way that is different than the gene or a nucleic acid molecule is normally expressed in nature. In another example, a heterologous domain of a polypeptide or nucleic acid sequence (e.g., a DNA binding domain of a polypeptide or nucleic acid encoding a DNA binding domain of a polypeptide) may be disposed relative to other domains or may be a different sequence or from a different source, relative to other domains or portions of a polypeptide or its encoding nucleic acid. In certain embodiments, a heterologous nucleic acid molecule may exist in a native host cell genome, but may have an altered expression level or have a different sequence or both. In other embodiments, heterologous nucleic acid molecules may not be endogenous to a host cell or host genome but instead may have been introduced into a host cell by transformation (e.g., transfection, electroporation), wherein the added molecule may integrate into the host genome or can exist as extra-chromosomal genetic material either transiently (e.g., mRNA) or semi-stably for more than one generation (e.g., episomal viral vector, plasmid or other self-replicating vector). In some embodiments, a domain is heterologous relative to another domain, if the first domain is not naturally comprised in the same polypeptide as the other domain (e.g., a fusion between two domains of different proteins from the same organism).

Mutation or Mutated: The term "mutated" when applied to nucleic acid sequences means that nucleotides in a nucleic acid sequence may be inserted, deleted or changed compared to a reference (e.g., native) nucleic acid sequence. A single alteration may be made at a locus (a point mutation) or multiple nucleotides may be inserted, deleted or changed at a single locus. In addition, one or more alterations may be made at any number of loci within a nucleic acid sequence. A nucleic acid sequence may be mutated by any method known in the art. In some embodiments a mutation occurs naturally. In some embodiments a desired mutation can be produced by a system described herein.

Nucleic acid molecule: Nucleic acid molecule refers to both RNA and DNA molecules including, without limitation, cDNA, genomic DNA and mRNA, and also includes synthetic nucleic acid molecules, such as those that are chemically synthesized or recombinantly produced, such as RNA templates, as described herein. The nucleic acid molecule can be double-stranded or single-stranded, circular or linear. If single-stranded, the nucleic acid molecule can be the sense strand or the antisense strand. Unless otherwise indicated, and as an example for all sequences described herein under the general format "SEQ. ID NO:" "nucleic acid comprising SEQ. ID NO:1" refers to a nucleic acid, at least a portion which has either (i) the sequence of SEQ. ID NO:1, or (ii) a sequence complimentary to SEQ. ID NO:1. The choice between the two is dictated by the context in which SEQ. ID NO:1 is used. For instance, if the nucleic acid is used as a probe, the choice between the two is dictated by the requirement that the probe be complimentary to the desired target. Nucleic acid sequences of the present disclosure may be modified chemically or biochemically or may contain non-natural or derivatized nucleotide bases, as will be readily appreciated by those of skill in the art. Such modifications include, for example, labels, methylation, substitution of one or more naturally occurring nucleotides with an analog, inter-nucleotide modifications such as uncharged linkages (for example, methyl phosphonates, phosphotriesters, phosphoramidates, carbamates, etc.), charged linkages (for example, phosphorothioates, phosphorodithioates, etc.), pendant moieties, (for example, polypeptides), intercalators (for example, acridine, psoralen, etc.), chelators, alkylators, and modified linkages (for example, alpha anomeric nucleic acids, etc.). Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of a molecule. Other modifications can include, for example, analogs in which the ribose ring contains a bridging moiety or other structure such as modifications found in "locked" nucleic acids.

Gene expression unit: a gene expression unit is a nucleic acid sequence comprising at least one regulatory nucleic acid sequence operably linked to at least one effector sequence. A first nucleic acid sequence is operably linked with a second nucleic acid sequence when the first nucleic acid sequence is placed in a functional relationship with the second nucleic acid sequence. For instance, a promoter or enhancer is operably linked to a coding sequence if the promoter or enhancer affects the transcription or expression of the coding sequence. Operably linked DNA sequences may be contiguous or non-contiguous. Where necessary to join two protein-coding regions, operably linked sequences may be in the same reading frame.

Host: The terms host genome or host cell, as used herein, refer to a cell and/or its genome into which protein and/or genetic material has been introduced. It should be understood that such terms are intended to refer not only to the particular subject cell and/or genome, but to the progeny of such a cell and/or the genome of the progeny of such a cell. Because certain modifications may occur in succeeding generations due to either mutation or environmental influences, such progeny may not, in fact, be identical to the parent cell, but are still included within the scope of the term "host cell" as used herein. A host genome or host cell may be an isolated cell or cell line grown in culture, or genomic material isolated from such a cell or cell line, or may be a host cell or host genome which composing living tissue or an organism. In some instances, a host cell may be an animal cell or a plant cell, e.g., as described herein. In certain instances, a host cell may be a bovine cell, horse cell, pig cell, goat cell, sheep cell, chicken cell, or turkey cell. In certain instances, a host cell may be a corn cell, soy cell, wheat cell, or rice cell.

Pseudoknot: A "pseudoknot sequence" sequence, as used herein, refers to a nucleic acid (e.g., RNA) having a sequence with suitable self-complementarity to form a pseudoknot structure, e.g., having: a first segment, a second segment between the first segment and a third segment, wherein the third segment is complementary to the first segment, and a fourth segment, wherein the fourth segment is complementary to the second segment. The pseudoknot may optionally have additional secondary structure, e.g., a stem loop disposed in the second segment, a stem-loop disposed between the second segment and third segment, sequence before the first segment, or sequence after the fourth segment. The pseudoknot may have additional sequence between the first and second segments, between the second and third segments, or between the third and fourth segments. In some embodiments, the segments are arranged, from 5' to 3': first, second, third, and fourth. In some embodiments, the first and third segments comprise five base pairs of perfect complementarity. In some embodiments, the second and fourth segments comprise 10 base pairs, optionally with one or more (e.g., two) bulges. In some embodiments, the second segment comprises one or more unpaired nucleotides, e.g., forming a loop. In some embodiments, the third segment comprises one or more unpaired nucleotides, e.g., forming a loop.

Stem-loop sequence: As used herein, a "stem-loop sequence" refers to a nucleic acid sequence (e.g., RNA sequence) with sufficient self-complementarity to form a stem-loop, e.g., having a stem comprising at least two (e.g., 3, 4, 5, 6, 7, 8, 9, or 10) base pairs, and a loop with at least three (e.g., four) base pairs. The stem may comprise mismatches or bulges.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 6 is a table listing the modules of an exemplary Gene Writer RNA template. Individual modules can be combined, re-arranged, and/or omitted, e.g., to produce a Gene Writer template. A=5' homology arm; B=Ribozyme; C=5' UTR; D=heterologous object sequence; E=3' UTR; F=3' homology arm.

FIGS. 7A and 7B are diagrams showing an exemplary second strand nicking process. (A) A Cas9 nickase is fused to a Gene Writer protein. The Gene Writer protein introduces a nick in a DNA strand through its EN domain (shown as *), and the fused Cas9 nickase introduces a nicks on either top or bottom DNA strands (shown as X). (B) A Gene Writer is targeted to DNA through its DNA biding domain and introduces a DNA nick with its EN domain (*). A Cas9 nickase is then used the generate a second nick (X) at the top or bottom strand, upstream or downstream of the EN introduced nick.

DETAILED DESCRIPTION

Figure 1:
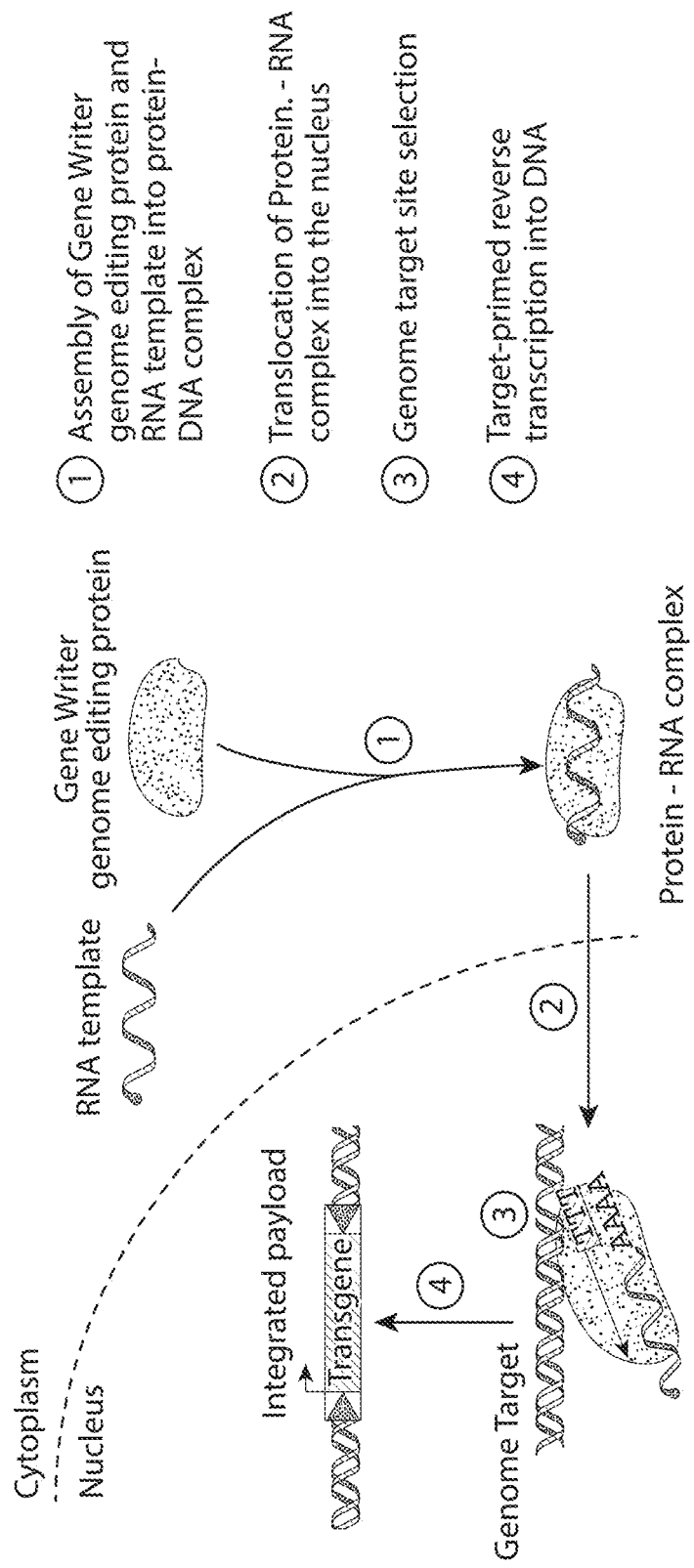
FIG. 1 is a schematic of the Gene Writing™ genome editing system.

This disclosure relates to compositions, systems and methods for targeting, editing, modifying or manipulating a DNA sequence (e.g., inserting a heterologous object DNA sequence into a target site of a mammalian genome) at one or more locations in a DNA sequence in a cell, tissue or subject, e.g., in vivo or in vitro. The object DNA sequence may include, e.g., a coding sequence, a regulatory sequence, a gene expression unit.

More specifically, the disclosure provides retrotransposon-based systems for inserting a sequence of interest into the genome. This disclosure is based, in part, on a bioinformatic analysis to identify retrotransposase sequences and the associated 5' UTR and 3' UTR from a variety of organisms (see Tables 3B, 10, 11, and X). Additional examples of retrotransposon elements are listed, e.g., in Tables 1 and 2 of PCT Application No. PCT/US2019/048607, incorporated herein by reference in its entirety.

In some embodiments, systems described herein can have a number of advantages relative to various earlier systems. For instance, the disclosure describes retrotransposases capable of inserting long sequences of heterologous nucleic acid into a genome. In addition, retrotransposases described herein can insert heterologous nucleic acid in an endogenous site in the genome, such as the rDNA locus. This is in contrast to Cre/loxP systems which require a first step of inserting an exogenous loxP site before a second step of inserting a sequence of interest into the loxP site.

Gene-Writer™ Genome Editors

Non-long terminal repeat (LTR) retrotransposons are a type of mobile genetic elements that are widespread in eukaryotic genomes. They include, for example, the apurinic/apyrimidinic endonuclease (APE)-type, the restriction enzyme-like endonuclease (RLE)-type, and the Penelope-like element (PLE)-type. The APE class retrotransposons are comprised of two functional domains: an endonuclease/DNA binding domain, and a reverse transcriptase domain. Examples of APE-class retrotransposons can be found, for example, in Table 1 of PCT Application No. PCT/US2019/048607, incorporated herein by reference in its entirety, including the sequence listing and sequences referred to in Table 1 therein. The RLE class are comprised of three functional domains: a DNA binding domain, a reverse transcription domain, and an endonuclease domain. Examples of RLE-class retrotransposons can be found, for example, in Table 2 of PCT Application No. PCT/US2019/048607, incorporated herein by reference in its entirety, including the sequence listing and sequences referred to in Table 2 therein. The reverse transcriptase domain of non-LTR retrotransposon functions by binding an RNA sequence template and reverse transcribing it into the host genome's target DNA. The RNA sequence template has a 3' untranslated region which is specifically bound to the retrotransposase, and a variable 5' region generally having Open Reading Frame(s) ("ORF") encoding retrotransposase proteins. The RNA sequence template may also comprise a 5' untranslated region which specifically binds the retrotransposase. Penelope-like elements (PLEs) are distinct from both LTR and non-LTR retrotransposons. PLEs generally comprise a reverse transcriptase domain distinct from that of APE and RLE elements, but similar to that of telomerases and Group II introns, and an optional GIY-YIG endonuclease domain.

Other exemplary classes of retrotransposon include, without limitation, CRE, NeSL, R4, R2, Hero, L1, RTE (e.g., AviRTE_Brh or BovB), I, Jockey, CR1, Rex1, RandI/Dualen, Penelope or Penelope-like (PLE) (e.g., Penelope_SM), Tx1, RTEX, Crack, Nimb, Proto1, Proto2, RTETP, L2, Tad1, Loa, Ingi, Outcast, R1, Daphne, L2A, L2B, Ambal, Vingi (e.g., Vingi-1_EE), and Kiri retrotransposons.

As described herein, the elements of such retrotransposons can be functionally modularized and/or modified to target, edit, modify or manipulate a target DNA sequence, e.g., to insert an object (e.g., heterologous) nucleic acid sequence into a target genome, e.g., a mammalian genome, by reverse transcription. Such modularized and modified nucleic acids, polypeptide compositions and systems are described herein and are referred to as Gene Writer™ gene editors. A Gene Writer™ gene editor system comprises: (A) a polypeptide or a nucleic acid encoding a polypeptide, wherein the polypeptide comprises (i) a reverse transcriptase domain, and either (x) an endonuclease domain that contains DNA binding functionality or (y) an endonuclease domain and separate DNA binding domain; and (B) a template RNA comprising (i) a sequence that binds the polypeptide and (ii) a heterologous insert sequence. For example, the Gene Writer genome editor protein may comprise a DNA-binding domain, a reverse transcriptase domain, and an endonuclease domain. In other embodiments, the Gene Writer genome editor protein may comprise a reverse transcriptase domain and an endonuclease domain. In certain embodiments, the elements of the Gene Writer™ gene editor polypeptide can be derived from sequences of retrotransposons, e.g., APE-type, RLE-type, or PLE-type retrotransposons or portions or domains thereof. In some embodiments the RLE-type non-LTR retrotransposon is from the R2, NeSL, HERO, R4, or CRE clade. In some embodiments the Gene Writer genome editor is derived from R4 element X4_Line, which is found in the human genome. In some embodiments the APE-type non-LTR retrotransposon is from the R1, or Tx1 clade. In some embodiments the Gene Writer genome editor is derived from Tx1 element Mare6, which is found in the human genome. The RNA template element of a Gene Writer™ gene editor system is typically heterologous to the polypeptide element and provides an object sequence to be inserted (reverse transcribed) into the host genome. In some embodiments the Gene Writer genome editor protein is capable of target primed reverse transcription.

In some embodiments the Gene Writer genome editor is combined with a second polypeptide. In some embodiments the second polypeptide is derived from an APE-type non-LTR retrotransposon. In some embodiments the second polypeptide has a zinc knuckle-like motif. In some embodiments the second polypeptide is a homolog of Gag proteins.

In some embodiments, the Gene Writer genome editor comprises a retrotransposase sequence of an element listed in Table X. Table X provides a series of nucleic acid and amino acid sequences (listed by Repbase gene name and species), with associated GenBank Accession numbers where available. The Repbase nucleic acid and amino acid sequences of elements listed in Table X are incorporated herein by reference in their entireties. The GenBank sequences of elements listed in Table X are also incorporated herein by reference in their entireties. The nucleic acid sequences of Table X include, in some instances, a sequence encoding a polypeptide (e.g., an open reading frame) (e.g., the protein-coding sequence of the corresponding Repbase entry, incorporated herein by reference). The nucleic acid sequences of Table X include, in some instances, a 5' UTR sequence (e.g., the 5' UTR sequence of the corresponding Repbase entry, incorporated herein by reference). The nucleic acid sequences of Table X include, in some instances, a 3' UTR sequence (e.g., the 3' UTR sequence of the corresponding Repbase entry, incorporated herein by reference).

In some embodiments, an open reading frame (ORF) for the amino acid sequence is annotated in Repbase. In some embodiments, an ORF for the amino acid sequence is not annotated in Repbase. When the ORF is not annotated, it can be identified by one of skill in the art, e.g., by performing one or more translations (e.g., all-frame translations), and optionally comparing the translation to a reverse transcriptase sequence or consensus motif. In some embodiments, an amino acid sequence of Table X, e.g., as used herein, is an amino acid sequence listed in the corresponding Repbase entry, or an amino acid sequence encoded by the nucleic acid sequence in the corresponding Repbase entry. In some embodiments, an amino acid sequence encoded by an element of Table X is an amino acid sequence encoded by the full length sequence of an element listed in Table X, or a sequence having at least 75%, 80%, 85%, 90%, 95%, 96%, 97%, 98%, or 99% sequence identity thereto. In some embodiments, the full length sequence of an element listed in Table X may comprise one or more (e.g., all of) a 5' UTR, polypeptide-encoding sequence, or 3' UTR of a retrotransposon as described herein. In some embodiments, an amino acid sequence of Table X is an amino acid sequence encoded by the full length sequence of an element listed in Table X, or a sequence having at least 75%, 80%, 85%, 90%, 95%, 96%, 97%, 98%, or 99% sequence identity thereto. In some embodiments, a 5' UTR of an element of Table X comprises a 5' UTR of the full length sequence of an element listed in Table X, or a sequence having at least 75%, 80%, 85%, 90%, 95%, 96%, 97%, 98%, or 99% sequence identity thereto. In some embodiments, a 3' UTR of an element of Table X comprises a 3' UTR of the full length sequence of an element listed in Table X, or a sequence having at least 75%, 80%, 85%, 90%, 95%, 96%, 97%, 98%, or 99% sequence identity thereto.

Also indicated in Table X are the host organisms from which the nucleic acid sequences were obtained and a listing of domains present within the polypeptide encoded by the open reading frame of the nucleic acid sequence. The domains listed in Table X are indicated as domain identifiers, which correspond to InterPro domain entries as listed in Table Y. Thus, a Repbase sequence listed in Table X can encode a polypeptide including one or more domains, indicated in Table X by their domain identifiers. The specific domain or domain type associated with each domain identifier is described in greater detail in Table Y. In some embodiments, a domain of interest (e.g., as listed in Table Y) can be identified in a nucleic acid sequence (e.g., as listed in Table X) by performing all-frame translations and identifying amino acid sequences encoding the domain of interest.

Retrotransposon Discovery Tools

As the result of repeated mobilization over time, transposable elements in genomic DNA often exist as tandem or interspersed repeats (Jurka Curr Opin Struct Biol 8, 333-337 (1998)). Tools capable of recognizing such repeats can be used to identify new elements from genomic DNA and for populating databases, e.g., Repbase (Jurka et al Cytogenet Genome Res 110, 462-467 (2005)). One such tool for identifying repeats that may comprise transposable elements is RepeatFinder (Volfovsky et al Genome Biol 2 (2001)), which analyzes the repetitive structure of genomic sequences. Repeats can further be collected and analyzed using additional tools, e.g., Censor (Kohany et al BMC Bioinformatics 7, 474 (2006)). The Censor package takes genomic repeats and annotates them using various BLAST approaches against known transposable elements. An all-frames translation can be used to generate the ORF(s) for comparison.

Other exemplary methods for identification of transposable elements include RepeatModeler2, which automates the discovery and annotation of transposable elements in genome sequences (Flynn et al bioRxiv (2019)). In addition to accomplishing this via available packages like Censor, one can perform an all-frames translation of a given genome or sequence and annotate with a protein domain tool like InterProScan, which tags the domains of a given amino acid sequence using the InterPro database (Mitchell et al. Nucleic Acids Res 47, D351-360 (2019)), allowing the identification of potential proteins comprising domains associated with known transposable elements (e.g., domains of elements listed in Table X).

Retrotransposons can be further classified according to the reverse transcriptase domain using a tool such as RTclass1 (Kapitonov et al Gene 448, 207-213 (2009)).

Polypeptide Component of Gene Writer Gene Editor System

RT Domain:

In certain aspects of the present invention, the reverse transcriptase domain of the Gene Writer system is based on a reverse transcriptase domain of an APE-type or RLE-type non-LTR retrotransposon, or of a PLE-type retrotransposon. A wild-type reverse transcriptase domain of an APE-type, RLE-type, or PLE-type retrotransposon can be used in a Gene Writer system or can be modified (e.g., by insertion, deletion, or substitution of one or more residues) to alter the reverse transcriptase activity for target DNA sequences. In some embodiments the reverse transcriptase is altered from its natural sequence to have altered codon usage, e.g. improved for human cells. In some embodiments the reverse transcriptase domain is a heterologous reverse transcriptase from a different retrovirus, retron, diversity-generating retroelement, retroplasmid, Group II intron, LTR-retrotransposon, non-LTR retrotransposon, or other source, e.g., as exemplified in Table Z1 or as comprising a domain listed in Table Z2. In certain embodiments, a Gene Writer system includes a polypeptide that comprises a reverse transcriptase domain of an RLE-type non-LTR retrotransposon from the R2, NeSL, HERO, R4, or CRE clade, of an APE-type non-LTR retrotransposon from the L1, RTE, I, Jockey, CR1, Rex1, RandI/Dualen, T1, RTEX, Crack, Nimb, Proto1, Proto2, RTETP, L2, Tad1, *Loa*, Ingi, Outcast, R1, Daphne, L2A, L2B, Ambal, Vingi, or Kiri clade, or of a PLE-type retrotransposon. In certain embodiments, a Gene Writer system includes a polypeptide that comprises a reverse transcriptase domain of a retrotransposon listed in Table 10, Table 11, Table Z2, or Table 3A or 3B. In embodiments, the amino acid sequence of the reverse transcriptase domain of a Gene Writer system is at least about 50%, at least about 60%, at least about 70%, at least about 80%, at least about 85%, at least about 90%, at least about 95%, at least about 96%, at least about 97%, at least about 98%, at least about 99% identical to the amino acid sequence of a reverse transcriptase domain of a retrotransposon whose DNA sequence is referenced in Table 10, Table 11, Table X, Table Z1, Table Z2, or Table 3A or 3B. Reverse transcription domains can be identified, for example, based upon homology to other known reverse transcription domains using routine tools as Basic Local Alignment Search Tool (BLAST). In some embodiments, reverse transcriptase domains are modified, for example by site-specific mutation. In some embodiments, the reverse transcriptase domain is engineered to bind a heterologous template RNA.

In some embodiments, a polypeptide (e.g., RT domain) comprises an RNA-binding domain, e.g., that specifically binds to an RNA sequence. In some embodiments, a template RNA comprises an RNA sequence that is specifically bound by the RNA-binding domain.

In some embodiments, the RT domain exhibits enhanced stringency of target-primed reverse transcription (TPRT) initiation, e.g., relative to an endogenous RT domain. In some embodiments, the RT domain initiates TPRT when the 3 nt in the target site immediately upstream of the first strand nick, e.g., the genomic DNA priming the RNA template, have at least 66% or 100% complementarity to the 3 nt of homology in the RNA template. In some embodiments, the RT domain initiates TPRT when there are less than 5 nt mismatched (e.g., less than 1, 2, 3, 4, or 5 nt mismatched) between the template RNA homology and the target DNA priming reverse transcription. In some embodiments, the RT domain is modified such that the stringency for mismatches in priming the TPRT reaction is increased, e.g., wherein the RT domain does not tolerate any mismatches or tolerates fewer mismatches in the priming region relative to a wild-type (e.g., unmodified) RT domain. In some embodiments, the RT domain comprises a HIV-1 RT domain. In embodiments, the HIV-1 RT domain initiates lower levels of synthesis even with three nucleotide mismatches relative to an alternative RT domain (e.g., as described by Jamburuthugoda and Eickbush J Mol Biol 407(5):661-672 (2011); incorporated herein by reference in its entirety).

In some embodiments, the RT domain forms a dimer (e.g., a heterodimer or homodimer). In some embodiments, the RT domain is monomeric. In some embodiments, an RT domain, e.g., a retroviral RT domain, naturally functions as a monomer or as a dimer (e.g., heterodimer or homodimer). In some embodiments, an RT domain naturally functions as a monomer, e.g., is derived from a virus wherein it functions as a monomer. Exemplary monomeric RT domains, their viral sources, and the RT signatures associated with them can be found in Table 30 with descriptions of domain signatures in Table 32. In some embodiments, the RT domain of a system described herein comprises an amino acid sequence of Table 30, or a functional fragment or variant thereof, or a sequence having at least 70%, 80%, 90%, 95%, or 99% identity thereto. In embodiments, the RT domain is selected from an RT domain from murine leukemia virus (MLV; sometimes referred to as MoMLV) (e.g., P03355), porcine endogenous retrovirus (PERV) (e.g., UniProt Q4VFZ2), mouse mammary tumor virus (MMTV) (e.g., UniProt P03365), Mason-Pfizer monkey virus (MPMV) (e.g., UniProt P07572), bovine leukemia virus (BLV) (e.g., UniProt P03361), human T-cell leukemia virus-1 (HTLV-1) (e.g., UniProt P03362), human foamy virus (HFV) (e.g., UniProt P14350), simian foamy virus (SFV) (e.g., UniProt P23074), or bovine foamy/syncytial virus (BFV/BSV) (e.g., UniProt 041894), or a functional fragment or variant thereof (e.g., an amino acid sequence having at least 70%, 80%, 90%, 95%, or 99% identity thereto). In some embodiments, an RT domain is dimeric in its natural functioning. Exemplary dimeric RT domains, their viral sources, and the RT signatures associated with them can be found in Table 31 with descriptions of domain signatures in Table 32. In some embodiments, the RT domain of a system described herein comprises an amino acid sequence of Table 31, or a functional fragment or variant thereof, or a sequence having at least 70%, 80%, 90%, 95%, or 99% identity thereto. In some embodiments, the RT domain is derived from a virus wherein it functions as a dimer. In embodiments, the RT domain is selected from an RT domain from avian sarcoma/leukemia virus (ASLV) (e.g., UniProt A0A142BKH1), Rous sarcoma virus (RSV) (e.g., UniProt P03354), avian myeloblastosis virus (AMV) (e.g., UniProt Q83133), human immunodeficiency virus type I (HIV-1) (e.g., UniProt P03369), human immunodeficiency virus type II (HIV-2) (e.g., UniProt P15833), simian immunodeficiency virus (SIV) (e.g., UniProt P05896), bovine immunodeficiency virus (BIV) (e.g., UniProt P19560), equine infectious anemia virus (EIAV) (e.g., UniProt P03371), or feline immunodeficiency virus (FIV) (e.g., UniProt P16088) (Herschhorn and Hizi Cell Mol Life Sci 67(16):2717-2747 (2010)), or a functional fragment or variant thereof (e.g., an amino acid sequence having at least 70%, 80%, 90%, 95%, or 99% identity thereto). Naturally heterodimeric RT domains may, in some embodiments, also be functional as homodimers. In some embodiments, dimeric RT domains are expressed as fusion proteins, e.g., as homodimeric fusion proteins or heterodimeric fusion proteins. In some embodiments, the RT function of the system is fulfilled by multiple RT domains (e.g., as described herein). In further embodiments, the multiple RT domains are fused or separate, e.g., may be on the same polypeptide or on different polypeptides.

In some embodiment, a GeneWriter described herein comprises an integrase domain, e.g., wherein the integrase domain may be part of the RT domain. In some embodiments, an RT domain (e.g., as described herein) comprises an integrase domain. In some embodiments, an RT domain (e.g., as described herein) lacks an integrase domain, or comprises an integrase domain that has been inactivated by mutation or deleted. In some embodiment, a GeneWriter described herein comprises an RNase H domain, e.g., wherein the RNase H domain may be part of the RT domain. In some embodiments, an RT domain (e.g., as described herein) comprises an RNase H domain, e.g., an endogenous RNAse H domain or a heterologous RNase H domain. In some embodiments, an RT domain (e.g., as described herein) lacks an RNase H domain. In some embodiments, an RT domain (e.g., as described herein) comprises an RNase H domain that has been added, deleted, mutated, or swapped for a heterologous RNase H domain. In some embodiments, mutation of an RNase H domain yields a polypeptide exhibiting lower RNase activity, e.g., as determined by the methods described in Kotewicz et al. Nucleic Acids Res 16(1):265-277 (1988) (incorporated herein by reference in its entirety), e.g., lower by at least 10%, 20%, 30%, 40%, 50%, 60%, 70%, 80%, or 90% compared to an otherwise similar domain without the mutation. In some embodiments, RNase H activity is abolished.

In some embodiments, an RT domain is mutated to increase fidelity compared to an otherwise similar domain without the mutation. For instance, in some embodiments, a YADD (SEQ ID NO: 1542) or YMDD (SEQ ID NO: 1543) motif in an RT domain (e.g., in a reverse transcriptase) is replaced with YVDD (SEQ ID NO: 1544). In embodiments, replacement of the YADD (SEQ ID NO: 1542) or YMDD (SEQ ID NO: 1543) or YVDD (SEQ ID NO: 1544) results in higher fidelity in retroviral reverse transcriptase activity (e.g., as described in Jamburuthugoda and Eickbush J Mol Biol 2011; incorporated herein by reference in its entirety).

The diversity of reverse transcriptases (e.g., comprising RT domains) has been described in, but not limited to, those used by prokaryotes (Zimmerly et al. *Microbiol Spectr* 3(2):MDNA3-0058-2014 (2015); Lampson B. C. (2007) Prokaryotic Reverse Transcriptases. In: Polaina J., MacCabe A. P. (eds) Industrial Enzymes. Springer, Dordrecht), viruses (Herschhorn et al. *Cell Mol Life Sci* 67(16):2717-2747 (2010); Menéndez-Arias et al. Virus Res 234:153-176 (2017)), and mobile elements (Eickbush et al. *Virus Res* 134(1-2):221-234 (2008); Craig et al. *Mobile DNA III* 3rd Ed. DOI: 10.1128/9781555819217 (2015)), each of which is incorporated herein by reference.

TABLE 30

Exemplary monomeric retroviral reverse transcriptases and their RT domain signatures

| Name | Accession | Organism | Sequence | RT Signatures |
|---|---|---|---|---|
| Q4VFZ2_9GAMR - residues only | Q4VFZ2 | Porcine endogenous retrovirus | MGATGQQQYPWTTRRTVDLGVGRVT HSFLVIPECPAPLLGRDLLTKMGAQISF EQGKPEVSANNKPITVLTLQLDDEYRL YSPLVKPDQNIQFWLEQFPQAWAETA GMGLAKQVPPQVIQLKASATPVSVRQ YPLSKEAQEGIRPHVQRLIQQGILVPVQ SPWNTPLLPVRKPGTNDYRPVQDLRE VNKRVQDIHPTVPNPYNLLCALPPQRS WYTVLDLKDAFFCLRLHPTSQPLFAFE WRDPGTGRTGQLTWTRLPQGFKNSPTI FDEALHRDLANFRIQHPQVTLLQYVDD LLLAGATKQDCLEGTKALLLELSDLGY RASAKKAQICRREVTYLGYSLRDGQR WLTEARKKTVVQIPAPTTAKQVREFLG TAGFCRLWIPGFATLAAPLYPLTKEKG EFSWAPEHQKAFDAIKKALLSAPALAL PDVTKPFTLYVDERKGVARGVLTQTL GPWRRPVAYLSKKLDPVASGWPVCLK AIAAVAILVKDADKLTLGQNITVIAPH ALENIVRQPPDRWMTNARMTHYQSLL LTERVTFAPPAALNPATLLPEETDEPVT HDCHQLLIEETGVRKDLTDIPLTGEVLT WFTDGSSYVVEGKRMAGAAVVDGTR TIWASSLPEGTSAQKAELMALTQALRL AEGKSINIYTDSRYAFATAHVHGAIYK QRGLLTSAGREIKNKEEILSLLEALHLP KRLAIIHCPGHQKAKDPISRGNQMADR VAKQAAQGVNLLPMIETPKAPEPGRQ YTLEDWQEIKKIDQFSETPEGTCYTSD GKEILPHKEGLEYVQQIHRLTHLGTKH LQQLVRTSPYHVLRLPGVADSVVKHC VPCQLVNANPSRIPPGKRLRGSHPGAH WEVDFTEVKPAKYGNKYLLVFVDTFS GWVEAYPTKKETSTVVAKKILEEIFPR FGIPKVIGSDNGPAFVAQVSQGLAKILG IDWKLHCAYRPQSSGQVERMNRTIKET LTKLTAETGVNDWIALLPFVLFRVRNT PGQFGLTPYELLYGGPPPLVEIASVHSA DVLLSQPLFSRLKALEWVRQRAWRQL REAYSGGGDLQIPHRFQVGDSVYVRR HRAGNLETRWKGPYHVLLTTPTAVKV EGISTWIHASHVKPAPPPDSGWKAEKT ENPLKLRLHRVVPYSVNNESS (SEQ ID NO: 1545) | IPR043502, SSF56672, IPR000477, PF00078, cd03715 |
| POL_SFV1 - residues only | P23074 | Simian foamy virus type 1 | MDPLQLLQPLEAEIKGTKLKAHWDSG ATITCVPEAFLEDERPIQTMLIKTIHGEK QQDVYYLTFKVQGRKVEAEVLASPYD YILLNPSDVPWLMKKPLQLTVLVPLHE YQERLLQQTALPKEQKELLQKLFLKY DALWQHWENQVGHRRIKPHNIATGTL APRPQKQYPINPKAKPSIQIVIDDLLKQ GVLIQQNSTMNTPVYPVPKPDGKWRM VLDYREVNKTIPLIAAQNQHSAGILSSI YRGKYKTTLDLTNGFWAHPITPESYW LTAFTWQGKQYCWTRLPQGFLNSPAL | IPR043502, SSF56672, IPR000477, PF00078 |

TABLE 30-continued

Exemplary monomeric retroviral reverse transcriptases and their RT domain signatures

| Name | Accession | Organism | Sequence | RT Signatures |
|---|---|---|---|---|
| | | | FTADVVDLLKEIPNVQAYVDDIYISHD DPQEHLEQLEKIFSILLNAGYVVSLKKS EIAQREVEFLGFNITKEGRGLTDTFKQK LLNITPPKDLKQLQSILGLLNFARNFIPN YSELVKPLYTIVANANGKFISWTEDNS NQLQHIISVLNQADNLEERNPETRLIIK VNSSPSAGYIRYYNEGSKRPIMYVNYIF SKAEAKFTQTEKLLTTMHKGLIKAMD LAMGQEILVYSPIVSMTKIQRTPLPERK ALPVRWITWMTYLEDPRIQFHYDKSLP ELQQIPNVTEDVIAKTKHPSEFAMVFY TDGSAIKHPDVNKSHSAGMGIAQVQFI PEYKIVHQWSIPLGDHTAQLAEIAAVE FACKKALKISGPVLIVTDSFYVAESAN KELPYWKSNGFLNNKKKPLRHVSKW KSIAECLQLKPDIIIMHEKGHQQPMTTL HTEGNNLADKLATQGSYVVHCNTTPS LDAELDQLLQGHYPPGYPKQYKYTLE ENKLIVERPNGIRIVPPKADREKIISTAH NIAHTGRDATFLKVSSKYWWPNLRKD VVKSIRQCKQCLVTNATNLTSPPILRPV KPLKPFDKFYIDYIGPLPPSNGYLHVLV VVDSMTGFVWLYPTKAPSTSATVKAL NMLTSIAIPKVLHSDQGAAFTSSTFAD WAKEKGIQLEFSTPYHPQSSGKVERKN SDIKRLLTKLLIGRPAKWYDLLPVVQL ALNNSYSPSSKYTPHQLLFGVDSNTPF ANSDTLDLSREEELSLLQEIRSSLHQPT SPPASSRSWSPSVGQLVQERVARPASL RPRWHKPTAILEVVNPRTVIILDHLGN RRTVSVDNLKLTAYQDNGTSNDSGTM ALMEEDESSTSST (SEQ ID NO: 1546) | |
| POL_MPMV - residues only | P07572 | Mason- Pfizer monkey virus | MGQELSQHERYVEQLKQALKTRGVK VKYADLLKFFDFVKDTCPWFPQEGTID IKRWRRVGDCFQDYYNTFGPEKVPVT AFSYWNLIKELIDKKEVNPQVMAAVA QTEEILKSNSQTDLTKTSQNPDLDLISL DSDDEGAKSSSLQDKGLSSTKKPKRFP VLLTAQTSKDPEDPNPSEVDWDGLED EAAKYHNPDWPPFLTRPPPYNKATPSA PTVMAVVNPKEELKEKIAQLEEQIKLE ELHQALISKLQKLKTGNETVTHPDTAG GLSRTPHWPGQHIPKGKCCASREKEEQ IPKDIFPVTETVDGQGQAWRHHNGFDF AVIKELKTAASQYGATAPYTLAIVESV ADNWLTPTDWNTLVRAVLSGGDHLL WKSEFFENCRDTAKRNQQAGNGWDF DMLTGSGNYSSTDAQMQYDPGLFAQI QAAATKAWRKLPVKGDPGASLTGVK QGPDEPFADFVHRLITTAGRIFGSAEAG VDYVKQLAYENANPACQAAIRPYRKK TDLTGYIRLCSDIGPSYQQGLAMAAAF SGQTVKDFLNNKNKEKGGCCFKCGKK GHFAKNCHEHAHNNAEPKVPGLCPRC KRGKHWANECKSKTDNQGNPIPPHQG NRVEGPAPGPETSLWGSQLCSSQQKQP ISKLTRATPGSAGLDLCSTSHTVLTPEM GPQALSTGIYGPLPPNTFGLILGRSSITM KGLQVYPGVIDNDYTGEIKIMAKAVN NIVTVSQGNRIAQLILLPLIETDNKVQQ PYRGQGSFGSSDIYWVQPITCQKPSLTL WLDDKMFTGLIDTGADVTIIKLEDWPP NWPITDTLTNLRGIGQSNNPKQSSKYL TWRDKENNSGLIKPFVIPNLPVNLWGR DLLSQMKIMMCSPNDIVTAQMLAQGY SPGKGLGKKENGILHPIPNQGQSNKKG FGNFLTAAIDILAPQQCAEPITWKSDEP VWVDQWPLTNDKLAAAQQLVQEQLE AGHITESSSPWNTPIFVIKKKSGKWRLL QDLRAVNATMVLMGALQPGLPSPVAI PQGYLKIIIDLKDCFFSIPLHPSDQKRFA FSLPSTNFKEPMQRFQWKVLPQGMAN SPTLCQKYVATAIHKVRHAWKQMYII | IPR043502, SSF56672, IPR000477, PF00078, cd01645, PF06817, IPR010661 |

TABLE 30-continued

Exemplary monomeric retroviral reverse transcriptases and their RT domain signatures

| Name | Accession | Organism | Sequence | RT Signatures |
|---|---|---|---|---|
| | | | HYMDDILIAGKDGQQVLQCFDQLKQE LTAAGLHIAPEKVQLQDPYTYLGFELN GPKITNQKAVIRKDKLQTLNDFQKLLG DINWLRPYLKLTTGDLKPLFDTLKGDS DPNSHRSLSKEALASLEKVETAIAEQF VTHINYSLPLIFLIFNTALTPTGLFWQD NPIMWIHLPASPKKVLLPYYDAIADLII LGRDHSKKYFGIEPSTIIQPYSKSQIDW LMQNTEMWPIACASFVGILDNHYPPN KLIQFCKLHTFVFPQIISKTPLNNALLVF TDGSSTGMAAYTLTDTTIKFQTNLNSA QLVELQALIAVLSAFPNQPLNIYTDSAY LAHSIPLLETVAQIKHISETAKLFLQCQ QLIYNRSIPFYIGHVRAHSGLPGPIAQG NQRADLATKIVASNINTNLESAQNAHT LHHLNAQTLRLMFNIPREQARQIVKQC PICVTYLPVPHLGVNPRGLFPNMIWQM DVTHYSEFGNLKYIHVSIDTFSGFLLAT LQTGETTKHVITHLLHCFSIIGLPKQIKT DNGPGYTSKNFQEFCSTLQIKHITGIPY NPQGQGIVERAHLSLKTTIEKIKKGEW YPRKGTPRNILNHALFILNFLNLDDQN KSAADRFWHNNPKKQFAMVKWKDPL DNTWHGPDPVLIWGRGSVCVYSQTYD AARWLPERLVRQVSNNNQSRE (SEQ ID NO: 1547) | |
| POL_MMTVB - residues only | P03365 | Mouse mammary tumor virus | MGVSGSKGQKLFVSVLQRLLSERGLH VKESSAIEFYQFLIKVSPWFPEEGGLNL QDWKRVGREMKRYAAEHGTDSIPKQ AYPIWLQLREILTEQSDLVLLSAEAKSV TEEELEEGLTGLLSTSSQEKTYGTRGT AYAEIDTEVDKLSEHIYDEPYEEKEKA DKNEEKDHVRKIKKVVQRKENSEGKR KEKDSKAFLATDWNDDDLSPEDWDD LEEQAAHYHDDDELILPVKRKVVKKK PQALRRKPLPPVGFAGAMAEAREKGD LTFTFPVVFMGESDEDDTPVWEPLPLK TLKELQSAVRTMGPSAPYTLQVVDMV ASQWLTPSDWHQTARATLSPGDYVL WRTEYEEKSKEMVQKAAGKRKGKVS LDMLLGTGQFLSPSSQIKLSKDVLKDV TTNAVLAWRAIPPPGVKKTVLAGLKQ GNEESYETFISRLEEAVYRMMPRGEGS DILIKQLAWENANSLCQDLIRPIRKTGT IQDYIRACLDASPAVVQGMAYAAAMR GQKYSTFVKQTYGGGKGGQGAEGPV CFSCGKTGHIRKDCKDEKGSKRAPPGL CPRCKKGYHWKSECKSKFDKDGNPLP PLETNAENSKNLVKGQSPSPAQKGDG VKGSGLNPEAPPFTIHDLPRGTPGSAGL DLSSQKDLILSLEDGVSLVPTLVKGTLP EGTTGLIIGRSSNYKKGLEVLPGVIDSD FQGEIKVMVKAAKNAVIIHKGERIAQL LLLPYLKLPNPVIKEERGSEGFGSTSHV HWVQEISDSRPMLHIYLNGRRFLGLLD TGADKTCIAGRDWPANWPIHQTESSLQ GLGMACGVARSSQPLRWQHEDKSGII HPFVIPTLPFTLWGRDIMKDIKVRLMT DSPDDSQDLMIGAIESNLFADQISWKS DQPVWLNQWPLKQEKLQALQQLVTE QLQLGHLEESNSPWNTPVFVIKKKSGK WRLLQDLRAVNATMHDMGALQPGLP SPVAVPKGWEIIIDLQDCFFNIKLHPED CKRFAFSVPSPNFKRPYQRFQWKVLPQ GMKNSPTLCQKFVDKAILTVRDKYQD SYIVHYMDDILLAHPSRSIVDEILTSMI QALNKHGLVVSTEKIQKYDNLKYLGT HIQGDSVSYQKLQIRTDKLRTLNDFQK LLGNINWIRPFLKLTTGELKPLFEILNG DSNPISTRKLTPEACKALQLMNERLST ARVKRLDLSQPWSLCILKTEYTPTACL WQDGVVEWIHLPISPKVITPYDIFCTQ LIIKGRHRSKELFSKDPDYIVVPYTKVQ | IPR043502, SSF56672, IPR000477, PF00078, cd01645, PF06817, IPR010661 |

TABLE 30-continued

Exemplary monomeric retroviral reverse transcriptases and their RT domain signatures

| Name | Accession | Organism | Sequence | RT Signatures |
|---|---|---|---|---|
| | | | FDLLLQEKEDWPISLLGFLGEVHFHLP KDPLLTFTLQTAIIFPHMTSTTPLEKGIV IFTDGSANGRSVTYIQGREPIIKENTQN TAQQAEIVAVITAFEEVSQPFNLYTDSK YVTGLFPEIETATLSPRTKIYTELKHLQ RLIHKRQEKFYIGHIRGHTGLPGPLAQG NAYADSLTRILTALESAQESHALHHQN AALRFQFHITREQAREIVKLCPNCPD WGHAPQLGVNPRGLKPRVLWQMDVT HVSEFGKLKYVHVTVDTYSHFTFATA RTGEATKDVLQHLAQSFAYMGIPQKIK TDNAPAYVSRSIQEFLARWKISHVTGIP YNPQGQAIVERTHQNIKAQLNKLQKA GKYYTPHHLLAHALFVLNHVNMDNQ GHTAAERHWGPISADPKPMVMWKDL LTGSWKGPDVLITAGRGYACVFPQDA ETPIWVPDRFIRPPFTERKEATPTPGTAE KTPPRDEKDQQESPKNESSPHQREDGL ATSAGVDLRSGGGP (SEQ ID NO: 1548) | |
| POL_MLVMS - residues only | P03355 | Moloney murine leukemia virus | MGQTVTTPLSLTLGHWKDVERIAHNQ SVDVKKRRWVTFCSAEWPTFNVGWP RDGTFNRDLITQVKIKVFSPGPHGHPD QVPYIVTWEALAFDPPPWVKPFVHPKP PPPLPPSAPSLPEPPRSTPPRSSLYPALT PSLGAKPKPQVLSDSGGPLIDLLTEDPP PYRDPRPPPSDRDGNGGEATPAGEAPD PSPMASRLRGRREPPVADSTTSQAFPL RAGGNGQLQYWPFSSSDLYNWKNNN PSFSEDPGKLTALIESVLITHQPTWDDC QQLLGTLLTGEEKQRVLLEARKAVRG DDGRPTQLPNEVDAAFPLERPDWDYT TQAGRNHLVHYRQLLLAGLQNAGRSP TNLAKVKGITQGPNESPSAFLERLKEA YRRYTPYDPEDPGQETNVSMSFIWQSA PDIGRKLERLEDLKNKTLGDLVREAEK IFNKRETPEEREERIRRETEEKEERRRTE DEQKEKERDRRRHREMSKLLATVVSG QKQDRQGGERRRSQLDRDQCAYCKE KGHWAKDCPKKPRGPRGPRPQTSLLT LDDQGGQGQEPPPEPRITLKVGGQPVT FLVDTGAQHSVLTQNPGPLSDKSAWV QGATGGKRYRWTTDRKVHLATGKVT HSFLHVPDCPYPLLGRDLLTKLKAQIH FEGSGAQVMGPMGQPLQVLTLNIEDE HRLHETSKEPDVSLGSTWLSDFPQAW AETGGMGLAVRQAPLIIPLKATSTPVSI KQYPMSQEARLGIKPHIQRLLDQGILV PCQSPWNTPLLPVKKPGTNDYRPVQD LREVNKRVEDIHPTVPNPYNLLSGLPPS HQWYTVLDLKDAFFCLRLHPTSQPLFA FEWRDPEMGISGQLTWTRLPQGFKNSP TLFDEALHRDLADFRIQHPDLILLQYV DDLLLAATSELDCQQGTRALLQTLGN LGYRASAKKAQICQKQVKYLGYLLKE GQRWLTEARKETVMGQPTPKTPRQLR EFLGTAGFCRLWIPGFAEMAAPLYPLT KTGTLFNWGPDQQKAYQEIKQALLTA PALGLPDLTKPFELFVDEKQGYAKGVL TQKLGPWRRPVAYLSKKLDPVAAGWP PCLRMVAAIAVLTKDAGKLTMGQPLV ILAPHAVEALVKQPPDRWLSNARMTH YQALLLDTDRVQFGPVVALNPATLLPL PEEGLQHNCLDILAEAHGTRPDLTDQP LPDADHTWYTDGSSLLQEGQRKAGAA VTTETEVIWAKALPAGTSAQRAELIAL TQALKMAEGKKLNVYTDSRYAFATA HIHGEIYRRRGLLTSEGKEIKNKDEILA LLKALFLPKRLSIIHCPGHQKGHSAEAR GNRMADQAARKAAITETPDTSTLLIEN SSPYTSEHFHYTVTDIKDLTKLGAIYDK TKKYWVYQGKPVMPDQFTFELLDFLH QLTHLSFSKMKALLERSHSPYYMLNR | IPR043502, SSF56672, IPR000477, PF00078, cd03715 |

TABLE 30-continued

Exemplary monomeric retroviral reverse transcriptases and their RT domain signatures

| Name | Accession | Organism | Sequence | RT Signatures |
|---|---|---|---|---|
| | | | DRTLKNITETCKACAQVNASKSAVKQ GTRVRGHRPGTHWEIDFTEIKPGLYGY KYLLVFIDTFSGWIEAFPTKKETAKVV TKKLLEEIFPRFGMPQVLGTDNGPAFV SKVSQTVADLLGIDWKLHCAYRPQSS GQVERMNRTIKETLTKLTLATGSRDW VLLLPLALYRARNTPGPHGLTPYEILY GAPPPLVNFPDPDMTRVTNSPSLQAHL QALYLVQHEVWRPLAAAYQEQLDRP VVPHPYRVGDTVWVRRHQTKNLEPR WKGPYTVLLTTPTALKVDGIAAWIHA AHVKAADPGGGPSSRLTWRVQRSQNP LKIRLTREAP (SEQ ID NO: 1549) | |
| POL_HTL1A - residues only | P03362 | Human T-cell leukemia virus 1 | MGQIFSRSASPIPRPPRGLAAHHWLNFL QAAYRLEPGPSSYDFHQLKKFLKIALE TPARICPINYSLLASLLPKGYPGRVNEIL HILIQTQAQIPSRPAPPPPSSPTHDPPDS DPQIPPPYVEPTAPQVLPVMHPHGAPP NHRPWQMKDLQAIKQEVSQAAPGSPQ FMQTIRLAVQQFDPTAKDLQDLLQYL CSSLVASLHHQQLDSLISEAETRGITGY NPLAGPLRVQANNPQQQGLRREYQQL WLAAFAALPGSAKDPSWASILQGLEEP YHAFVERLNIALDNGLPEGTPKDPILRS LAYSNANKECQKLLQARGHTNSPLGD MLRACQTWTPKDKTKVLVVQPKKPPP NQPCFRCGKAGHWSRDCTQPRPPPGP CPLCQDPTHWKRDCPRLKPTIPEPEPEE DALLLDLPADIPHPKNLHRGGGLTSPP TLQQVLPNQDPASILPVIPLDPARRPVI KAQVDTQTSHPKTIEALLDTGADMTV LPIALFSSNTPLKNTSVLGAGGQTQDH FKLTSLPVLIRLPFRTTPIVLTSCLVDTK NNWAIIGRDALQQCQGVLYLPEAKRPP VILPIQAPAVLGLEHLPRPPQISQFPLNP ERLQALQHLVRKALEAGHIEPYTGPGN NPVFPVKKANGTWRFIHDLRATNSLTI DLSSSSPGPPDLSSLPTTLAHLQTIDLRD AFFQIPLPKQFQPYFAFTVPQQCNYGP GTRYAWKVLPQGFKNSPTLFEMQLAH ILQPIRQAFPQCTILQYMDDILLASPSHE DLLLLSEATMASLISHGLPVSENKTQQ TPGTIKFLGQIISPNHLTYDAVPTVPIRS RWALPELQALLGEIQWVSKGTPTLRQP LHSLYCALQRHTDPRDQIYLNPSQVQS LVQLRQALSQNCRSRLVQTLPLLGAIM LTLTGTTTVVFQSKEQWPLVWLHAPL PHTSQCPWGQLLASAVLLLDKYTLQS YGLLCQTIHHNISTQTFNQFIQTSDHPS VPILLHHSHRFKNLGAQTGELWNTFLK TAAPLAPVKALMPVFTLSPVIINTAPCL FSDGSTSRAAYILWDKQILSQRSFPLPP PHKSAQRAELLGLLHGLSSARSWRCL NIFLDSKYLYHYLRTLALGTFQGRSSQ APFQALLPRLLSRKVVYLHHVRSHTNL PDPISRLNALTDALLITPVLQLSPAELHS FTHCGQTALTLQGATTTEASNILRSCH ACRGGNPQHQMPRGHIRRGLLPNHIW QGDITHFKYKNTLYRLHVWVDTFSGAI SATQKRKETSSEAISSLLQAIAHLGKPS YINTDNGPAYISQDFLNMCTSLAIRHTT HVPYNPTSSGLVERSNGILKTLLYKYF TDKPDLPMDNALSIALWTINHLNVLTN CHKTRWQLHHSPRLQPIPETRSLSNKQ THWYYFKLPGLNSRQWKGPQEALQEA AGAALIPVSASSAQWIPWRLLKRAACP RPVGGPADPKEKDLQHHG (SEQ ID NO: 1550) | IPR043502, SSF56672, IPR000477, PF00078 |
| POL_FOAMV - residues only | P14350 | Human spumaretrovirus | MNPLQLLQPLPAEIKGTKLLAHWDSG ATITCIPESFLEDEQPIKKTLIKTIHGEK QQNVYYVTFKVKGRKVEAEVIASPYE YILLSPTDVPWLTQQPLQLTILVPLQEY | IPR043502, SSF56672, IPR000477, PF00078 |

TABLE 30-continued

Exemplary monomeric retroviral reverse transcriptases and their RT domain signatures

| Name | Accession | Organism | Sequence | RT Signatures |
|---|---|---|---|---|
| | | | QEKILSKTALPEDQKQQLKTLFVKYDN LWQHWENQVGHRKIRPHNIATGDYPP RPQKQYPINPKAKPSIQIVIDDLLKQGV LTPQNSTMNTPVYPVPKPDGRWRMVL DYREVNKTIPLTAAQNQHSAGILATIV RQKYKTTLDLANGFWAHPITPESYWL TAFTWQGKQYCWTRLPQGFLNSPALF TADVVDLLKEIPNVQVYVDDIYLSHDD PKEHVQQLEKVFQILLQAGYVVSLKKS EIGQKTVEFLGFNITKEGRGLTDTFKTK LLNITPPKDLKQLQSILGLLNFARNFIPN FAELVQPLYNLIASAKGKYIEWSEENT KQLNMVIEALNTASNLEERLPEQRLVI KVNTSPSAGYVRYYNETGKKPIMYLN YVFSKAELKFSMLEKLLTTMHKALIKA MDLAMGQEILVYSPIVSMTKIQKTPLP ERKALPIRWITWMTYLEDPRIQFHYDK TLPELKHIPDVYTSSQSPVKHPSQYEGV FYTDGSAIKSPDPTKSNNAGMGIVHAT YKPEYQVLNQWSIPLGNHTAQMAEIA AVEFACKKALKIPGPVLVITDSFYVAES ANKELPYWKSNGFVNNKKKPLKHISK WKSIAECLSMKPDITIQHEKGISLQIPVF ILKGNALADKLATQGSYVVNCNTKKP NLDAELDQLLQGHYIKGYPKQYTYFL EDGKVKVSRPEGVKIIPPQSDRQKIVLQ AHNLAHTGREATLLKIANLYWWPNM RKDVVKQLGRCQQCLITNASNKASGPI LRPDRPQKPFDKFFIDYIGPLPPSQGYL YVLVVVDGMTGFTWLYPTKAPSTSAT VKSLNVLTSIAIPKVIHSDQGAAFTSST FAEWAKERGIHLEFSTPYHPQSGSKVE RKNSDIKRLLTKLLVGRPTKWYDLLPV VQLALNNTYSPVLKYTPHQLLFGIDSN TPFANQDTLDLTREEELSLLQEIRTSLY HPSTPPASSRSWSPVVGQLVQERVARP ASLRPRWHKPSTVLKVLNPRTVVILDH LGNNRTVSIDNLKPTSHQNGTTNDTAT MDHLEKNE (SEQ ID NO: 1551) | |
| POL_BLVJ - residues only | P03361 | Bovine leukemia virus | MGNSPSYNPPAGISPSDWLNLLQSAQR LNPRPSPSDFTDLKNYIHWFHKTQKKP WTFTSGGPTSCPPGRFGRVPLVLATLN EVLSNEGGAPGASAPEEQPPPYDPPAIL PIISEGNRNRHRAWALRELQDIKKEIEN KAPGSQVWIQTLRLAILQADPTPADLE QLCQYIASPVDQTAHMTSLTAAIAAAE AANTLQGFNPKTGTLTQQSAQPNAGD LRSQYQNLWLQAGKNLPTRPSAPWSTI VQGPAESSVEFVNRLQISLADNLPDGV PKEPIIDSLSYANANRECQQILQGRGPV AAVGQKLQACAQWAPKNKQPALLVH TPGPKMPGPRQPAPKRPPPGPCYRCLK EGHWARDCPTKATGPPPGPCICKDPS HWKRDCPTLKSKNKLIEGGLSAPQTIT PITDSLSEAELECLLSIPLARSRPSVAVY LSGPWLQPSQNQALMLVDTGAENTVL PQNWLVRDYPRIPAAVLGAGGVSRNR YNWLQGPLTLALKPEGPFITIPKILVDT SDKWQILGRDVPSRLQASISIPEEVRPP VVGVLDTPPSHIGLEHLPPPPEVPQFPL NLERLQALQDLVHRSLEAGYISPWDGP GNNPVFPVRKPNGAWRFVHDLRATNA LTKPIPALSPGPPDLTAIPTHPPHIICLDL KDAFFQIPVEDRFRFYLSFTLPSPGGLQ PHRRFAWRVLPQGFINSPALFERALQE PLRQVSAAFSQSLLVSYMDDILYASPT EEQRSQCYQALAARLRDLGFQVASEK TSQTPSPVPFLGQMVHEQIVTYQSLPTL QISSPISLHQLQAVLGDLQWVSRGTPTT RRPLQLLYSSLKRHHDPRAIIQLSPEQL QGIAELRQALSHNARSRYNEQEPLLAY VHLTRAGSTLVLFQKGAQFPLAYFQTP LTDNQASPWGLLLLLGCQYLQTQALS | IPR043502, SSF56672, IPR000477, PF00078 |

TABLE 30-continued

Exemplary monomeric retroviral reverse transcriptases and their RT domain signatures

| Name | Accession | Organism | Sequence | RT Signatures |
|---|---|---|---|---|
| | | | SYAKPILKYYHNLPKTSLDNWIQSSED PRVQELLQLWPQISSQGIQPPGPWKTLI TRAEVFLTPQFSPDPIPAALCLFSDGAT GRGAYCLWKDHLLDFQAVPAPESAQK GELAGLLAGLAAAPPEPVNIWVDSKY LYSLLRTLVLGAWLQPDPVPSYALLYK SLLRHPAIVVGHVRSHSSASHPIASLNN YVDQLLPLETPEQWHKLTHCNSRALS RWPNPRISAWDPRSPATLCETCQKLNP TGGGKMRTIQRGWAPNHIWQADITHY KYKQFTYALHVFVDTYSGATHASAKR GLTTQTTIEGLLEAIVHLGRPKKLNTD QGANYTSKTFVRFCQQFGVSLSHHVP YNPTSSGLDERTNGLLKLLLSKYHLDE PHLPMTQALSRALWTHNQINLLPILKT RWELHHSPPLAVISEGGETPKGSDKLF LYLLPGQNNRRWLGPLPALVEASGGA LLATDPPVWVPWRLLKAFKCLKNDGP EDAHNRSSDG (SEQ ID NO: 1552) | |
| O41894_9RETR - residues only | O41894 | Bovine foamy virus | MPALRPLQVEIKGNHLKGYWDSGAEI TCVPAIYIIEEQPVGKKLITTIHNEKEHD VYYVEMKIEKRKVQCEVIATALDYVL VAPVDIPWYKPGPLELTIKIDVESQKHT LITESTLSPQGQMRLKKLLDQYQALW QCWENQVGHRRIEPHKIATGALKPRPQ KQYHINPRAKADIQIVIDDLLRQGVLR QQNSEMNTPVYPVPKADGRWRMVLD YREVNKVTPLVATQNCHSASILNTLYR GPYKSTLDLANGFWAHPIKPEDYWITA FTWGGKTYCWTVLPQGFLNSPALFTA DVVDILKDIPNVQVYVDDVYVSSATE QEHLDILETIFNRLSTAGYIVSLKKSKL AKETVEFLGFSISQNGRGLTDSYKQKL MDLQPPTTLRQLQSILGLINFARNFLPN FAELVAPLYQLIPKAKGQCIPWTMDHT TQLKTIIQALNSTENLEERRPDVDLIMK VHISNTAGYIRFYNHGGQKPIAYNNAL FTSTELKFTPTEKIMATIHKGLLKALDL SLGKEIHVYSAIASMTKLQKTPLSERK ALSIRWLKWQTYFEDPRIKFHHDATLP DLQNLPVPQQDTGKEMTILPLLHYEAI FYTDGSAIRSPKPNKTHSAGMGIIQAKF EPDFRIVHLWSFPLGDHTAQYAEIAAF EFAIRRATGIRGPVLIVTDSNYVAKSYN EELPYWESNGFVNNKKKTLKHISKWK AIAECKNLKADIHVIHEPGHQPAEASP HAQGNALADKQAVSGSYKVFSNELKP SLDAELEQVLSTGRPNPQGYPNKYEYK LVNGLCYVDRRGEEGLKIIPPKADRVK LCQLAHDGPGSAHLGRSALLLKLQQK YWWPRMHIDASRIVLNCTVCAQTNST NQKPRPPLVIPHDTKPFQVWYMDYIGP LPPSNGYQHALVIVDAGTGFTWIYPTK AQTANATVKALTHLTGTAVPKVLHSD QGPAFTSSILADWAKDRGIQLEHSAPY HPQSSGKVERKNSEIKRLLTKLLAGRP TKWYPLIPIVQLALNNTPNTRQKYTPH QLMYGADCNLPFENLDTLDLTREEQL AVLKEVRDGLLDYPSPSQTTARSWTP SPGLLVQERVARPAQLRPKWRKPTPIK KVLNERTVIIDHLGQDKVVSIDNLKPA AHQKLAQTPDSAEICPSATPCPPNTSL WYDLDTGTWTCQRCGYQCPDKYHQP QCTWSCEDRCGHRWKECGNCIPDGS SDDASAVAAVEI (SEQ ID NO: 1553) | IPR043502, SSF56672, IPR000477, PF00078 |
| POL_MLVBM - residues only | Q7SVK7 | Murine leukemia virus | MGQTVTTPLSLTLEHWGDVQRIASNQ SVGVKKRRWVTFCSAEWPTFGVGWP QDGTFNLDIILQVKSKVFSPGPHGHPD QVPYIVTWEAIAYEPPPWVKPFVSPKL SLSPTAPILPSGPSTQPPPRSALYPAFTP SIKPRPSKPQVLSDDGGPLIDLLTEDPPP YGEQGPSSPDGDGDREEATSTSEIPAPS | IPR043502, SSF56672, IPR000477, PF00078, cd03715 |

TABLE 30-continued

Exemplary monomeric retroviral reverse transcriptases and their RT domain signatures

| Name | Accession | Organism | Sequence | RT Signatures |
|------|-----------|----------|----------|---------------|
| | | | PMVSRLRGKRDPPAADSTTSRAFPLRL<br>GGNGQLQYWPFSSSDLYNWKNNNPSF<br>SEDPGKLTALIESVLTTHQPTWDDCQQ<br>LLGTLLTGEEKQRVLLEARKAVRGND<br>GRPTQLPNEVNSAFPLERPDWDYTTPE<br>GRNHLVLYRQLLLAGLQNAGRSPTNL<br>AKVKGITQGPNESPSAFLERLKEAYRR<br>YTPYDPEDPGQETNVSMSFIWQSAPAI<br>GRKLERLEDLKSKTLGDLVREAEKIFN<br>KRETPEEREERIRRETEEKEERRRAGDE<br>QREKERDRRRQREMSKLLATVVTGQR<br>QDRQGGERRRPQLDKDQCAYCKEKG<br>HWAKDCPKKPRGPRGPRPQTSLLTLD<br>DQGGQGQEPPPEPRITLTVGGQPVTFL<br>VDTGAQHSVLTQNPGPLSDRSAWVQG<br>ATGGKRYRWTTDRKVHLATGKVTHSF<br>LHVPDCPYPLLGRDLLTKLKAQIHFEG<br>SGAQVVGPKGQPLQVLTLGIEDEYRLH<br>ETSTEPDVSLGSTWLSDFPQAWAETGG<br>MGLAVRQAPLIIPLKATSTPVSIQQYPM<br>SHEARLGIKPHIQRLLDQGILVPCQSPW<br>NTPLLPVKKPGTNDYRPVQDLREVNK<br>RVEDIHPTVPNPYNLLSGLPPSHQWYT<br>VLDLKDAFFCLRLHPTSQPLFAFEWRD<br>PGMGISGQLTWTRLPQGFKNSPTLFDE<br>ALHRDLADFRIQHPDLILLQYVDDILLA<br>ATSELDCQQGTRALLQTLGDLGYRAS<br>AKKAQICQKQVKYLGYLLREGQRWLT<br>EARKETVMGQPVPKTPRQLREFLGTA<br>GFCRLWIPGFAEMAAPLYPLTKTGTLF<br>SWGPDQQKAYQEIKQALLTAPALGLP<br>DLTKPFELFVDEKQGYAKGVLTQKLG<br>PWRRPVAYLSKKLDPVAAGWPPCLRM<br>VAAIAVLTKDAGKLTMGQPLVILAPH<br>AVEALVKQPPDRWLSNARMTHYQAM<br>LLDTDRVQFGPVVALNPATLLPLPEEG<br>APHDCLEILAETHGTRPDLTDQPIPDAD<br>HTWYTDGSSFLQEGQRKAGAAVTTET<br>EVIWAGALPAGTSAQRAELIALTQALK<br>MAEGKRLNVYTDSRYAFATAHIHGEI<br>YRRRGLLTSEGREIKNKSEILALLKALF<br>LPKRLSIIHCLGHQKGDSAEARGNRLA<br>DQAAREAAIKTPPDTSTLLIEDSTPYTP<br>AYFHYTETDLKKLRDLGATYNQSKGY<br>WVFQGKPVMPDQFVFELLDSLHRLTH<br>LGYQKMKALLDRGESPYYMLNRDKT<br>LQYVADSCTVCAQVNASKAKIGAGVR<br>VRGHRPGTHWEIDFTEVKPGLYGYKY<br>LLVFVDTFSGWVEAFPTKRETARVVSK<br>KLLEEIFPRFGMPQVLGSDNGPAFTSQ<br>VSQSVADLLGIDWKLHCAYRPQSSGQ<br>VERINRTIKETLTKLTLAAGTRDWVLL<br>LPLALYRARNTPGPHGLTPYEILYGAPP<br>PLVNFHDPDMSELTNSPSLQAHLQALQ<br>TVQREIWKPLAEAYRDRLDQPVIPHPF<br>RIGDSVWVRRHQTKNLEPRWKGPYTV<br>LTTTPTALKVDGISAWIHAAHVKAATT<br>PPIKPSWRVQRSQNPLKIRLTRGAP<br>(SEQ ID NO: 2085) | |

TABLE 31

Exemplary dimeric retroviral reverse transcriptases and their RT domain signatures

| Name | Accession | Organism | Sequence | RT Signatures |
|------|-----------|----------|----------|---------------|
| Q83133_AVIMA | Q83133 | Avian myeloblastosis-associated virus type | RATVLTVALHLAIPLKWKPNHTPVWID<br>QWPLPEGKLVALTQLVEKELQLGHIEP<br>SLSCWNTPVFVIRKASGSYRLLHDLRA<br>VNAKLVPFGAVQQGAPVLSALPRGWP | IPR043502,<br>SSF56672,<br>IPR000477,<br>PF00078, |

TABLE 31-continued

Exemplary dimeric retroviral reverse transcriptases and their RT domain signatures

| Name | Accession | Organism | Sequence | RT Signatures |
|---|---|---|---|---|
| | | 1 | LMVLDLKDCFFSIPLAEQDREAFAFTLP SVNNQAPARRFQWKVLPQGMTCSPTI CQLIVGQILEPLRLKHPSLRMLHYMDD LLLAASSHDGLEAAGEEVISTLERAGF TISPDKVQREPGVQYLGYKLGSTYVAP VGLVAEPRIATLWDVQKLVGSLQSVR PALGIPPRLMGPFYEQLRGSDPNEARE WNLDMKMAWREIVQLSTTAALERWD PALPLEGAVARCEQGAIGVLGQGLSTH PRPCLWLFSTQPTKAFTAWLEVLTLLIT KLRASAVRTFGKEVDILLLPACFREDL PLPEGILLALRGFAGKIRSSDTPSIFDIA RPLHVSLKVRVTDHPVPGPTVFTDASS STHKGVVVWREGPRWEIKEIADLGAS VQQLEARAVAMALLLWPTTPTNVVTD SAFVAKMLLKMGQEGVPSTAAAFILE DALSQRSAMAAVLHVRSHSEVPGFFTE GNDVADSQATFQAYPLREAKDLHTAL HIGPRALSKACNISMQQAREVVQTCPH CNSAPALEAGVNPRGLGPLQIWQTDFT LEPRMAPRSWLAVTVDTASSAIVVTQ HGRVTSVAAQHHWATAIAVLGRPKAI KTDNGSCFTSKSTREWLARWGIAHTT GIPGNSQGQAMVERANRLLKDKIRVL AEGDGFMKRIPTSKQGELLAKAMYAL NHFERGENTKTPIQKHWRPTVLTEGPP VKIRIETGEWEKGWNVLVWGRGYAA VKNRDTDKVIWVPSRKVKPDITQKDE VTKKDEASPLFAGISDWAPWEGEQEG LQEETASNKQERPGEDTPAANES (SEQ ID NO: 1554) | cd01645, PF06817, IPR010661 |
| POL_SIVM1 | P05896 | Simian immunodeficiency virus | MGARNSVLSGKKADELEKIRLRPGGK KKYMLKHVVWAANELDRFGLAESLL ENKEGCQKILSVLAPLVPTGSENLKSL YNTVCVIWCIHAEEKVKHTEEAKQIVQ RHLVMETGTAETMPKTSRPTAPFSGRG GNYPVQQIGGNYTHLPLSPRTLNAWV KLIEEKKFGAEVVSGFQALSEGCLPYDI NQMLNCVGDHQAAMQIIRDIINEEAAD WDLQHPQQAPQQGQLREPSGSDIAGT TSTVEEQIQWMYRQQNPIPVGNIYRRW IQLGLQKCVRMYNPTNILDVKQGPKEP FQSYVDRFYKSLRAEQTDPAVKNWMT QTLLIQNANPDCKLVLKGLGTNPTLEE MLTACQGVGGPGQKARLMAEALKEA LAPAPIPFAAAQQKGPRKPIKCWNCGK EGHSARQCRAPRRQGCWKCGKMDHV MAKCPNRQAGFFRPWPLGKEAPQFPH GSSASGADANCSPRRTSCGSAKELHAL GQAAERKQREALQGGDRGFAAPQFSL WRRPVVTAHIEGQPVEVLLDTGADDSI VTGIELGPHYTPKIVGGIGGFINTKEYK NVEIEVLGKRIKGTIMTGDTPINIFGRN LLTALGMSLNLPIAKVEPVKSPLKPGK DGPKLKQWPLSKEKIVALREICEKMEK DGQLEEAPPTNPYNTPTFAIKKKDKNK WRMLIDFRELNRVTQDFTEVQLGIPHP AGLAKRKRITVLDIGDAYFSIPLDEEFR QYTAFTLPSVNNAEPGKRYIYKVLPQG WKGSPAIFQYTMRHVLEPFRKANPDV TLVQYMDDILIASDRTDLEHDRVVLQL KELLNSIGFSSPEEKFQKDPPFQWMGY ELWPTKWKLQKIELPQRETWTVNDIQ KLVGVLNWAAQIYPGIKTKHLCRLIRG KMTLTEEVQWTEMAEAEYEENKIILSQ EQEGCYYQESKPLEATVIKSQDNQWS YKIHQEDKILKVGKFAKIKNTHINGVR LLAHVIQKIGKEAIVIWGQVPKFHLPVE KDVWEQWWTDYWQVTWIPEWDFIST PPLVRLVFNLVKDPIEGEETYYVDGSC SKQSKEGKAGYITDRGKDKVKVLEQT TNQQAELEAFLMALTDSGPKANIIVDS QYVMGIITGCPTESESRLVNQIIEEMIK KTEIYVAWVPAHKGIGGNQEIDHLVSQ | IPR043502, SSF56672, IPR000477, PF00078, PF06817, IPR010661, PF06815, IPR010659 |

TABLE 31-continued

Exemplary dimeric retroviral reverse transcriptases and their RT domain signatures

| Name | Accession | Organism | Sequence | RT Signatures |
|---|---|---|---|---|
| | | | GIRQVLFLEKIEPAQEEHSKYHSNIKEL VFKFGLPRLVAKQIVDTCDKCHQKGE AIHGQVNSDLGTWQMDCTHLEGKIVI VAVHVASGFIEAEVIPQETGRQTALFLL KLASRWPITHLHTDNGANFASQEVKM VAWWAGIEHTFGVPYNPQSQGVVEA MNHHLKNQIDRIREQANSVETIVLMAV HCMNFKRRGGIGDMTPAERLINMITTE QEIQFQQSKNSKFKNFRVYYREGRDQL WKGPGELLWKGEGAVILKVGTDIKVV PRRKAKIIKDYGGGKEMDSSSHMEDT GEAREVA (SEQ ID NO: 1555) | |
| POL_RSVP | P03354 | Rous sarcoma virus | MEAVIKVISSACKTYCGKTSPSKKEIGA MLSLLQKEGLLMSPSDLYSPGSWDPIT AALSQRAMILGKSGELKTWGLVLGAL KAAREEQVTSEQAKFWLGLGGGRVSP PGPECIEKPATERRIDKGEEVGETTVQR DAKMAPEETATPKTVGTSCYHCGTAI GCNCATASAPPPPYVGSGLYPSLAGVG EQQGQGGDTPPGAEQSRAEPGHAGQA PGPALTDWARVREELASTGPPVVAMP VVIKTEGPAWTPLEPKLITRLADTVRT KGLRSPITMAEVEALMSSPLLPHDVTN LMRVILGPAPYALWMDAWGVQLQTVI AAATRDPRHPANGQGRGERTNLRLK GLADGMVGNPQGQAALLRPGELVAIT ASALQAFREVARLAEPAGPWADIMQG PSESFVDFANRLIKAVEGSDLPPSARAP VIIDCFRQKSQPDIQQLIRTAPSTLTTPG EIIKYVLDRQKTAPLTDQGIAAAMSSAI QPLIMAVVNRERDGQTGSGGRARGLC YTCGSPGHYQAQCPKKRKSGNSRERC QLCNGMGHNAKQCRKRDGNQGQRPG KGLSSGPWPGPEPPAVSLAMTMEHKD RPLVRVILTNTGSHPVKQRSVYITALLD SGADITIISEEDWPTDWPVMEAANPQI HGIGGGIPMRKSRDMIELGVINRDGSL ERPLLLFPAVAMVRGSILGRDCLQGLG LRLTNLIGRATVLTVALHLAIPLKWKP DHTPVWIDQWPLPEGKLVALTQLVEK ELQLGHIEPSLSCWNTPVFVIRKASGSY RLLHDLRAVNAKLVPFGAVQQGAPVL SALPRGWPLMVLDLKDCFFSIPLAEQD REAFAFTLPSVNNQAPARRFQWKVLP QGMTCSPTICQLVVGQVLEPLRLKHPS LCMLHYMDDLLLAASSHDGLEAAGEE VISTLERAGFTISPDKVQREPGVQYLGY KLGSTYVAPVGLVAEPRIATLWDVQK LVGSLQWLRPALGIPPRLMGPFYEQLR GSDPNEAREWNLDMKMAWREIVRLST TAALERWDPALPLEGAVARCEQGAIG VLGQGLSTHPRPCLWLFSTQPTKAFTA WLEVLTLLITKLRASAVRTFGKEVDIL LLPACFREDLPLPEGILLALKGFAGKIR SSDTPSIFDIARPLHVSLKVRVTDHPVP GPTVFTDASSSTHKGVVVWREGPRWE IKEIADLGASVQQLEARAVAMALLLW PTTPTNVVTDSAFVAKMLLKMGQEGV PSTAAAFILEDALSQRSAMAAVLHVRS HSEVPGFFTEGNDVADSQATFQAYPLR EAKDLHTALHIGPRALSKACNISMQQA REVVQTCPHCNSAPALEAGVNPRGLG PLQIWQTDFTLEPRMAPRSWLAVTVD TASSAIVVTQHGRVTSVAVQHHWATA IAVLGRPKAIKTDNGSCFTSKSTREWL ARWGIAHTTGIPGNSQGQAMVERANR LLKDRIRVLAEGDGFMKRIPTSKQGEL LAKAMYALNHFERGENTKTPIQKHWR PTVLTEGPPVKIRIETGEWEKGWNVLV WGRGYAAVKNRDTDKVIWVPSRKVK PDITQKDEVTKKDEASPLFAGISDWIP WEDEQEGLQGETASNKQERPGEDTLA ANES (SEQ ID NO: 1556) | IPR043502, SSF56672, IPR000477, PF00078, cd01645, PF06817, IPR010661 |

TABLE 31-continued

Exemplary dimeric retroviral reverse transcriptases and their RT domain signatures

| Name | Accession | Organism | Sequence | RT Signatures |
|---|---|---|---|---|
| POL_HV2D2 | P15833 | Human immunodeficiency virus type 2 | MGARGSVLSGKKTDELEKVRLRPGGK KKYMLKHVVWAVNELDRFGLAESLL ESKEGCQKILKVLAPLVPTGSENLKSLF NIVCVIFCLHAEEKVKDTEEAKKIAQR HLAADTEKMPATNKPTAPPSGGNYPV QQLAGNYVHLPLSPRTLNAWVKLVEE KKFGAEVVPGFQALSEGCTPYDINQML NCVGEHQAAMQIIREIINEEAADWDQQ HPSPGPMPAGQLRDPRGSDIAGTTSTV EEQIQWMYRAQNPVPVGNIYRRWIQL GLQKCVRMYNPTNILDIKQGPKEPFQS YVDRFYKSLRAEQTDPAVKNWMTQT LLIQNANPDCKLVLKGLGMNPTLEEM LTACQGIGGPGQKARLMAEALKEALT PAPIPFAAVQQKAGKRGTVTCWNCGK QGHTARQCRAPRRQGCWKCGKTGHI MSKCPERQAGFLRVRTLGKEASQLPH DPSASGSDTICTPDEPSRGHDTSGGDTI CAPCRSSSGDAEKLHADGETTEREPRE TLQGGDRGFAAPQFSLWRRPVVKACIE GQSVEVLLDTGVDDSIVAGIELGSNYT PKIVGGIGGFINTKEYKDVEIEVVGKRV RATIMTGDTPINIFGRNILNTLGMTLNF PVAKVEPVKVELKPGKDGPKIRQWPLS REKILALKEICEKMEKEGQLEEAPPTNP YNTPTFAIKKKDKNKWRMLIDFRELN KVTQDFTEVNWVFPTRQVAEKRRITVI DVGDAYFSIPLDPNFRQYTAFTLPSVN NAEPGKRYIYKVLPQGWKGSQSICQYS MRKVLDPFRKANSDVIIIQYMDDILIAS DRSDLEHDRVVSQLKELLNDMGFSTPE EKFQKDPPPKWMGYELWPKKWKLQK IQLPEKEVWTVNAIQKLVGVLNWAAQ LFPGIKTRHICKLIRGKMTLTEEVQWTE LAEAELQENKIILEQEQEGSYYKERVPL EATVQKNLANQWTYKIHQGNKVLKV GKYAKVKNTHTNGVRLLAHVVQKIG KEALVIWGEIPVFHLPVERETWDQWW TDYWQVTWIPEWDFVSTPPLIRLAYNL VKDPLEGRETYYTDGSCNRTSKEGKA GYVTDRGKDKVKVLEQTTNQQAELEA FALALTDSEPQVNIIVDSQYVMGIIAAQ PTETESPIVAKIIEEMIKKEAVYVGWVP AHKGLGGNQEVDHLVSQGIRQVLFLE KIEPAQEEHEKYHGNVKELVHKFGIPQ LVAKQIVNSCDKCQQKGEAIHGQVNA DLGTWQMDCTHLEGKIIIVAVHVASGF IEAEVIPQETGRQTALFLLKLASRWPIT HLHTDNGANFTSPSVKMVAWWVGIE QTFGVPYNPQSQGVVEAMNHHLKNQI DRLRDQAVSIETVVLMATHCMNFKRR GGIGDMTPAERLVNMITTEQEIQFFQA KNLKFQNFQVYYREGRDQLWKGPGEL LWKGEGAVIIKVGTEIKVVPRRKAKIIR HYGGGKGLDCSADMEDTRQAREMAQ SD (SEQ ID NO: 1557) | IPR043502, SSF56672, IPR000477, PF00078, PF06817, IPR010661, PF06815, IPR010659 |
| POL_HV1A2 | P03369 | Human immunodeficiency virus type 1 | MGARASVLSGGELDKWEKIRLRPGGK KKYKLKHIVWASRELERFAVNPGLLET SEGCRQILGQLQPSLQTGSEELRSLYNT VATLYCVHQRIDVKDTKEALEKIEEEQ NKSKKKAQQAAAAAGTGNSSQVSQN YPIVQNLQGQMVHQAISPRTLNAWVK VVEEKAFSPEVIPMFSALSEGATPQDL NTMLNTVGGHQAAMQMLKETINEEA AEWDRVHPVHAGPIAPGQMREPRGSD IAGTTSTLQEQIGWMTNNPPIPVGEIYK RWIILGLNKIVRMYSPTSILDIRQGPKEP FRDYVDRFYKTLRAEQASQDVKNWM TETLLVQNANPDCKTILKALGPAATLE EMMTACQGVGGPGHKARVLAEAMSQ VTNPANIMMQRGNFRNQRKTVKCFNC GKEGHIAKNCRAPRKKGCWRCGREGH QMKDCTERQANFLREDLAFLQGKARE FSSEQTRANSPTRRELQVWGGENNSLS | IPR043502, SSF56672, IPR000477, PF00078, cd01645, PF06817, IPR010661, PF06815, IPR010659 |

TABLE 31-continued

Exemplary dimeric retroviral reverse transcriptases and their RT domain signatures

| Name | Accession | Organism | Sequence | RT Signatures |
|---|---|---|---|---|
| | | | EAGADRQGTVSFNFPQITLWQRPLVTI RIGGQLKEALLDTGADDTVLEEMNLP GKWKPKMIGGIGGFIKVRQYDQIPVEI CGHKAIGTVLVGPTPVNIIGRNLLTQIG CTLNFPISPIETVPVKLKPGMDGPKVKQ WPLTEEKIKALVEICTEMEKEGKISKIG PENPYNTPVFAIKKKDSTKWRLVDFR ELNKRTQDFWEVQLGIPHPAGLKKKK SVTVLDVGDAYFSVPLDKDFRKYTAF TIPSINNETPGIRYQYNVLPQGWKGSPA IFQSSMTKILEPFRKQNPDIVIYQYMDD LYVGSDLEIGQHRTKIEELRQHLLRWG FTTPDKKHQKEPPFLWMGYELHPDKW TVQPIMLPEKDSWTVNDIQKLVGKLN WASQIYAGIKVKQLCKLLRGTKALTE VIPLTEEAELELAENREILKEPVHEVYY DPSKDLVAEIQKQGQGQWTYQIYQEPF KNLKTGKYARMRGAHTNDVKQLTEA VQKVSTESIVIWGKIPKFKLPIQKETWE AWWMEYWQATWIPEWEFVNTPPLVK LWYQLEKEPIVGAETFYVDGAANRET KLGKAGYVTDRGRQKVVSIADTTNQK TELQAIHLALQDSGLEVNIVTDSQYAL GIIQAQPDKSESELVSQIIEQLIKKEKVY LAWVPAHKGIGGNEQVDKLVSAGIRK VLFLNGIDKAQEEHEKYHSNWRAMAS DFNLPPVVAKEIVASCDKCQLKGEAM HGQVDCSPGIWQLDCTHLEGKIILVAV HVASGYIEAEVIPAETGQETAYFLLKL AGRWPVKTIHTDNGSNFTSTTVKAAC WWAGIKQEFGIPYNPQSQGVVESMNN ELKKIIGQVRDQAEHLKTAVQMAVFIH NFKRKGGIGGYSAGERIVDIIATDIQTK ELQKQITKIQNFRVYYRDNKDPLWKG PAKLLWKGEGAVVIQDNSDIKVVPRR KAKIIRDYGKQMAGDDCVASRQDED (SEQ ID NO: 1558) | |
| POL_FIVPE | P16088 | Feline immunodeficiency virus | KEFGKLEGGASCSPSESNAASSNAICTS NGGETIGFVNYNKVGTTTTLEKRPEILI FVNGYPIKFLLDTGADITILNRRDFQVK NSIENGRQNMIGVGGGKRGTNYINVH LEIRDENYKTQCIFGNVCVLEDNSLIQP LLGRDNMIKFNIRLVMAQISDKIPVVK VKMKDPNKGPQIKQWPLTNEKIEALTE IVERLEKEGKVKRADSNNPWNTPVFAI KKKSGKWRMLIDFRELNKLTEKGAEV QLGLPHPAGLQIKKQVTVLDIGDAYFT IPLDPDYAPYTAFTLPRKNNAGPGRRF VWCSLPQGWILSPLIYQSTLDNIIQPFIR QNPQLDIYQYMDDIYIGSNLSKKEHKE KVEELRKLLLWWGFETPEDKLQEEPP YTWMGYELHPLTWTIQQKQLDIPEQPT LNELQKLAGKINWASQAIPDLSIKALT NMMRGNQNLNSTRQWTKEARLEVQK AKKAIEEQVQLGYYDPSKELYAKLSLV GPHQISYQVYQKDPEKILWYGKMSRQ KKKAENTCDIALRACYKIREESIIRIGK EPRYEIPTSREAWESNLINSPYLKAPPP EVEYIHAALNIKRALSMIKDAPIPGAET WYIDGGRKLGKAAKAAYWTDTGKW RVMDLEGSNQKAEIQALLLALKAGSE EMNIITDSQYVINIILQQPDMMEGIWQE VLEELEKKTAIFIDWVPGHKGIPGNEE VDKLCQTMMIIEGDGILDKRSEDAGYD LLAAKEIHLLPGEVKVIPTGVKMLPK GYWGLIIGKSSIGSKGLDVLGGVIDEG YRGEIGVIMINVSRKSITLMERQKIAQL IILPCKHEVLEQGKVVMDSERGDNGY GSTGVFSSWVDRIEEAEINHEKFHSDP QYLRTEFNLPKMVAEEIRRKCPVCRIIG EQVGGQLKIGPGIWQMDCTHFDGKIIL VGIHVESGYIWAQIISQETADCTVKAV LQLLSAHNVTELQTDNGPNFKNQKME GVLNYMGVKHKFGIPGNPQSQALVEN | IPR043502, SSF56672, IPR000477, PF00078, PF06817, IPR010661, PF06815, IPR010659 |

TABLE 31-continued

Exemplary dimeric retroviral reverse transcriptases and their RT domain signatures

| Name | Accession | Organism | Sequence | RT Signatures |
|---|---|---|---|---|
| | | | VNHTLKVWIQKFLPETTSLDNALSLAV HSLNFKRRGRIGGMAPYELLAQQESLR IQDYFSAIPQKLQAQWIYYKDQKDKK WKGPMRVEYWGQGSVLLKDEEKGYF LIPRRHIRRVPEPCALPEGDE (SEQ ID NO: 1559) | |
| POL_EIAVY | P03371 | Equine infectious anemia virus | TAWTFLKAMQKCSKKREARGSREAPE TNFPDTTEESAQQICCTRDSSDSKSVPR SERNKKGIQCQGEGSSRGSQPGQFVGV TYNLEKRPTTIVLINDTPLNVLLDTGAD TSVLTTAHYNRLKYRGRKYQGTGIIGV GGNVETFSTPVTIKKKGRHIKTRMLVA DIPVTILGRDILQDLGAKLVLAQLSKEI KFRKIELKEGTMGPKIPQWPLTKEKLE GAKETVQRLLSEGKISEASDNNPYNSPI FVIKKRSGKWRLLQDLRELNKTVQVG TEISRGLPHPGGLIKCKHMTVLDIGDA YFTIPLDPEFRPYTAFTIPSINHQEPDKR YVWKCLPQGFVLSPYIYQKTLQEILQP FRERYPEVQLYQYMDDLFVGSNGSKK QHKELIIELRAILQKGFETPDDKLQEVP PYSWLGYQLCPENWKVQKMQLDMVK NPTLNDVQKLMGNITWMSSGVPGLTV KHIAATTKGCLELNQKVIWTEEAQKEL EENNEKIKNAQGLQYYNPEEEMLCEV EITKNYEATYVIKQSQGILWAGKKIMK ANKGWSTVKNLMLLLQHVATESITRV GKCPTFKVPFTKEQVMWEMQKGWYY SWLPEIVYTHQVVHDDWRMKLVEEPT SGITIYTDGGKQNGEGIAAYVTSNGRT KQKRLGPVTHQVAERMAIQMALEDTR DKQVNIVTDSYYCWKNITEGLGLEGP QNPWWPIIQNIREKEIVYFAWVPGHKG IYGNQLADEAAKIKEEIMLAYQGTQIK EKRDEDAGFDLCVPYDIMIPVSDTKIIP TDVKIQVPPNSFGWVTGKSSMAKQGL LINGGIIDEGYTGEIQVICTNIGKSNIKLI EGQKFAQLIILQHHSNSRQPWDENKIS QRGDKGFGSTGVFWVENIQEAQDEHE NWHTSPKILARNYKIPLTVAKQITQECP HCTKQGSGPAGCVMRSPNHWQADCT HLDNKIILHFVESNSGYIHATLLSKENA LCTSLAILEWARLFSPKSLHTDNGTNF VAEPVVNLLKFLKIAHTTGIPYHPESQG IVERANRTLKEKIQSHRDNTQTLEAAL QLALITCNKGRESMGGQTPWEVFITNQ AQVIHEKLLLQQAQSSKKFCFYKIPGE HDWKGPTRVLWKGDGAVVVNDEGK GIIAVPLTRTKLLIKPN (SEQ ID NO: 1560) | IPR043502, SSF56672, IPR000477, PF00078, PF06817, IPR010661, PF06815, IPR010659 |
| POL_BIV29 | P19560 | Bovine immunodeficiency virus | MKRRELEKKLRKVRVTPQQDKYYTIG NLQWAIRMINLMGIKCVCDEECSAAE VALIITQFSALDLENSPIRGKEEVAIKNT LKVFWSLLAGYKPESTETALGYWEAF TYREREARADKEGEIKSIYPSLTQNTQ NKKQTSNQTNTQSLPAITTQDGTPRFD PDLMKQLKIWSDATERNGVDLHAVNI LGVITANLVQEEIKLLLNSTPKWRLDV QLIESKVREKENAHRTWKQHHPEAPK TDEIIGKGLSSAEQATLISVECRETFRQ WVLQAAMEVAQAKHATPGPINIHQGP KEPYTDFINRLVAALEGMAAPETTKEY LLQHLSIDHANEDCQSILRPLGPNTPME KKLEACRVVGSQKSKMQFLVAAMKE MGIQSPIPAVLPHTPEAYASQTSGPEDG RRCYGCGKTGHLKRNCKQQKCYHCG KPGHQARNCRSKNREVLLCPLWAEEP TTEQFSPEQHEFCDPICTPSYIRLDKQPF IKVFIGGRWVKGLVDTGADEVVLKNI HWDRIKGYPGTPIKQIGVNGVNVAKR KTHVEWRFKDKTGIIDVLFSDTPVNLF GRSLLRSIVTCFTLLVHTEKIEPLPVKV RGPGPKVPQWPLTKEKYQALKEIVKD | IPR043502, SSF56672, IPR000477, PF00078, PF06817, IPR010661 |

TABLE 31-continued

Exemplary dimeric retroviral reverse transcriptases and their RT domain signatures

| Name | Accession | Organism | Sequence | RT Signatures |
|---|---|---|---|---|
| | | | LLAEGKISEAAWDNPYNTPVFVIKKKG TGRWRMLMDFRELNKITVKGQEFSTG LPYPPGIKECEHLTAIDIKDAYFTIPLHE DFRPFTAFSVVPVNREGPIERFQWNVL PQGWVCSPAIYQTTTQKIIENIKKSHPD VMLYQYMDDLLIGSNRDDHKQIVQEI RDKLGSYGFKTPDEKVQEERVKWIGF ELTPKKWRFQPRQLKIKNPLTVNELQQ LVGNCVWVQPEVKIPLYPLTDLLRDKT NLQEKIQLTPEAIKCVEEFNLKLKDPE WKDRIREGAELVIKIQMVPRGIVEDLL QDGNPIWGGVKGLNYDHSNKIKKILRT MNELNRTVVIMTGREASFLLPGSSEDW EAALQKEESLTQIFPVKFYRHSCRWTSI CGPVRENLTTYYTDGGKKGKTAAAVY WCEGRTKSKVFPGTNQQAELKAICMA LLDGPPKMNIITDSRYAYEGMREEPET WAREGIWLEIAKILPFKQYVGVGWVP AHKGIGGNTEADEGVKKALEQMAPCS PPEAILLKPGEKQNLETGIYMQGLRPQS FLPRADLPVAITGTMVDSELQLQLLNI GTEHIRIQKDEVFMTCFLENIPSATEDH ERWHTSPDILVRQFHLPKRIAKEIVARC QECKRTTTSPVRGTNPRGRFLWQMDN THWNKTIIWVAVETNSGLVEAQVIPEE TALQVALCILQLIQRYTVLHLHSDNGP CFTAHRIENLCKYLGITKTTGIPYNPQS QGVVERAHRDLKDRLAAYQGDCETV EAALSLALVSLNKKRGGIGGHTPYEIY LESEHTKYQDQLEQQFSKQKIEKWCY VRNRRKEWKGPYKVLWDGDGAAVIE EEGKTALYPHRHMRFIPPPDSDIQDGSS (SEQ ID NO: 1561) | |
| A0A142BKH1_ALV | A0A142BKH1 | Avian leukosis and sarcoma virus | TVALHLAIPLKWKPDHTPVWIDQWPL PEGKLVALTQLVEKELQLGHIEPSLSC WNTPVFVIRKASGSYRLLHDLRAVNA KLVPFGAVQQGAPVLSALPRGWPLMV LDLKDCFFSIPLAEQDREAFAFTLPSVN NQAPARRFQWKVLPQGMTCSPTICQL VVGQVLEPLRLKHPSLRMLHYMDDLL LAASSHDGLEAAGEEVISTLERAGFTIS PDKIQREPGVQYLGYKLGSTYVAPVGL VAEPRIATLWDVQKLVGSLQWLRPAL GIPPRLMGPFYEQLRGSDPNEAREWNL DMKMAWREIVQLSTTAALERWDPALP LEGAVARCEQGAIGVLGQGLSTHPRPC LWLFSTQPTKAFTAWLEVLTLLITKLR ASAVRTFGKEVDVLLLPACFREDLPLP EGILLALRGFAGKIRSSDTPSIFDIARPL HVSLKVRVTDHPVPGPTVFTDASSSTH KGVVVWREGPRWEIKEIADLGASVQQ LEARAVAMALLLWPTTPTNVVTDSAF VAKMLLKMGQEGVPSTAAAFILEDAL SQRSAMAAVLHVRSHSEVPGFFTEGN DVADSQATFQAYPLREAKDLHTALHI GPRALSKACNISMQQAREVVQTCPHC NSAPALEAGVNPRGLGPLQIWQTDFTL EPRMAPRSWLAVTVATASSAIVVTQH GRVTSVAARHHWATAIAVLGRPKAIK TDNGSCFTSKSTREWLARWGIAHTTGI PGNSQGQAMVERANRLLKDKIRVLAE GDGFMKRIPTGKQGELLAKAMYALNH FERGENTKTPIQKHWRPTVLTEGPPVKI RIETGEWEKGWNVLVWGRGYAAVKN RDTDKIIWVPSRKVKPDITQKDELTKK DEASPLFAGISDWAPWKGEQEGL (SEQ ID NO: 1562) | IPR043502, SSF56672, IPR000477, PF00078, cd01645, PF06817, IPR010661 |

TABLE 32

InterPro descriptions of signatures present in reverse transcriptases in Table 30 (monomeric viral RTs) and Table 31 (dimeric viral RTs).

| Signature | Database | Short Name | Description |
| --- | --- | --- | --- |
| cd01645 | CDD | RT_Rtv | RT_Rtv: Reverse transcriptases (RTs) from retroviruses (Rtvs). RTs catalyze the conversion of single-stranded RNA into double-stranded viral DNA for integration into host chromosomes. Proteins in this subfamily contain long terminal repeats (LTRs) and are multifunctional enzymes with RNA-directed DNA polymerase, DNA directed DNA polymerase, and ribonuclease hybrid (RNase H) activities. The viral RNA genome enters the cytoplasm as part of a nucleoprotein complex, and the process of reverse transcription generates in the cytoplasm forming a linear DNA duplex via an intricate series of steps. This duplex DNA is colinear with its RNA template, but contains terminal duplications known as LTRs that are not present in viral RNA. It has been proposed that two specialized template switches, known as strand-transfer reactions or "jumps", are required to generate the LTRs. [PMID: 9831551, PMID: 15107837, PMID: 11080630, PMID: 10799511, PMID: 7523679, PMID: 7540934, PMID: 8648598, PMID: 1698615] |
| cd03715 | CDD | RT_ZFREV_like | RT_ZFREV_like: A subfamily of reverse transcriptases (RTs) found in sequences similar to the intact endogenous retrovirus ZFERV from zebrafish and to Moloney murine leukemia virus RT. An RT gene is usually indicative of a mobile element such as a retrotransposon or retrovirus. RTs occur in a variety of mobile elements, including retrotransposons, retroviruses, group II introns, bacterial msDNAs, hepadnaviruses, and caulimoviruses. These elements can be divided into two major groups. One group contains retroviruses and DNA viruses whose propagation involves an RNA intermediate. They are grouped together with transposable elements containing long terminal repeats (LTRs). The other group, also called poly(A)-type retrotransposons, contain fungal mitochondrial introns and transposable elements that lack LTRs. Phylogenetic analysis suggests that ZFERV belongs to a distinct group of retroviruses. [PMID: 14694121, PMID: 2410413, PMID: 9684890, PMID: 10669612, PMID: 1698615, PMID: 8828137] |
| PF00078 | Pfam | RVT_1 | A reverse transcriptase gene is usually indicative of a mobile element such as a retrotransposon or retrovirus. Reverse transcriptases occur in a variety of mobile elements, including retrotransposons, retroviruses, group II introns, bacterial msDNAs, hepadnaviruses, and caulimoviruses. [PMID: 1698615] |
| IPR000477 | InterPro | RT_dom | The use of an RNA template to produce DNA, for integration into the host genome and exploitation of a host cell, is a strategy employed in the replication of retroid elements, such as the retroviruses and bacterial retrons. The enzyme catalysing polymerisation is an RNA-directed DNA-polymerase, or reverse trancriptase (RT) (2.7.7.49). Reverse transcriptase occurs in a variety of mobile elements, including retrotransposons, retroviruses, group II introns [PMID: 12758069], bacterial msDNAs, hepadnaviruses, and caulimoviruses. Retroviral reverse transcriptase is synthesised as part of the POL polyprotein that contains; an aspartyl protease, a reverse transcriptase, RNase H and integrase. POL polyprotein undergoes specific enzymatic cleavage to yield the mature proteins. The discovery of |

TABLE 32-continued

InterPro descriptions of signatures present in reverse transcriptases in Table 30 (monomeric viral RTs) and Table 31 (dimeric viral RTs).

| Signature | Database | Short Name | Description |
|---|---|---|---|
| | | | retroelements in the prokaryotes raises intriguing questions concerning their roles in bacteria and the origin and evolution of reverse transcriptases and whether the bacterial reverse transcriptases are older than eukaryotic reverse transcriptases [PMID: 8828137]. Several crystal structures of the reverse transcriptase (RT) domain have been determined [PMID: 1377403]. |
| IPR043502 | InterPro | DNA/RNA polymerase superfamily | This entry represents the DNA/RNA polymerase superfamily, which includes DNA polymerase I, reverse transcriptase, T7 RNA polymerase, lesion bypass DNA polymerase (Y-family), RNA-dependent RNA-polymerase and dsRNA phage RNA-dependent RNA-polymerase. These enzymes share a similar protein fold at their active site, which resembles the palm subdomain of the right-hand-shaped polymerases. [PMID: 26931141] |
| SSF56672 | Superfamily | DNA/RNA polymerases | This superfamily comprises DNA polymerases and RNA polymerases |
| PF06817 | Pfam | RVT_thumb | This domain is known as the thumb domain. It is composed of a four helix bundle [PMID: 1377403]. |
| IPR010661 | InterPro | RVT_thumb | This domain is known as the thumb domain. It is composed of a four helix bundle. Reverse transcriptase converts the viral RNA genome into double-stranded viral DNA. Reverse transcriptase often occurs in a polyprotein; with integrase, ribonuclease H and/or protease, which is cleaved before the enzyme takes action. The impact of antiretroviral treatment on the first 400 amino acids of HIV reverse transcriptase is good. Little is known, however, of the antiretroviral drug impact on the C-terminal domains of Pol, which includes the thumb, connection and RNase H. Evidence suggests that these might be well conserved domains. [PMID: 1377403, PMID: 18335052] |
| PF06815 | Pfam | RVT_connect | This domain is known as the connection domain. This domain lies between the thumb and palm domains [PMID: 1377403]. |
| IPR010659 | InterPro | RVT_connect | This domain is known as the connection domain. This domain lies between the thumb and palm domains [PMID: 1377403]. |
| cd03715 | CDD | RT_ZFREV_like | RT_ZFREV_like: A subfamily of reverse transcriptases (RTs) found in sequences similar to the intact endogenous retrovirus ZFERV from zebrafish and to Moloney murine leukemia virus RT. An RT gene is usually indicative of a mobile element such as a retrotransposon or retrovirus. RTs occur in a variety of mobile elements, including retrotransposons, retroviruses, group II introns, bacterial msDNAs, hepadnaviruses, and caulimoviruses. These elements can be divided into two major groups. One group contains retroviruses and DNA viruses whose propagation involves an RNA intermediate. They are grouped together with transposable elements containing long terminal repeats (LTRs). The other group, also called poly(A)-type retrotransposons, contain fungal mitochondrial introns and transposable elements that lack LTRs. Phylogenetic analysis suggests that ZFERV belongs to a distinct group of retroviruses. [PMID: 14694121, PMID: 2410413, PMID: 9684890, PMID: 10669612, PMID: 1698615, PMID: 8828137] |

Endonuclease Domain:

In some embodiments, the polypeptide comprises an endonuclease domain (e.g., a heterologous endonuclease domain). In certain embodiments, the endonuclease/DNA binding domain of an APE-type retrotransposon, the endonuclease domain of an RLE-type retrotransposon, or the endonuclease domain of a PLE-type retrotransposon can be used or can be modified (e.g., by insertion, deletion, or substitution of one or more residues) in a Gene Writer system described herein. In some embodiments the endonuclease domain or endonuclease/DNA binding domain is altered from its natural sequence to have altered codon usage, e.g. improved for human cells. In some embodiments the endonuclease element is a heterologous endonuclease element, such as Fok1 nuclease, Cas9, Cas9 nickase, a type-II restriction enzyme like endonuclease (RLE-type nuclease), or another RLE-type endonuclease (also known as REL). In some embodiments, the heterologous endonuclease domain cleaves both DNA strands and forms double-stranded breaks. In some embodiments, the heterologous endonuclease activity has nickase activity and does not form double stranded breaks. The amino acid sequence of an endonuclease domain of a Gene Writer system described herein may be at least about 50%, at least about 60%, at least about 70%, at least about 80%, at least about 85%, at least about 90%, at least about 95%, at least about 96%, at least about 97%, at least about 98%, at least about 99% identical to the amino acid sequence of an endonuclease domain of a retrotransposon whose DNA sequence is referenced in Table X, Z1, 72, 3A, or 3B. Endounclease domains can be identified, for example, based upon homology to other known endonuclease domains using tools as Basic Local Alignment Search Tool (BLAST). In certain embodiments, the heterologous endonuclease is Cas9 or Cas9 nickase or a functional fragment thereof. In certain embodiments, the heterologous endonuclease is Fok1 or a functional fragment thereof. In certain embodiments, the heterologous endonuclease is a Holliday junction resolvase or homolog thereof, such as the Holliday junction resolving enzyme from *Sulfolobus solfataricus*—Ssol Hje (Govindaraju et al., *Nucleic Acids Research* 44:7, 2016). In certain embodiments, the heterologous endonuclease is the endonuclease of the large fragment of a spliceosomal protein, such as Prp8 (Mahbub et al., *Mobile DNA* 8:16, 2017). For example, a Gene Writer polypeptide described herein may comprise a reverse transcriptase domain from an APE-, RLE-, or PLE-type retrotransposon and an endonuclease domain that comprises Fok1 or a functional fragment thereof. In still other embodiments, homologous endonuclease domains are modified, for example by site-specific mutation, to alter DNA endonuclease activity. In still other embodiments, endonuclease domains are modified to remove any latent DNA-sequence specificity.

In some embodiments, a Gene Writer polypeptide possesses the function of DNA target site cleavage via an endonuclease domain. In some embodiments, the endonuclease domain is also a DNA-binding domain. In some embodiments, the endonuclease domain is also a template nucleic acid (e.g., template RNA) binding domain. For example, in some embodiments a polypeptide comprises a CRISPR-associated endonuclease domain that binds a template RNA comprising a gRNA, binds a target DNA sequence (e.g., with complementarity to a portion of the gRNA), and cuts the target DNA sequence. In certain embodiments, the endonuclease/DNA binding domain of an APE-type retrotransposon or the endonuclease domain of an RLE-type retrotransposon can be used or can be modified (e.g., by insertion, deletion, or substitution of one or more residues) in a Gene Writer system described herein. In some embodiments the endonuclease domain or endonuclease/DNA binding domain is altered from its natural sequence to have altered codon usage, e.g. improved for human cells. In some embodiments the endonuclease element is a heterologous endonuclease element, such as Fok1 nuclease, a type-II restriction 1-like endonuclease (RLE-type nuclease), or another RLE-type endonuclease (also known as REL). In some embodiments the heterologous endonuclease activity has nickase activity and does not form double stranded breaks. The amino acid sequence of an endonuclease domain of a Gene Writer system described herein may be at least about 50%, at least about 60%, at least about 70%, at least about 80%, at least about 85%, at least about 90%, at least about 95%, at least about 96%, at least about 97%, at least about 98%, at least about 99% identical to the amino acid sequence of an endonuclease domain of a retrotransposon whose DNA sequence is referenced in Table 1, 2, 3A, or 3B. Endonuclease domains can be identified, for example, based upon homology to other known endonuclease domains using tools such as Basic Local Alignment Search Tool (BLAST). In certain embodiments, the heterologous endonuclease is Fok1 or a functional fragment thereof. In certain embodiments, the heterologous endonuclease is a Holliday junction resolvase or homolog thereof, such as the Holliday junction resolving enzyme from *Sulfolobus solfataricus*—Ssol Hje (Govindaraju et al., *Nucleic Acids Research* 44:7, 2016). In certain embodiments, the heterologous endonuclease is the endonuclease of the large fragment of a spliceosomal protein, such as Prp8 (Mahbub et al., *Mobile DNA* 8:16, 2017). In certain embodiments, the heterologous endonuclease is derived from a CRISPR-associated protein, e.g., Cas9. In certain embodiments, the heterologous endonuclease is engineered to have only ssDNA cleavage activity, e.g., only nickase activity, e.g., be a Cas9 nickase. For example, a Gene Writer polypeptide described herein may comprise a reverse transcriptase domain from an APE- or RLE-type retrotransposon and an endonuclease domain that comprises Fok1 or a functional fragment thereof. In still other embodiments, homologous endonuclease domains are modified, for example by site-specific mutation, to alter DNA endonuclease activity. In still other embodiments, endonuclease domains are modified to remove any latent DNA-sequence specificity.

In some embodiments the endonuclease domain has nickase activity and does not form double stranded breaks. In some embodiments, the endonuclease domain forms single stranded breaks at a higher frequency than double stranded breaks, e.g., at least 90%, 95%, 96%, 97%, 98%, or 99% of the breaks are single stranded breaks, or less than 10%, 5%, 4%, 3%, 2%, or 1% of the breaks are double stranded breaks. In some embodiments, the endonuclease forms substantially no double stranded breaks. In some embodiments, the exonuclease does not form detectable levels of double stranded breaks.

In some embodiments, the endonuclease domain has nickase activity that nicks the target site DNA of the to-be-edited strand; e.g., in some embodiments, the endonuclease domain cuts the genomic DNA of the target site near to the site of alteration on the strand that will be extended by the writing domain. In some embodiments, the endonuclease domain has nickase activity that nicks the target site DNA of the to-be-edited strand and does not nick the target site DNA of the non-edited strand. For example, when a polypeptide comprises a CRISPR-associated endonuclease domain having nickase activity and that does not form double stranded breaks, in some embodiments said CRISPR-associated endonuclease domain nicks the target site DNA strand containing the PAM site (e.g., and does not nick the target site DNA strand that does not contain the PAM site).

In some other embodiments, the endonuclease domain has nickase activity that nicks the target site DNA of the to-be-edited strand and the non-edited strand. Without wishing to be bound by theory, after a writing domain (e.g., RT domain) of a polypeptide described herein polymerizes (e.g., reverse transcribes) from the heterologous object sequence of a template nucleic acid (e.g., template RNA), the cellular DNA repair machinery must repair the nick on the to-be-edited DNA strand. The target site DNA now contains two different sequences for the to-be-edited DNA strand: one corresponding to the original genomic DNA and a second corresponding to that polymerized from the heterologous object sequence. It is thought that the two different sequences equilibrate with one another, first one hybridizing the non-edited strand, then the other, and which the cellular DNA repair apparatus incorporates into its repaired target site is thought to be random. Without wishing to be bound by theory, introducing an additional nick to the non-edited strand may bias the cellular DNA repair machinery to adopt the heterologous object sequence-based sequence more frequently than the original genomic sequence. In some embodiments, the additional nick is positioned at least 10, 15, 20, 25, 30, 35, 40, 45, 50, 55, 60, 65, 70, 75, 80, 85, 90, 95, 100, 105, 110, 115, 120, 125, 130, 135, 140, 145, or 150 nucleotides 5' or 3' of the target site modification (e.g., the insertion, deletion, or substitution) or to the nick on the to-be-edited strand.

Alternatively or additionally, without wishing to be bound by theory, an additional nick to the non-edited strand may promote second strand synthesis. In some embodiments, where the Gene Writer has inserted or substituted a portion of the edited strand, synthesis of a new sequence corresponding to the insertion/substitution in the non-edited strand is necessary.

In some embodiments, the polypeptide comprises a single domain having endonuclease activity (e.g., a single endonuclease domain) and said domain nicks both the to-be-edited strand and the non-edited strand. For example, in such an embodiment the endonuclease domain may be a CRISPR-associated endonuclease domain, and the template nucleic acid (e.g., template RNA) comprises a gRNA that directs nicking of the to-be-edited strand and an additional gRNA that directs nicking of the non-edited strand. In some embodiments, the polypeptide comprises a plurality of domains having endonuclease activity, and a first endonuclease domain nicks the to-be-edited strand and a second endonuclease domain nicks the non-edited strand (optionally, the first endonuclease domain does not (e.g., cannot) nick the non-edited strand and the second endonuclease domain does not (e.g., cannot) nick the to-be-edited strand).

In some embodiments, the endonuclease domain is capable of nicking a first strand and a second strand. In some embodiments, the first and second strand nicks occur at the same position in the target site but on opposite strands. In some embodiments, the second strand nick occurs in a staggered location, e.g., upstream or downstream, from the first nick. In some embodiments, the endonuclease domain generates a target site deletion if the second strand nick is upstream of the first strand nick. In some embodiments, the endonuclease domain generates a target site duplication if the second strand nick is downstream of the first strand nick. In some embodiments, the endonuclease domain generates no duplication and/or deletion if the first and second strand nicks occur in the same position of the target site (e.g., as described in Gladyshev and Arkhipova Gene 2009, incorporated by reference herein in its entirety). In some embodiments, the endonuclease domain has altered activity depending on protein conformation or RNA-binding status, e.g., which promotes the nicking of the first or second strand (e.g., as described in Christensen et al. PNAS 2006; incorporated by reference herein in its entirety).

In some embodiments, the endonuclease domain comprises a meganuclease, or a functional fragment thereof. In some embodiments, the endonuclease domain comprises a homing endonuclease, or a functional fragment thereof. In some embodiments, the endonuclease domain comprises a meganuclease from the LAGLIDADG (SEQ ID NO: 1563), GIY-YIG, HNH, His-Cys Box, or PD-(D/E) XK families, or a functional fragment or variant thereof, e.g., which possess conserved amino acid motifs, e.g., as indicated in the family names. In some embodiments, the endonuclease domain comprises a meganuclease, or fragment thereof, chosen from, e.g., I-SmaMI (Uniprot F7WD42), I-Scel (Uniprot P03882), I-AniI (Uniprot P03880), I-DmoI (Uniprot P21505), I-CreI (Uniprot P05725), I-TevI (Uniprot P13299), I-OnuI (Uniprot Q4VWW5), or I-BmoI (Uniprot Q9ANR6). In some embodiments, the meganuclease is naturally monomeric, e.g., I-ScelI, I-TevI, or dimeric, e.g., I-CreI, in its functional form. For example, the LAGLIDADG (SEQ ID NO: 1563) meganucleases with a single copy of the LAGLIDADG motif (SEQ ID NO: 1563) generally form homodimers, whereas members with two copies of the LAGLIDADG motif (SEQ ID NO: 1563) are generally found as monomers. In some embodiments, a meganuclease that normally forms as a dimer is expressed as a fusion, e.g., the two subunits are expressed as a single ORF and, optionally, connected by a linker, e.g., an I-CreI dimer fusion (Rodriguez-Fornes et al. Gene Therapy 2020; incorporated by reference herein in its entirety). In some embodiments, a meganuclease, or a functional fragment thereof, is altered to favor nickase activity for one strand of a double-stranded DNA molecule, e.g., I-Scel (K122I and/or K223I) (Niu et al. J Mol Biol 2008), I-AniI (K227M) (McConnell Smith et al. PNAS 2009), I-DmoI (Q42A and/or K120M) (Molina et al. J Biol Chem 2015). In some embodiments, a meganuclease or functional fragment thereof possessing this preference for single-strand cleavage is used as an endonuclease domain, e.g., with nickase activity. In some embodiments, an endonuclease domain comprises a meganuclease, or a functional fragment thereof, which naturally targets or is engineered to target a safe harbor site, e.g., an I-CreI targeting SH6 site (Rodriguez-Fornes et al., supra). In some embodiments, an endonuclease domain comprises a meganuclease, or a functional fragment thereof, with a sequence tolerant catalytic domain, e.g., I-Tev recognizing the minimal motif CNNNG (Kleinstiver et al. PNAS 2012). In some embodiments, a target sequence tolerant catalytic domain is fused to a DNA binding domain, e.g., to direct activity, e.g., by fusing I-TevI to: (i) zinc fingers to create Tev-ZFEs (Kleinstiver et al. PNAS 2012), (ii) other meganucleases to create MegaTevs (Wolfs et al. Nucleic Acids Res 2014), and/or (iii) Cas9 to create TevCas9 (Wolfs et al. PNAS 2016).

In some embodiments, the endonuclease domain comprises a restriction enzyme, e.g., a Type IIS or Type IIP restriction enzyme. In some embodiments, the endonuclease domain comprises a Type IIS restriction enzyme, e.g., FokI, or a fragment or variant thereof. In some embodiments, the endonuclease domain comprises a Type IIP restriction enzyme, e.g., PvuII, or a fragment or variant thereof. In some embodiments, a dimeric restriction enzyme is expressed as a fusion such that it functions as a single chain, e.g., a FokI dimer fusion (Minczuk et al. Nucleic Acids Res 36(12):3926-3938 (2008)).

The use of additional endonuclease domains is described, for example, in Guha and Edgell Int J Mol Sci 18(22):2565 (2017), which is incorporated herein by reference in its entirety.

In some embodiments, an endonuclease domain or DNA binding domain (e.g., as described herein) comprises a *Streptococcus pyogenes* Cas9 (SpCas9) or a functional fragment or variant thereof. In some embodiments, the endonuclease domain or DNA binding domain comprises a modified SpCas9. In embodiments, the modified SpCas9 comprises a modification that alters protospacer-adjacent motif (PAM) specificity. In embodiments, the PAM has specificity for the nucleic acid sequence 5'-NGT-3'. In embodiments, the modified SpCas9 comprises one or more amino acid substitutions, e.g., at one or more of positions L1111, D1135, G1218, E1219, A1322, of R1335, e.g., selected from L1111R, D1135V, G1218R, E1219F, A1322R, R1335V. In embodiments, the modified SpCas9 comprises the amino acid substitution T1337R and one or more additional amino acid substitutions, e.g., selected from L1111, D1135L, S1136R, G1218S, E1219V, D1332A, D1332S, D1332T, D1332V, D1332L, D1332K, D1332R, R1335Q, T1337, T1337L, T1337Q, T1337I, T1337V, T1337F, T1337S, T1337N, T1337K, T1337H, T1337Q, and T1337M, or corresponding amino acid substitutions thereto. In embodiments, the modified SpCas9 comprises: (i) one or more amino acid substitutions selected from D1135L, S1136R, G1218S, E1219V, A1322R, R1335Q, and T1337; and (ii) one or more amino acid substitutions selected from L1111R, G1218R, E1219F, D1332A, D1332S, D1332T, D1332V, D1332L, D1332K, D1332R, T1337L, T1337I, T1337V, T1337F, T1337S, T1337N, T1337K, T1337R, T1337H, T1337Q, and T1337M, or corresponding amino acid substitutions thereto.

In some embodiments, an endonuclease domain or DNA binding domain (e.g., as described herein) comprises a Cas domain, e.g., a Cas9 domain. In embodiments, the endonuclease domain or DNA binding domain comprises a nuclease-active Cas domain, a Cas nickase (nCas) domain, or a nuclease-inactive Cas (dCas) domain. In embodiments, the endonuclease domain or DNA binding domain comprises a nuclease-active Cas9 domain, a Cas9 nickase (nCas9) domain, or a nuclease-inactive Cas9 (dCas9) domain. In some embodiments, the endonuclease domain or DNA binding domain comprises a Cas9 domain of Cas9 (e.g., dCas9 and nCas9), Cas12a/Cpf1, Cas12b/C2c1, Cas12c/C2c3, Cas12d/CasY, Cas12e/CasX, Cas12g, Cas12h, or Cas12i. In some embodiments, the endonuclease domain or DNA binding domain comprises a Cas9 (e.g., dCas9 and nCas9), Cas12a/Cpf1, Cas12b/C2c1, Cas12c/C2c3, Cas12d/CasY, Cas12e/CasX, Cas12g, Cas12h, or Cas12i. In some embodiments, the endonuclease domain or DNA binding domain comprises an *S. pyogenes* or an *S. thermophilus* Cas9, or a functional fragment thereof. In some embodiments, the endonuclease domain or DNA binding domain comprises a Cas9 sequence, e.g., as described in Chylinski, Rhun, and Charpentier (2013) RNA Biology 10:5, 726-737; incorporated herein by reference. In some embodiments, the endonuclease domain or DNA binding domain comprises the HNH nuclease subdomain and/or the RuvC1 subdomain of a Cas, e.g., Cas9, e.g., as described herein, or a variant thereof. In some embodiments, the endonuclease domain or DNA binding domain comprises Cas12a/Cpf1, Cas12b/ C2c1, Cas12c/C2c3, Cas12d/CasY, Cas12e/CasX, Cas12g, Cas12h, or Cas12i. In some embodiments, the endonuclease domain or DNA binding domain comprises a Cas polypeptide (e.g., enzyme), or a functional fragment thereof. In embodiments, the Cas polypeptide (e.g., enzyme) is selected from Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (e.g., Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, Cpf1, Cas12b/C2c1, Cas12c/C2c3, Cas12b/ C2c1, Cas12c/C2c3, SpCas9(K855A), eSpCas9(1.1), SpCas9-HF1, hyper accurate Cas9 variant (HypaCas9), homologues thereof, modified or engineered versions thereof, and/or functional fragments thereof. In embodiments, the Cas9 comprises one or more substiutions, e.g., selected from H840A, D10A, P475A, W476A, N477A, D1125A, W1126A, and D1127A. In embodiments, the Cas9 comprises one or more mutations at positions selected from: D10, G12, G17, E762, H840, N854, N863, H982, H983, A984, D986, and/or A987, e.g., one or more substitutions selected from D10A, G12A, G17A, E762A, H840A, N854A, N863A, H982A, H983A, A984A, and/or D986A. In some embodiments, the endonuclease domain or DNA binding domain comprises a Cas (e.g., Cas9) sequence from *Corynebacterium ulcerans*, *Corynebacterium diphtheria*, *Spiroplasma syrphidicola*, *Prevotella intermedia*, *Spiroplasma taiwanense*, *Streptococcus iniac*, *Belliella baltica*, *Psychroflexus torquis*, *Streptococcus thermophilus*, *Listeria innocua*, *Campylobacter jejuni*, *Neisseria meningitidis*, *Streptococcus pyogenes*, or *Staphylococcus aureus*, or a fragment or variant thereof.

In some embodiments, an endonuclease domain or DNA binding domain (e.g., as described herein) comprises a Cpf1 domain, e.g., comprising one or more substitutions, e.g., at position D917, E1006A, D1255 or any combination thereof, e.g., selected from D917A, E1006A, D1255A, D917A/ E1006A, D917A/D1255A, E1006A/D1255A, and D917A/ E1006A/D1255A.

In some embodiments, an endonuclease domain or DNA binding domain (e.g., as described herein) comprises spCas9, spCas9-VRQR, spCas9-VRER, xCas9 (sp), saCas9, saCas9-KKH, spCas9-MQKSER, spCas9-LRKIQK, or spCas9-LRVSQL.

In some embodiments, an endonuclease domain or DNA binding domain (e.g., as described herein) comprises an amino acid sequence as listed in Table 37 below, or an amino acid sequence having at least 80%, 85%, 90%, 95%, 96%, 97%, 98%, or 99% sequence identity thereto. In some embodiments, the endonuclease domain or DNA-binding domain comprises an amino acid sequence that has no more than 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 differences (e.g., mutations) relative to any of the amino acid sequences described herein.

TABLE 37

Each of the Reference Sequences are incorporated by reference in their entirety.

| Name | Amino Acid Sequence or Reference Sequence |
|---|---|
| Streptococcus pyogenes Cas9 | |
| Exemplary Linker | SGSETPGTSESATPES (SEQ ID NO: 1023) |
| Exemplary Linker Motif | (SGGS)$_n$ (SEQ ID NO: 1569) |
| Exemplary Linker Motif | (GGGS)$_n$ (SEQ ID NO: 1570) |
| Exemplary Linker Motif | (GGGGS)$_n$ (SEQ ID NO: 1535) |
| Exemplary Linker Motif | (G)$_n$ |
| Exemplary Linker Motif | (EAAAK)$_n$ (SEQ ID NO: 1534) |
| Exemplary Linker Motif | (GGS)$_n$ |
| Exemplary Linker Motif | (XP)$_n$ |
| Cas9 from Streptococcus pyogenes | NCBI Reference Sequence: NC_002737.2 and Uniprot Reference Sequence: Q99ZW2 |
| Cas9 from Corynebacterium ulcerans | NCBI Refs: NC_015683.1, NC_017317.1 |
| Cas9 from Corynebacterium diphtheria | NCBI Refs: NC_016782.1, NC_016786.1 |
| Cas9 from Spiroplasma syrphidicola | NCBI Ref: NC_021284.1 |
| Cas9 from Prevotella intermedia | NCBI Ref: NC_017861.1 |
| Cas9 from Spiroplasma taiwanense | NCBI Ref: NC_021846.1 |
| Cas9 from Streptococcus iniae | NCBI Ref: NC_021314.1 |
| Cas9 from Belliella baltica | NCBI Ref: NC_018010.1 |
| Cas9 from Psychroflexus torquisI | NCBI Ref: NC_018721.1 |
| Cas9 from Streptococcus thermophilus | NCBI Ref: YP_820832.1 |
| Cas9 from Listeria innocua | NCBI Ref: NP_472073.1 |
| Cas9 from Campylobacter jejuni | NCBI Ref: YP_002344900.1 |
| Cas9 from Neisseria meningitidis | NCBI Ref: YP_002342100.1 |
| dCas9 (D10A and H840A) | |
| Catalytically inactive Cas9 (dCas9) | |
| Cas9 nickase (nCas9) | |
| Catalytically active Cas9 | |
| CasY | ((ncbi.nlm.nih.gov/protein/APG80656.1) >APG80656.1 CRISPR-associated protein CasY [uncultured Parcubacteria group bacterium]) |
| CasX | uniprot.org/uniprot/F0NN87; uniprot.org/uniprot/F0NH53 |
| CasX | >tr\|F0NH53\|F0NH53_SULIR CRISPR associated protein, Casx OS = Sulfolobus islandicus (strain REY15A) GN = SiRe_0771 PE = 4 SV = 1 |

TABLE 37-continued

Each of the Reference Sequences are incorporated by reference in their entirety.

| Name | Amino Acid Sequence or Reference Sequence |
|---|---|
| Deltaproteobacteria CasX | |
| Cas12b/C2c1 | ((uniprot.org/uniprot/T0D7A2#2) sp\|T0D7A2\|C2C1_ALIAG CRISPR-associated endonuclease C2c1 OS = *Alicyclobacillus acido-terrestris* (strain ATCC 49025/DSM 3922/CIP 106132/ NCIMB 13137/GD3B) GN = c2c1 PE = 1 SV = 1) |
| BhCas12b (*Bacillus hisashii*) | NCBI Reference Sequence: WP_095142515 |
| BvCas12b (*Bacillus* sp. V3-13) | NCBI Reference Sequence: WP_101661451.1 |
| Wild-type *Francisella novicida* Cpf1 | |
| *Francisella novicida* Cpf1 D917A | |
| *Francisella novicida* Cpf1 E1006A | |
| *Francisella novicida* Cpf1 D1255A | |
| *Francisella novicida* Cpf1 D917A/E1006A | |
| *Francisella novicida* Cpf1 D917A/D1255A | |
| *Francisella novicida* Cpf1 E1006A/D1255A | |
| *Francisella novicida* Cpf1 D917A/E1006A | |
| SaCas9 | |
| SaCas9n | |
| PAM-binding SpCas9 | |
| PAM-binding SpCas9n | |
| PAM-binding SpEQR Cas9 | |
| PAM-binding SpVQR Cas9 | |
| PAM-binding SpVRER Cas9 | |
| PAM-binding SpVRQR Cas9 | |
| SpyMacCas9 | |

In some embodiments, a Gene Writing polypeptide has an endonuclease domain comprising a Cas9 nickase, e.g., Cas9 H840A. In embodiments, the Cas9 H840A has the following amino acid sequence:

Cas9 nickase (H840A):
(SEQ ID NO: 1571)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

-continued

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

```
-continued
LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDAIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD
```

In some embodiments, a Gene Writing polypeptide comprises the RT domain from a retroviral reverse transcriptase, e.g., a wild-type M-MLV RT, e.g., comprising the following retroviral reverse transcriptase, e.g., an M-MLV RT, e.g., comprising the following sequence:

```
M-MLV (WT):
                                  (SEQ ID NO: 1572)
TLNIEDEYRLHETSKEPDVSLGSTWLSDFPQAWAETGGMGLAVRQAPLII

PLKATSTPVSIKQYPMSQEARLGIKPHIQRLLDQGILVPCQSPWNTPLLP

VKKPGTNDYRPVQDLREVNKRVEDIHPTVPNPYNLLSGLPPSHQWYTVLD

LKDAFFCLRLHPTSQPLFAFEWRDPEMGISGQLTWTRLPQGFKNSPTLFD

EALHRDLADFRIQHPDLILLQYVDDLLLAATSELDCQQGTRALLQTLGNL

GYRASAKKAQICQKQVKYLGYLLKEGQRWLTEARKETVMGQPTPKTPRQL

REFLGTAGFCRLWIPGFAEMAAPLYPLTKTGTLFNWGPDQQKAYQEIKQA

LLTAPALGLPDLTKPFELFVDEKQGYAKGVLTQKLGPWRRPVAYLSKKLD

PVAAGWPPCLRMVAAIAVLTKDAGKLTMGQPLVILAPHAVEALVKQPPDR

WLSNARMTHYQALLLDTDRVQFGPVVALNPATLLPLPEEGLQHNCLDILA

EAHGTRPDLTDQPLPDADHTWYTDGSSLLQEGQRKAGAAVTTETEVIWAK

ALPAGTSAQRAELIALTQALKMAEGKKLNVYTDSRYAFATAHIHGEIYRR

RGLLTSEGKEIKNKDEILALLKALFLPKRLSIIHCPGHQKGHSAEARGNR

MADQAARKAAITETPDTSTLLI
```

In some embodiments, a Gene Writing polypeptide comprises the RT domain from a retroviral reverse transcriptase, e.g., an M-MLV RT, e.g., comprising the following sequence:

```
                                  (SEQ ID NO: 1573)
TLNIEDEHRLHETSKEPDVSLGSTWLSDFPQAWAETGGMGLAVRQAPLII

PLKATSTPVSIKQYPMSQEARLGIKPHIQRLLDQGILVPCQSPWNTPLLP

VKKPGTNDYRPVQDLREVNKRVEDIHPTVPNPYNLLSGLPPSHQWYTVLD

LKDAFFCLRLHPTSQPLFAFEWRDPEMGISGQLTWTRLPQGFKNSPTLFD

EALHRDLADFRIQHPDLILLQYVDDLLLAATSELDCQQGTRALLQTLGNL

GYRASAKKAQICQKQVKYLGYLLKEGQRWLTEARKETVMGQPTPKTPRQL

REFLGTAGFCRLWIPGFAEMAAPLYPLTKTGTLFNWGPDQQKAYQEIKQA

LLTAPALGLPDLTKPFELFVDEKQGYAKGVLTQKLGPWRRPVAYLSKKLD

PVAAGWPPCLRMVAAIAVLTKDAGKLTMGQPLVILAPHAVEALVKQPPDR

WLSNARMTHYQALLLDTDRVQFGPVVALNPATLLPLPEEGLQHNCLDILA

EAHGTRPDLTDQPLPDADHTWYTDGSSLLQEGQRKAGAAVTTETEVIWAK

ALPAGTSAQRAELIALTQALKMAEGKKLNVYTDSRYAFATAHIHGEIYRR

RGLLTSEGKEIKNKDEILALLKALFLPKRLSIIHCPGHQKGHSAEARGNR

MADQAARKAAITETPDTSTLL
```

In some embodiments, a Gene Writing polypeptide comprises the RT domain from a retroviral reverse transcriptase comprising the sequence of amino acids 659-1329 of NP_057933. In embodiments, the Gene Writing polypeptide further comprises one additional amino acid at the N-terminus of the sequence of amino acids 659-1329 of NP_057933, e.g., as shown below:

```
                                  (SEQ ID NO: 1574)
TLNIEDEHRLHETSKEPDVSLGSTWLSDFPQAWAETGGMGLAVRQAPLII

PLKATSTPVSIKQYPMSQEARLGIKPHIQRLLDQGILVPCQSPWNTPLLP

VKKPGTNDYRPVQDLREVNKRVEDIHPTVPNPYNLLSGLPPSHQWYTVLD

LKDAFFCLRLHPTSQPLFAFEWRDPEMGISGQLTWTRLPQGFKNSPTLFD

EALHRDLADFRIQHPDLILLQYVDDLLLAATSELDCQQGTRALLQTLGNL

GYRASAKKAQICQKQVKYLGYLLKEGQRWLTEARKETVMGQPTPKTPRQL

REFLGTAGFCRLWIPGFAEMAAPLYPLTKTGTLFNWGPDQQKAYQEIKQA

LLTAPALGLPDLTKPFELFVDEKQGYAKGVLTQKLGPWRRPVAYLSKKLD

PVAAGWPPCLRMVAAIAVLTKDAGKLTMGQPLVILAPHAVEALVKQPPDR

WLSNARMTHYQALLLDTDRVQFGPVVALNPATLLPLPEEGLQHNCLDILA

EAHGTRPDLTDQPLPDADHTWYTDGSSLLQEGQRKAGAAVTTETEVIWAK

ALPAGTSAQRAELIALTQALKMAEGKKLNVYTDSRYAFATAHIHGEIYRR

RGLLTSEGKEIKNKDEILALLKALFLPKRLSIIHCPGHQKGHSAEARGNR

MADQAARKAA
Core RT (bold), annotated per above
RNAseH (underlined), annotated per above
```

In embodiments, the Gene Writing polypeptide further comprises one additional amino acid at the C-terminus of the sequence of amino acids 659-1329 of NP_057933. In embodiments, the Gene Writing polypeptide comprises an RNaseH1 domain (e.g., amino acids 1178-1318 of NP_057933).

In some embodiments, a retroviral reverse transcriptase domain, e.g., M-MLV RT, may comprise one or more mutations from a wild-type sequence that may improve features of the RT, e.g., thermostability, processivity, and/or template binding. In some embodiments, an M-MLV RT domain comprises, relative to the M-MLV (WT) sequence above, one or more mutations, e.g., selected from D200N, L603W, T330P, T306K, W313F, D524G, E562Q, D583N, P51L, S67R, E67K, T197A, H204R, E302K, F309N, L435G, N454K, H594Q, D653N, R110S, K103L, e.g., a combination of mutations, such as D200N, L603W, and T330P, optionally further including T306K and W313F. In some embodiments, an M-MLV RT used herein comprises the mutations D200N, L603W, T330P, T306K and W313F. In embodiments, the mutant M-MLV RT comprises the following amino acid sequence:

M-MLV (PE2):
(SEQ ID NO: 1575)
TLNIEDEYRLHETSKEPDVSLGSTWLSDFPQAWAETGGMGLAVRQAPLII

PLKATSTPVSIKQYPMSQEARLGIKPHIQRLLDQGILVPCQSPWNTPLLP

VKKPGTNDYRPVQDLREVNKRVEDIHPTVPNPYNLLSGLPPSHQWYTVLD

LKDAFFCLRLHPTSQPLFAFEWRDPEMGISGQLTWTRLPQGFKNSPTLFN

EALHRDLADFRIQHPDLILLQYVDDLLLAATSELDCQQGTRALLQTLGNL

GYRASAKKAQICQKQVKYLGYLLKEGQRWLTEARKETVMGQPTPKTPRQL

REFLGKAGFCRLFIPGFAEMAAPLYPLTKPGTLFNWGPDQQKAYQEIKQA

LLTAPALGLPDLTKPFELFVDEKQGYAKGVLTQKLGPWRRPVAYLSKKLD

PVAAGWPPCLRMVAAIAVLTKDAGKLTMGQPLVILAPHAVEALVKQPPDR

WLSNARMTHYQALLLDTDRVQFGPVVALNPATLLPLPEEGLQHNCLDILA

EAHGTRPDLTDQPLPDADHTWYTDGSSLLQEGQRKAGAAVTTETEVIWAK

ALPAGTSAQRAELIALTQALKMAEGKKLNVYTDSRYAFATAHIHGEIYRR

RGWLTSEGKEIKNKDEILALLKALFLPKRLSIIHCPGHQKGHSAEARGNR

MADQAARKAAITETPDTSTLLI

In some embodiments, a Gene Writer polypeptide may comprise a linker, e.g., a peptide linker, e.g., a linker as described in Table 7. In some embodiments, a Gene Writer polypeptide comprises a flexible linker between the endonuclease and the RT domain, e.g., a linker comprising the amino acid sequence SGGSSGGSSGSETPGTSESAT-PESSGGSSGGSS (SEQ ID NO: 1576). In some embodiments, an RT domain of a Gene Writer polypeptide may be located C-terminal to the endonuclease domain. In some embodiments, an RT domain of a Gene Writer polypeptide may be located N-terminal to the endonuclease domain.

TABLE 7

Exemplary linker sequences

| Amino Acid Sequence | SEQ ID NO: |
|---|---|
| GGS | |
| GGSGGS | 2109 |
| GGSGGSGGS | 2110 |
| GGSGGSGGSGGS | 2111 |
| GGSGGSGGSGGSGGS | 2112 |
| GGSGGSGGSGGSGGSGGS | 2113 |

TABLE 7-continued

Exemplary linker sequences

| Amino Acid Sequence | SEQ ID NO: |
|---|---|
| GGGGS | 2114 |
| GGGGSGGGGS | 2115 |
| GGGGSGGGGSGGGGS | 2116 |
| GGGGSGGGGSGGGGSGGGGS | 2117 |
| GGGGSGGGGSGGGGSGGGGSGGGGS | 2118 |
| GGGGSGGGGSGGGGSGGGGSGGGGSGGGGS | 2119 |
| GGG | |
| GGGG | 2120 |
| GGGGG | 2121 |
| GGGGGG | 2122 |
| GGGGGGG | 2123 |
| GGGGGGGG | 2124 |
| GSS | |
| GSSGSS | 2125 |
| GSSGSSGSS | 2126 |
| GSSGSSGSSGSS | 2127 |
| GSSGSSGSSGSSGSS | 2128 |
| GSSGSSGSSGSSGSSGSS | 2129 |
| EAAAK | 2130 |
| EAAAKEAAAK | 2131 |
| EAAAKEAAAKEAAAK | 2132 |
| EAAAKEAAAKEAAAKEAAAK | 2133 |
| EAAAKEAAAKEAAAKEAAAKEAAAK | 2134 |
| EAAAKEAAAKEAAAKEAAAKEAAAKEAAAK | 2135 |
| PAP | |
| PAPAP | 2136 |
| PAPAPAP | 2137 |
| PAPAPAPAP | 2138 |
| PAPAPAPAPAP | 2139 |
| PAPAPAPAPAPAP | 2140 |
| GGSGGG | 2141 |
| GGGGGS | 2142 |
| GGSGSS | 2143 |
| GSSGGS | 2144 |
| GGSEAAAK | 2145 |
| EAAAKGGS | 2146 |
| GGSPAP | 2147 |

TABLE 7-continued

Exemplary linker sequences

| Amino Acid Sequence | SEQ ID NO: |
|---|---|
| PAPGGS | 2148 |
| GGGGSS | 2149 |
| GSSGGG | 2150 |
| GGGEAAAK | 2151 |
| EAAAKGGG | 2152 |
| GGGPAP | 2153 |
| PAPGGG | 2154 |
| GSSEAAAK | 2155 |
| EAAAKGSS | 2156 |
| GSSPAP | 2157 |
| PAPGSS | 2158 |
| EAAAKPAP | 2159 |
| PAPEAAAK | 2160 |
| GGSGGGGSS | 2161 |
| GGSGSSGGG | 2162 |
| GGGGGSGSS | 2163 |
| GGGGSSGGS | 2164 |
| GSSGGSGGG | 2165 |
| GSSGGGGGS | 2166 |
| GGSGGGEAAAK | 2167 |
| GGSEAAAKGGG | 2168 |
| GGGGGSEAAAK | 2169 |
| GGGEAAAKGGS | 2170 |
| EAAAKGGSGGG | 2171 |
| EAAAKGGGGGS | 2172 |
| GGSGGGPAP | 2173 |
| GGSPAPGGG | 2174 |
| GGGGGSPAP | 2175 |
| GGGPAPGGS | 2176 |
| PAPGGSGGG | 2177 |
| PAPGGGGGS | 2178 |
| GGSGSSEAAAK | 2179 |
| GGSEAAAKGSS | 2180 |
| GSSGGSEAAAK | 2181 |
| GSSEAAAKGGS | 2182 |
| EAAAKGGSGSS | 2183 |
| EAAAKGSSGGS | 2184 |
| GGSGSSPAP | 2185 |
| GGSPAPGSS | 2186 |
| GSSGGSPAP | 2187 |
| GSSPAPGGS | 2188 |
| PAPGGSGSS | 2189 |
| PAPGSSGGS | 2190 |
| GGSEAAAKPAP | 2191 |
| GGSPAPEAAAK | 2192 |
| EAAAKGGSPAP | 2193 |
| EAAAKPAPGGS | 2194 |
| PAPGGSEAAAK | 2195 |
| PAPEAAAKGGS | 2196 |
| GGGGSSEAAAK | 2197 |
| GGGEAAAKGSS | 2198 |
| GSSGGGEAAAK | 2199 |
| GSSEAAAKGGG | 2200 |
| EAAAKGGGGSS | 2201 |
| EAAAKGSSGGG | 2202 |
| GGGGSSPAP | 2203 |
| GGGPAPGSS | 2204 |
| GSSGGGPAP | 2205 |
| GSSPAPGGG | 2206 |
| PAPGGGGSS | 2207 |
| PAPGSSGGG | 2208 |
| GGGEAAAKPAP | 2209 |
| GGGPAPEAAAK | 2210 |
| EAAAKGGGPAP | 2211 |
| EAAAKPAPGGG | 2212 |
| PAPGGGEAAAK | 2213 |
| PAPEAAAKGGG | 2214 |
| GSSEAAAKPAP | 2215 |
| GSSPAPEAAAK | 2216 |
| EAAAKGSSPAP | 2217 |
| EAAAKPAPGSS | 2218 |
| PAPGSSEAAAK | 2219 |
| PAPEAAAKGSS | 2220 |
| AEAAAKEAAAKEAAAKEAAAKALEAEAAAKEAAAKEAAAKEAAAKA | 2221 |
| GGGGSEAAAKGGGGS | 2222 |

TABLE 7-continued

Exemplary linker sequences

| Amino Acid Sequence | SEQ ID NO: |
|---|---|
| EAAAKGGGGSEAAAK | 2223 |
| SGSETPGTSESATPES | 1023 |
| GSAGSAAGSGEF | 2224 |
| SGGSSGGSSGSETPGTSESATPESSGGSSGGSS | 1576 |

In some embodiments, a Gene Writer polypeptide comprises a dCas9 sequence comprising a D10A and/or H840A mutation, e.g., the following sequence:

(SEQ ID NO: 1577)
SMDKKYSIGLAIGTNSVGWAVITDDYKVPSKKFKVLGNTDRHSIKKNLIG

ALLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEEN

PINASGVDAKAILSARLSKSRRLENLIAQLPGEKKNGLFGNLIALSLGLT

PNFKSNFDLAEDAKLQLSKDTYDDDLDNLLAQIGDQYADLFLAAKNLSDA

ILLSDILRVNTEITKAPLSASMIKRYDEHHQDLTLLKALVRQQLPEKYKE

IFFDQSKNGYAGYIDGGASQEEFYKFIKPILEKMDGTEELLVKLNREDLL

RKQRTFDNGSIPHQIHLGELHAILRRQEDFYPFLKDNREKIEKILTFRIP

YYVGPLARGNSRFAWMTRKSEETITPWNFEEVVDKGASAQSFIERMTNFD

KNLPNEKVLPKHSLLYEYFTVYNELTKVKYVTEGMRKPAFLSGEQKKAIV

DLLFKTNRKVTVKQLKEDYFKKIECFDSVEISGVEDRFNASLGTYHDLLK

IIKDKDFLDNEENEDILEDIVLTLTLFEDREMIEERLKTYAHLFDDKVMK

QLKRRRYTGWGRLSRKLINGIRDKQSGKTILDFLKSDGFANRNFMQLIHD

DSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEH

PVENTQLQNEKLYLYYLONGRDMYVDQELDINRLSDYDVDAIVPQSFLKD

DSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKL

IREVKVITLKSKLVSDFRKDFQFYKVREINNYHHAHDAYLNAVVGTALIK

KYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTE

VQTGGFSKESILPKRNSDKLIARKKDWDPKKYGGFDSPTVAYSVLVVAKV

EKGKSKKLKSVKELLGITIMERSSFEKNPIDFLEAKGYKEVKKDLIIKLP

KYSLFELENGRKRMLASAGELQKGNELALPSKYVNFLYLASHYEKLKGSP

EDNEQKQLFVEQHKHYLDEIIEQISEFSKRVILADANLDKVLSAYNKHRD

KPIREQAENIIHLFTLTNLGAPAAFKYFDTTIDRKRYTSTKEVLDATLIH

QSITGLYETRIDLSQLGGD

In some embodiments, a template RNA molecule for use in the system comprises, from 5' to 3' (1) a gRNA spacer; (2) a gRNA scaffold; (3) heterologous object sequence (4) 3' homology domain. In some embodiments:

(1) Is a Cas9 spacer of ~18-22 nt, e.g., is 20 nt
(2) Is a gRNA scaffold comprising one or more hairpin loops, e.g., 1, 2, of 3 loopd for associating the template with a nickase Cas9 domain. In some embodiments, the gRNA scaffold carries the sequence, from 5' to 3', (SEQ ID NO: 1578)
GTTTTAGAGCTAGAAATAGCAAGTTAAAATAAGGCTAGTCCGTTATCAAC

TTGAAAAAGTGGGACCGAGTCGGTCC.

(3) In some embodiments, the heterologous object sequence is, e.g., 7-74, e.g., 10-20, 20-30, 30-40, 40-50, 50-60, 60-70, or 70-80 nt or, 80-90 nt in length. In some embodiments, the first (most 5') base of the sequence is not C.

(4) In some embodiments, the 3' homology domain that binds the target priming sequence after nicking occurs is e.g., 3-20 nt, e.g., 7-15 nt, e.g., 12-14 nt. In some embodiments, the 3' homology domain has 40-60% GC content.

A second gRNA associated with the system may help drive complete integration. In some embodiments, the second gRNA may target a location that is 0-200 nt away from the first-strand nick, e.g., 0-50, 50-100, 100-200 nt away from the first-strand nick. In some embodiments, the second gRNA can only bind its target sequence after the edit is made, e.g., the gRNA binds a sequence present in the heterologous object sequence, but not in the initial target sequence.

In some embodiments, a Gene Writing system described herein is used to make an edit in HEK293, K562, U2OS, or HeLa cells. In some embodiment, a Gene Writing system is used to make an edit in primary cells, e.g., primary cortical neurons from E18.5 mice.

In some embodiments, a reverse transcriptase or RT domain (e.g., as described herein) comprises a MoMLV RT sequence or variant thereof. In embodiments, the MoMLV RT sequence comprises one or more mutations selected from D200N, L603W, T330P, T306K, W313F, D524G, E562Q, D583N, P51L, S67R, E67K, T197A, H204R, E302K, F309N, L435G, N454K, H594Q, D653N, R110S, and K103L. In embodiments, the MoMLV RT sequence comprises a combination of mutations, such as D200N, L603W, and T330P, optionally further including T306K and/or W313F.

In some embodiments, an endonuclease domain (e.g., as described herein) comprises nCAS9, e.g., comprising the H840A mutation.

In some embodiments, the heterologous object sequence (e.g., of a system as described herein) is about 1-50, 50-100, 100-200, 200-300, 300-400, 400-500, 500-600, 600-700, 700-800, 800-900, 900-1000, or more, nucleotides in length.

In some embodiments, the RT and endonuclease domains are joined by a flexible linker, e.g., comprising the amino acid sequence SGGSSGGSSGSETPGTSESAT-PESSGGSSGGSS (SEQ ID NO: 1576).

In some embodiments, the endonuclease domain is N-terminal relative to the RT domain. In some embodiments, the endonuclease domain is C-terminal relative to the RT domain.

In some embodiments, the system incorporates a heterologous object sequence into a target site by TPRT, e.g., as described herein.

In some embodiments, a system or method described herein involves a CRISPR DNA targeting enzyme or system described in US Pat. App. Pub. No. 20200063126, 20190002889, or 20190002875 (each of which is incorporated by reference herein in its entirety) or a functional fragment or variant thereof. For instance, in some embodiments, a GeneWriter polypeptide or Cas endonuclease described herein comprises a polypeptide sequence of any of the applications mentioned in this paragraph, and in some embodiments a template RNA or guide RNA comprises a nucleic acid sequence of any of the applications mentioned in this paragraph.

Template Nucleic Acid Binding Domain:

A Gene Writer polypeptide typically contains regions capable of associating with the Gene Writer template nucleic acid (e.g., template RNA). In some embodiments, the template nucleic acid binding domain is an RNA binding domain. In some embodiments, the RNA binding domain is a modular domain that can associate with RNA molecules containing specific signatures, e.g., structural motifs, e.g., secondary structures present in the 3' UTR in non-LTR retrotransposons. In other embodiments, the template nucleic acid binding domain (e.g., RNA binding domain) RNA binding domain is contained within the reverse transcription domain, e.g., the reverse transcriptase-derived component has a known signature for RNA preference, e.g., secondary structures present in the 3' UTR in non-LTR retrotransposons. In other embodiments, the template nucleic acid binding domain (e.g., RNA binding domain) is contained within the DNA binding domain. For example, in some embodiments, the DNA binding domain is a CRISPR-associated protein that recognizes the structure of a template nucleic acid (e.g., template RNA) comprising a gRNA. In some embodiments, the gRNA is a short synthetic RNA composed of a scaffold sequence that participates in CRISPR-associated protein binding and a user-defined ~20 nucleotide targeting sequence for a genomic target. The structure of a complete gRNA was described by Nishimasu et al. Cell 156, P935-949 (2014). The gRNA (also referred to as sgRNA for single-guide RNA) consists of crRNA- and tracrRNA-derived sequences connected by an artificial tetraloop. The crRNA sequence can be divided into guide (20 nt) and repeat (12 nt) regions, whereas the tracrRNA sequence can be divided into anti-repeat (14 nt) and three tracrRNA stem loops (Nishimasu et al. Cell 156, P935-949 (2014)). In practice, guide RNA sequences are generally designed to have a length of between 17-24 nucleotides (e.g., 19, 20, or 21 nucleotides) and be complementary to a targeted nucleic acid sequence. Custom gRNA generators and algorithms are available commercially for use in the design of effective guide RNAs. In some embodiments, the gRNA comprises two RNA components from the native CRISPR system, e.g. crRNA and tracrRNA. As is well known in the art, the gRNA may also comprise a chimeric, single guide RNA (sgRNA) containing sequence from both a tracrRNA (for binding the nuclease) and at least one crRNA (to guide the nuclease to the sequence targeted for editing/binding). Chemically modified sgRNAs have also been demonstrated to be effective for use with CRISPR-associated proteins; see, for example, Hendel et al. (2015) Nature Biotechnol., 985-991. In some embodiments, a gRNA comprises a nucleic acid sequence that is complementary to a DNA sequence associated with a target gene. In some embodiments, a polypeptide comprises a DNA-binding domain comprising a CRISPR-associated protein that associates with a gRNA that allows the DNA-binding domain to bind a target genomic DNA sequence. In some embodiments, the gRNA is comprised within the template nucleic acid (e.g., template RNA), thus the DNA-binding domain is also the template nucleic acid binding domain. In some embodiments, the polypeptide possesses RNA binding function in multiple domains, e.g., can bind a gRNA structure in a CRISPR-associated DNA binding domain and a 3' UTR structure in a non-LTR retrotransposon derived reverse transcription domain.

In some embodiments, a template nucleic acid (e.g., template RNA) comprises a 3' target homology domain. In some embodiments, a 3' target homology domain is disposed 3' of the heterologous object sequence and is complementary to a sequence adjacent to a site to be modified by a system described herein, or comprises no more than 1, 2, 3, 4, or 5 mismatches to a sequence complementary to the sequence adjacent to a site to be modified by the system/Gene Writer™. In some embodiments, the 3' target homology domain anneals to the target site, which provides a binding site and the 3' hydroxyl for the initiation of TPRT by a Gene Writer polypeptide. In some embodiments, the 3' target homology domain is 3-5, 5-10, 10-30, 10-25, 10-20, 10-19, 10-18, 10-17, 10-16, 10-15, 10-14, 10-13, 10-12, 10-11, 11-30, 11-25, 11-20, 11-19, 11-18, 11-17, 11-16, 11-15, 11-14, 11-13, 11-12, 12-30, 12-25, 12-20, 12-19, 12-18, 12-17, 12-16, 12-15, 12-14, 12-13, 13-30, 13-25, 13-20, 13-19, 13-18, 13-17, 13-16, 13-15, 13-14, 14-30, 14-25, 14-20, 14-19, 14-18, 14-17, 14-16, 14-15, 15-30, 15-25, 15-20, 15-19, 15-18, 15-17, 15-16, 16-30, 16-25, 16-20, 16-19, 16-18, 16-17, 17-30, 17-25, 17-20, 17-19, 17-18, 18-30, 18-25, 18-20, 18-19, 19-30, 19-25, 19-20, 20-30, 20-25, or 25-30 nt in length, e.g., 10-17, 12-16, or 12-14 nt in length.

In some embodiments, the template nucleic acid, e.g., template RNA, may comprise a gRNA (e.g., pegRNA). In some embodiments, the template nucleic acid, e.g., template RNA, may bind to the Gene Writer™ polypeptide by interaction of a gRNA portion of the template nucleic acid with a template nucleic acid binding domain, e.g., a RNA binding domain (e.g., a heterologous RNA binding domain). In some embodiments, the heterologous RNA binding domain is a CRISPR/Cas protein, e.g., Cas9.

In some embodiments, the region of the template nucleic acid, e.g., template RNA, comprising the gRNA adopts an underwound ribbon-like structure of gRNA bound to target DNA (e.g., as described in Mulepati et al. Science 19 Sep. 2014:Vol. 345, Issue 6203, pp. 1479-1484). Without wishing to be bound by theory, this non-canonical structure is thought to be facilitated by rotation of every sixth nucleotide out of the RNA-DNA hybrid. Thus, in some embodiments, the region of the template nucleic acid, e.g., template RNA, comprising the gRNA may tolerate increased mismatching with the target site at some interval, e.g., every sixth base. In some embodiments, the region of the template nucleic acid, e.g., template RNA, comprising the gRNA comprising homology to the target site may possess wobble positions at a regular interval, e.g., every sixth base, that do not need to base pair with the target site.

gRNAs with Inducible Activity

In some embodiments, a template nucleic acid, e.g., template RNA, comprises a guide RNA (gRNA) with inducible activity. Inducible activity may be achieved by the template nucleic acid, e.g., template RNA, further comprising (in addition to the gRNA) a blocking domain, wherein the sequence of a portion of or all of the blocking domain is at least partially complementary to a portion or all of the gRNA. The blocking domain is thus capable of hybridizing or substantially hybridizing to a portion of or all of the gRNA. In some embodiments, the blocking domain and inducibly active gRNA are disposed on the template nucleic acid, e.g., template RNA, such that the gRNA can adopt a first conformation where the blocking domain is hybridized or substantially hybridized to the gRNA, and a second conformation where the blocking domain is not hybridized or or not substantially hybridized to the gRNA. In some embodiments, in the first conformation the gRNA is unable to bind to the Gene Writer polypeptide (e.g., the template nucleic acid binding domain, DNA binding domain, or endonuclease domain (e.g., a CRISPR/Cas protein)) or binds with substantially decreased affinity compared to an otherwise similar template RNA lacking the blocking domain. In some embodiments, in the second conformation the gRNA is able to bind to the Gene Writer polypeptide (e.g., the template nucleic acid binding domain, DNA binding domain, or endonuclease domain (e.g., a CRISPR/Cas protein)). In some embodiments, whether the gRNA is in the first or second conformation can influence whether the DNA binding or endonuclease activities of the Gene Writer polypeptide (e.g., of the CRISPR/Cas protein the Gene Writer polypeptide comprises) are active. In some embodiments, hybridization of the gRNA to the blocking domain can be disrupted using an opener molecule. In some embodiments, an opener molecule comprises an agent that binds to a portion or all of the gRNA or blocking domain and inhibits hybridization of the gRNA to the blocking domain. In some embodiments, the opener molecule comprises a nucleic acid, e.g., comprising a sequence that is partially or wholly complementary to the gRNA, blocking domain, or both. By choosing or designing an appropriate opener molecule, providing the opener molecule can promote a change in the conformation of the gRNA such that it can associate with a CRISPR/Cas protein and provide the associated functions of the CRISPR/Cas protein (e.g., DNA binding and/or endonuclease activity). Without wishing to be bound by theory, providing the opener molecule at a selected time and/or location may allow for spatial and temporal control of the activity of the gRNA, CRISPR/Cas protein, or Gene Writer system comprising the same. In some embodiments, a Gene Writer may comprise a Cas protein as listed in Table 9 or Table 37 or a functional fragment thereof, or a sequence having at least 70%, 75%, 80%, 85%, 90%, 95%, 96%, 97%, 98%, 99% identity thereto.

TABLE 9

CRISPR/Cas Proteins, Species, and Mutations

| Variant | Parental Host | Protein Sequence | Nickase Mutation | SEQ ID NO: |
|---|---|---|---|---|
| Nme2Cas9 | Neisseria meningitidis | MAAFKPNPINYILGLDIGIASVGWAMVEIDEEENPIRLIDLGVRVFERAEVPKTGDSLAMARRLAR SVRRLTRRRAHRLLRARRLLKREGVLQAADFDENGLIKSLPNTPWQLRAAALDRKLTPLEWSAVL LHLIKHRGYLSQRKNEGETADKELGALLKGVANNAHALQTGDFRTPAELALNKFEKESGHIRNQR GDYSHTFSRKDLQAELILLFKQKEFGNPHVSGGLKEGIETLLMTQRPALSGDAVQKMLGHCTFE PAEPKAAKNTYTAERRIWLTKLNNLRILEQGSERPLTDTERATLMDEPYRKSKLITYAQARKLLGL EDTAFFKGLRYGKDNAEASTLMEMKAYHAISRALEKEGLKDKKSPLNLSSELQDEIGTAFSLFKT DEDITGRLKDRVQPEILEALLKHISFDKFVQISLKALRRIVPLMEQGKRYDEACAEIYGDHYGKKN TEEKIYLPPIPADEIRNPVVLRALSQARKVINGVVRRYGSPARIHIETAREVGKSFKDRKEIEKRQEE NRKDREKAAAKFREYFPNFVGEPKSKDILKLRLYEQQHGKCLYSGKEINLVRLNEKGYVEIDHAL PFSRTWDDSFNNKVLVLGSENQNKGNQTPYEYFNGKDNSREWQEFKARVETSRFPRSKKQRILLQ KFDEDGFKECNLNDTRYVNRFLCQFVADHILLTGKGKRRVFASNGQITNLLRGFWGLRKVRAEN DRHHALDAVVACSTVAMQKITRFVRYKEMNAFDGKTIDKETGKVLHQKTHFPQPWEFFAQE VMIRVPGKPDGKPEFEADTPEKLRTILAEKLSSRPEAVHEYVTPLFVSRAPNRKMSGAHKDTLRS AKRFVKHNEKLSVKRVWLTEIKLADLENMVNYKNGREIELYEALKARLEAYGGNAKQAFDPKDN PFYKKGGQLVKAVRVEKTQESGVLLNKKNAYTIADNGDMVRVDVFCKVDKKGKNQYFIVPIYA WQVAENILPDICKGYRIDDSYTFCFSLHKYDLIAFQKDEKSKVEFAYYINCDSSNGRFYLAWHD KGSKEQQFRISTQNLVLIQKYQVNELGKEIRPCRLKKRPVR | N611A | 2225 |
| PpnCas9 | Pasteurella pneumotropica | MQNNPLNYILGLDLGIASIGWAVVEIDEESSPIRLIDVGVRTFERAEVAKTGESLALSRRLARSSRR LIKRRAERLKKAKRLLKAEKILHSIDEKLPINVWQLRVKGLKEKLERQEWAAVLLHLSKHRGYLS QRKNEGKSDNKELGALLSGIASNHQMLQSSEYRTPAEIAVKKFQVEEGHIRNQRGSYTHTFSRLDL LAEMELLFQRQAELGNSYTSTTLLENITALLLMWQKPALAGDAILKMLGKCTFEPSEYKAAKNSY SAERFWLTKLNNLRILENGTERALLEQPYEKSLLTYAQVRAMLALSDNAIFKGVRY LGEDKKTVESKTTLIEMKFYHQIRKTLGSAELKKEWNELKGNSDLLDEIGTAFSLYKTDDDICRYL EGKLPERVLALLENLNFDKFIQLSLKALHQILPLMLQGQRYDEAVSAIYGDHYGKKSTETTRLLP TIPADEIRNPVVLRTLTQARKVINAVVRLYGSPARIHETAREVGKSYQDRKKLEKQQEDNRKQRE SAVKKKEMPPHFVGEPKGDILKMRLYELQQAKCLYSGKSLELHRLLEKGYVEVDHALPSRT WDDSFNNKVLVLANENQNKGNLTPYEWLDGKNNSERWQHFVVRVQTSGFSYAKKQRILNHKLD EKGFIERNLNDTRYVARFLCNFIADNMLLVCKGKRNVFASNGQITALLRHRWGLQKVREQNDRH HALDAVVVACSTVAMQQKITRFVRYNEGNVPSGERIDRETGEIIPLHFPSPWAFFKENVEIRIFSEN PKLELENRLPDYPQYNHEWVQPLFVSRMPTRKMTGGGHMETVKSAKRLNEGLSVLKVPLTQLKL SDLERMVNRDREIALYESLKARLEQFGNDPAKAFAEPFYKKGGALVKAVRLEQTQKSGVLVRDG NGVADNASMVRVDVFTKGGKYFLVPIYTWQVAKGILPNRAATOGKDENDWDIMDEMATFQPSL CQNDLIKLVTKKKTIPGYFNGLNRATSNINIKEHDLDKSKGKLGIYLEVGVKLAISLEKYQVDELG KNIRPCRPTKRQHVR | N605A | 2226 |
| SauCas9 | Staphylococcus aureus | MKRNYILGLDIGITSVGYGIIDYETRDVIDAGVRLFKEAANVENNEGRRSKRGARRLKRRRHRIQR VKKLLFDYNLLTDHSELSGINPYEARVKGLSQKLSEEFSAALLHLAKRRGVHNVNEVEEDTGNE LSTKEQISRNSKALEEKYVAELQLERLKKDGEVRGSINRFKTSDVVKEAKQLLKVQKAYHQLDQS FIDTYIDLLETRRTYEGPGEGSPFGWKDIKEWYEMLMGHCTYFPPELRSVKYANADLYNALN DLNNLVITRDENEKLEYYEKFQIIENVFKQKKKPTLKQIAKEILVNEEDIKGYRVTSTGKPEFTNLK VYHDIKDITARKEIIENAELLDQIAKILTIYQSSEDIQEELTNLNSELTQEIEQISNLKGYTGTHNLSL KAINLLIDELWHTNDNQIAIFNRLKLVPKKVDLSQQKEIPTTLVDDFILSPVVKRSFIQSIKVINAIIK KYGLPNDIIIELAREKNSKDAQKMINEMQKRNRQTNERIEIIRTTGKENAKYLIEKIKLHDMQEGK CLYSLEAIPLEDLLNNPFNYEVDHIIPRSVSFDNSFNNKVLVKQEENSKKGNRTPFQYLSSSDSKISY ETFKKHILNLAKGKGRISKTKKEYLLEERDINRFSVQKDFINRNLVDTRYATRGLMNLLRSYFRVN NLDVKVKSINGGFTSFLRRKWKFKKERNKGYKHHAEDALIIANADFIFKEWKKLDKAKKVMENQ | N580A | 2227 |

TABLE 9-continued

CRISPR/Cas Proteins, Species, and Mutations

| Variant | Parental Host | Protein Sequence | Nickase Mutation | SEQ ID NO: |
|---|---|---|---|---|
| SauCas9-KKH | Staphylococcus aureus | MPEEKQAESMPEIETEQEYKEIFITPHQIKHIKDFKDYKYSHRVDKKPNRELINDTLYSTRKDDKGN TLIVNNLNGLYDKDNDKLKKLINKSPEKLLMYHHDPQTYQKLKLIMEQYGDEKNPLYKYEETG NYLTKYSKKDNGPVIKKIKYGNKLNAHLDITDDYPNSRNKVVKLSLKPYRFDVYLDNGVYKFV TVKNLDVIKKENYYEVNSKCYEEAAKLKKISNQAEFIASFYNNDLIKINGELYRVIGVNNDLLNRI EVNMIDITYREYLENMNDKRPPRIIKTIASKTQSIKKYSTDILGNLYEVKSKKHPQIIKKG | | 2228 |
| SauriCas9 | Staphylococcus auricularis | MKRNYILGLDIGITSVGYGIIDYETRDVIDAGVRLFKEAVENNEGRRSKRGARRLKRRRHRIQR VKKLLFDYNLLTDHSELSGINPYEARVKGLSQKLSEEEFSAALLHLAKRRGVHNVNEVEEDTGNE LSTKEQISRNSKALEEKYVAELQLERLKKDGEVRGSINRFKTSDYVKEAQLLKVQKAYHQLDQS FIDTYIDLLETRRTYEGPGEGSPFGWKDIKEWYEMLMGHCTYFPEELRSVKYAYNADLYNALN DLNNLVITRDENEKLEYYEKFQIIENVFKQKKKPTLKQIAKEILVNEEDIKGYRVTSTGKPEFTNLK VYHDIKDITARKEIIENAELLDQIAKILTIYQSSEDIQEELTNLNSELTQEEIEQISNLKGYTGTHNLSL KAINLILDELWHTNDNQIAIFNRLKLVPKKVDLSQQKEIPTTLVDDFILSPVVKRSFIQSIKVINAIIK KYGLPNDIIIELARERKNSKDAQKMINEMQKRNRQTNERIEEIIRTTGKENAKYLIEKIKLHDMQEGK CLYSLEAIPLEDLLNNPFNYEVDHIIPRSVSFDNKVLVKQEENSKGNRTPFQYLSSSSDSKISY ETFKKHILNLAKGKGRISKTKEYLLEERDINRFSVQKDFINRNLVDTRYATRGLMNLLRSYFRVN NLDVKVKSINGGFTSFLRRKWFKKERNGYKHHAEDALIIANADPIFKEWKKLDKCAKKVMENQ MPEEKQAESMPIETEQEYKEIFITPHQIKHIKDFKDYKYSHRVDKKPNRKLINDTLYSTRKDDKG NTLIVNNLNGLYDKDNDKLKKLINKSPEKLLMYHHDPQTYQKLKLIMEQYGDEKNPLYKYEET GNYLTKYSKKDNGPVIKKIKYGNKLNAHLDITDDYPNSRNKVVKLSLKPYRFDVVLDNGVYKF VTVKNLDVIKKENYYEVNSKCYEEAAKLKKISNQAEFIASFYKNDLIKINGELYRVIGVNNDLLNR IEVNMIDITYREYLENMNDKRPPHIIKTIASKTQSIKKYSTDILGNLYEVKSKKHPQIIKKG | N580A | 2228 |
| SauriCas9 | Staphylococcus auricularis | MQENQQKQNYILGLDIGITSVGYGLIDSKTREVIDAGVRLFPEADSENNSNRRSKRGARRLKRRRI HRLNRVKDLLADYQMIDLNNVPKSTDPYTIRVKGLREPLTKEEFAIALLHIAKRRGLHNISVSMGD EEQDNELSTKQQLQKNAQQLQDKYVCELQLERLTNINKVRGEKNRFKTEDFVKEVKQLCETQRQ YHNIDDQFIQQYIDLVSTRREYFEGPGNGSPYGWDGDLLKNYEKLMGRCTYFPEELRSVKYAYS ADLFNALNDLNNLVVTRDDNPKLEYEKYHIIENVFKQKKNPTLKQIAKEIGVQDYDIRGYRITKS GKPQFTSFKLYHDLKNIFEQAKYLEDVEMLDEIAKILTIYQDEISIKKALDQLPELLTESEKSQIAQL TGYTGTHRLSLKCIHIVIDELWESPENQMEIFTRLNLKPKKVEMSEIDSIPTTLVDEFILSPVVKRAFI QSIKVINAVINRFGLPEDIIELARERKNSKDRRKFINKLQKQNEATRKKIEQLLAKYGNTNAKYMIE KIKLHDMQEGKCLYSLEAIPLEDLLSNPTHYEVDHIIPRSVSFDNSLNNKVLVKQSENSKKGNRTP YQYLSSNESKISYNQFKQHILNLSKAKDRISKKKRDMLLEERDINKFEVQKEFINRNLVDTRYATR ELSNLLKTYFSTHDYAVKVKTINGGFTNHLRKVWDFKKHRNHGYKHHAEDALVIANADFLFKTH KALRRTDKILEQPGLEVNDTTVKVDTEEKYQELFETPKQVKNIKQPRDFKYSHRVDKKPNRQLIN DTLYSTREIDGETYVVQTLDLLYAKDNEKVKLFTERRPQKILMYQHDPKTFEKLMTILNQYAEAK NPLAAYYEDKGEYVTKAKKGNGPAIHKIKYIDKKLGSYLDVSNKYPETQNKLVKLLSLKSPFDI YKCEOQYKMVSIGYLDVLKKDNYYIIPKDKYEAEKQKKIKESDLFVGSFYYNDLIMYEDELFR VIGVNSDINNLVELNMVDITYKDFCEVNNVTGEKRIKKTIGKRVVLIEKYTTDILGNLYKTPLPKKP QLIFKRGEL | N588A | 2229 |
| SauriCas9-KKH | Staphylococcus auricularis | MQENQQKQNYILGLDIGITSVGYGLIDSKTREVIDAGVRLFPEADSENNSNRRSKRGARRLKRRRI HRLNRVKDLLADYQMIDLNNVPKSTDPYTIRVKGLREPLTKEEFAIALLHIAKRRGLHNISVSMGD EEQDNELSTKQQLQKNAQQLQDKYVCELQLERLTNINKVRGEKNRFKTEDFVKEVKQLCETQRQ YHNIDDQFIQQYIDLVSTRREYFEGPGNGSPYGWDGDLLKNYEKLMGRCTYFPEELRSVKYAYS ADLFNALNDLNNLVVTRDDNPKLEYEKYHIIENVFKQKKNPTLKQIAKEIGVQDYDIRGYRITKS GKPQFTSFKLYHDLKNIFEQAKYLEDVEMLDEIAKILTIYQDEISIKKALDQLPELLTESEKSQIAQL TGYTGTHRLSLKCIHIVIDELWESPENQMEIFTRLNLKPKKVEMSEIDSIPTTLVDEFILSPVVKRAFI QSIKVINAVINRFGLPEDIIELARENSKDRRKFINKLQKQNEATRKKIEQLLAKYGNTNAKYMIE | N588A | 2230 |

TABLE 9-continued

CRISPR/Cas Proteins, Species, and Mutations

| Variant | Parental Host | Protein Sequence | Nickase Mutation | SEQ ID NO: |
|---|---|---|---|---|
| | | KIKLHDMQEGKCLYSLEAIPLEDLLSNPTHYEVDHIIPRSVSFDNSLNNKVLVKQSENSKKGNRTP YQYLSSNESKISYNQPKQHILNLSKADRISKKKRDMLLEERDINKPEVQKEFINRNLVDTRYATR ELSNLLKTYFSTHDYAVKVKTINGGFTNHLRKVWDFKKHRNHGYKHHAEDALVIANADFLPKTH KALRRTDKILEQPGLEVNDTTVKVDTEEKYQELFETPKQVKNIKQPRDFKYSHRVDKKPNRKLIN DTLYSTREIDGETYVVQTLKDLYAKDNEKVKKLFTERPQKILMYQHDPKTFEKLMTILNQYAEAK NPLAAYYEDKGEYVTKYAKKGNGPAIHKIKYIDKKLGSYLDVSNKYPETQNKLIVKLSLKSRPFDI YKCEQGYKMVSIGYLDVLKKDNYYIPKDKYEAEKQKKKIKESDLFVGSFYKNDLIMYEDELFR VIGVNSDINNLVELNMVDITYKDFCEVNNVTGEKHIKKTIGKRVLIEKYTTDILGNLYKTPLPKK PQLIFKRGEL | | |
| ScaCas9-Sc++ | Streptococcus canis | MEKKYSIGLDIGTNSVGWAVITDDYKVPSKKFKVLGNTNRKSIKKNLMGALLFDSGETAEATRLK RTARRRYTRRKNRIRYLQEIFANEMAKLDDSFFQRLEESFLVEEDKKNERHPIFGNLADEVAYHRN YPTIYHLRKKLADSPEKADLRLIYLALAHIIKFRGHFLIEGKLNAENSDVAKLFYQLIQTYNQLFEE SPLDEIEVDAKGILSARLSKSKRLEKLIAVPPNEKKNGLFGNIIALALGLTPNFKSNFDLTEDAKLQL SKDTYDDDLDELLGQIGDQYADLFLAAKNLSDAILLSDILRSNSEVTKAPLSASMVKRYDEHHQD LALLKTLVRQQPEKYAEIFKDDTKNGYAGYVGADKKLRKRSGKLATEEEFYKFIKPILEKMDGA EELLAKLNRDDLLRKQRTFDNGSIPHQIHLKELHAILRRQEEFYPPLKENREKIEKILTFRIPYYVGP LARGNSRFAWLTRKSEEAITPWNFEEVVDKGASAQSFIERMTNFDKQLPNKKVLPKHSLLYEYFT VYNELTKVKVTERMRKPEFLSGEQKKAIVDLLFKTNRKVTVKQLKEDYFKKIECFDSVELIGVED RPNASLGTYHDLLKIIKDKDFLDNEENEDILEDIVLTLTLFEDREMIEERLKTYAHLFDDKVMKQL KRRHTGWGRLSRKMINGIRDKQSGKTILDFLKSDGFSNRNFMQLIHDDSLTFKEEIEKAQVSGQG DSLHEQIADLAGSPAIKKGILQTVKIVDELVKVMGHKPENIVIEMARENQTTKGLQQSRERKRI EEGIKELESQILKENPVENTQLQNEKLYLYYLQNGRDMYVDQELDINRLSDYDVDHIVPQSFIKDD SIDNKVLTRSVENRGKSDNVPSEEVVKKMKNYWRQLLNAKLITQRKFDNLTKAERGGLSEADKA GFIKRQLVETRQITKHVARILDSRMNTKRDKNDKPIREVKVITLKSKLIVSDFRKDFQLYKVRDINN YHHAHDAYLNAVVGTALIKKYPKLESEFVYGDYKVYDVRKMIAKSEQEIGKATAKRFFYSNIMN FFKTEVKLANGEIRKRPLIETNGETGEVVWNKEKDFATVRKVLAMPQVNIVKKTEVQTGGFSKES ILSKRESAKLIPRKKGWDTRKYGGSPTVAYSIIKVRLFLENGRRRMLASAKELQKANELVLPQHLVRLLYYTQ NISATTGSNNLGYIEQHREEFKEIFEKIIDFSEKYILKNKVNSNLKSSFDEQFAVSDSILLSNSFVSLL KYTSFGASGGFTFLDLDVKQGRLRYQTVTEVLDATLIYQSITGLYETRTDLSQLGGD | N872A | 2231 |
| SpyCas9 | Streptococcus pyogenes | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGRHKPENIVIEMARENQTTQKGQKNSRERMKRIEEGIKELG SQILKEHPVENTQLQNEKLYLYYLQNGRDMVDQELDINRLSDYDVDHIVPQSFLKDDSIDNKVL TRSDKNRGKSDNVPSEEVVKKMKNVWRQLLNAKLITQRKFDNLTKAERGGLSELDKAGFIKRQL SQILKEHPVENTQLQNEKLYLYYLQNGRDMYVDQELDINRLSDYDVDHIVPQSFLKDDSIDNKVL VETRQITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKRNSDK | N863A | 2232 |

TABLE 9-continued

CRISPR/Cas Proteins, Species, and Mutations

| Variant | Parental Host | Protein Sequence | Nickase Mutation | SEQ ID NO: |
|---|---|---|---|---|
| SpyCas9-NG | Streptococcus pyogenes | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQQDSLHEHIANL AGSPAIKKGILQTVKVVDELVKVMGRHKPENIVIEMARENQTTQKGQKNSRERMKRIEEGIKELG SQILKEHPVENTQLQNEKLYLYYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESIRPKRNSDK LIARKKDWDPKKYGGFDSPTVAYSVLVVAKVEKGKSKKLKSVKELLGITIMERSSFEKNPIDFLEA KGYKEVKKDLIIKLPKYSLFELENGRKRMLASARFIQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPAFKYFDTTIDRKRYTSTKEVLDATLIHQSITGLYETRIDLSQLGGD | N863A | 2233 |
| SpyCas9-SpRY | Streptococcus pyogenes | MDKKYSIGLDIGTNSVGWAVITDEYKVPSKKFKVLGNTDRHSIKKNLIGALLFDSGETAEBRTRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQQDSLHEHIANL AGSPAIKKGILQTVKVVDELVKVMGRHKPENIVIEMARENQTTQKGQKNSRERMKRIEEGIKELG SQILKEHPVENTQLQNEKLYLYYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESIRPKRNSDK LIARKKDWDPKKYGGFIWPTVAYSVLVVAKVEKGKSKKLKSVKELLGITIMERSSFEKNPIDFLE AKGYKEVKKDLIIKLPKYSLFELENGRKRMLASAKQLKGNELALPSKYVNFLYLASHYEKLKGS PEDNEQKQLFVEQHKHYLDEIIEQISEFSKRVILADANLDKVLSAYNKHRDKPIREQAENIIHLFTLT RLGAPRAFKYFDTTIDPKQYRSTKEVLDATLIHQSITGLYETRIDLSQLGGD | N863A | 2234 |

TABLE 9-continued

CRISPR/Cas Proteins, Species, and Mutations

| Variant | Parental Host | Protein Sequence | Nickase Mutation | SEQ ID NO: |
|---|---|---|---|---|
| St1Cas9 | Streptococcus thermophilus | MSDLVLGLDIGIGSVGVGILNKVTGEIIHKNSRIFPAAQAENNLVRRTNRQGRRLARKKHRRVRL NRLFEESGLITDFTKISINLNPYQLRVKGLTDELSNEELFIALKNMVKHRGISYLDDASDGNSSVG DYAQIVKENSKQLETKTPGQIQLERYQTYGQLRGDFTVEKDGKKHRLINVPTSAYRSEALRILQT QQEFNPQITDEFINRVLEILTGKRKYYHGPGNEKSRTDGYRYRTSGETLDNIFGILIGKCTFYPDEFR AAKASYTAQEFNLLNDLNNLIVPTETKKLSKEQKNQIINVVKNEKAMGPAKLFKYIAKLLSCDVA DIKGYRIDKSGKAEIHTFEAYRKMKTLETLDIEQMDRETLDKLAYVLTLNTEREGIQEALEHEFAD GSFSQKQVDELVQFRKANSSIFGKGWHNFSVKLMMELIPELYETSEEQMTLTRLGKQKTSSSNK TKYIDEKLLTEEIYNPVVAKSVRQAIKIVNAAIKEYGDFDNIVIEMARETNEDDEKKAIQKIQKANK DEKDAAMLKAANQYNGKAELPHSVFHGHKQLATKIRLMHQQGERCLYTGKTISIHDLINNSNQF EVDHILPLSITFDDSLANKVLVYATANQEKGQRTPYQALDSMDDAWSFRELKAFVRESKTLSNKK KEYLLTEEDISKFDVRKKFIERNLVDTRYASRVVLNALQEHFRAHKIDTKVSVVRGQFTSQLRRH WGIEKTRDTYHHAVDALIIAASSQLNLWKKQKNTLVSYSEDQLLDIETGELISDDEYKESVFKAP YQHFVDTLKSKEFEDSILFSYQVDSKFNRKISDATIYATRQAKVGKDKADETYVLGKIKDIYTQDG YDAFMKIYKKDKSKFLMYRHDPQTFEKVIEPILENYPNKQINEKGKEVPCNPFLKYKEEHGYIRKY SKKGNGPEIKSLKYDSKLGNHIDITPKDSNNKVLQSVSPWRADVYFNKTTGKYEILGLKYADL QFEKGTGTYKILSQEKYNDIKKKEGVDSDSEFKFTLYKNDLLLIVKDTETKEQQLFRPLSRTMPKQK HYVELKPYDKQKPFEGGEALIKVLGNVANSGQCKKGLGKSNIISIYKVRTDVLGNQHIIKNEGDKPK LDF | N622A | 2235 |
| BlatCas9 | Brevibacillus laterosporus | MAYTMGIDVGIASCGWAIVDLERQRIIDIGVRTFEKAENPKNGEALAVPRREARSRRRLRKKHR IERLKHMFVRNGLAVDIQHLEQTLRSQNEIDVWQLRVDGLDRMLTQKEWLRVLIHLAQRGFQS NRKTDGSSEDGQVLVNVTENDRLMEEKDYRTVAEMMVKDEKFSDHKRNKNGNYHGVVSRSSL LVEIHTLFETQRQHHNSLASKDFELEVNIWSAQRPVATKDQIEKMIGTCFLPKEKRAPKASWHF QYFMLLQTINHLIRTNVQGTRSLNKEIEQVVNMALTKSKVSYHDTRKILDLSEEYQFVGLDYGKE DEKKKVESKETIIKLDDYHKLNKIFNEVELAKGETWEADDYDTVAYALTFFKDDEDIRDYLQNKY KDSKNRLVKNLANKEYTNELIGKVSTLSFRKVGHLSLKALRKIIPFLEQGMTYDKACQAAGFDFQ GISKKKRSVVLPVIDQISNPVVNRALTQTRKVINALIKKYGSPETIHIETARELSKTFDERKNITKDY KENRDKNEHAKKHLSELGIINPTGLDIVKYKLWCEQQGRCMYSNQPISFERLKESGYTEVDHIIPY SRSMNDSYNNRVLVMTRENREKGNQTPFEYMGNDTQRWYEFEQRVTTNPQIKKEKRQNLLLKG FTNRRELEMLERNLNDTRYITKYLSHFISTNLEFSPSDKKKKVVNTSGRITSHLRSRWGLEKNRGQ NDLHHAMDAIVIAVTSDSFIQQVTNYYKRKERRELNGDDKPPLPWKFPREEVIARLSPNPKEQIEA LPNHFYSEDELADLQPIFVSRMPKRSITGEAHQAQPRRVVGKTKEGKNITAKKTALVDISYDKNGD FNMYGRETDPATYEAIKERYLEFGGNVKKAFSTDLHKPKDGTKGPLIKSVRIMENKTLVHPVNK GKGVVNSSIVRTDVFQRKEKYYLLPVYVTDVTKGKLPNKVIVAKKGYHDWIEVDDSFTFLFSLY PNDLIFIRQNPKKKISLKKRIESHSISDSKEVQEIHAYYKGVDSSTAAIEFIIHDGSYYAKGVGVQNL DCFEKYQVDLLGNYFKVGKEKRLELETSDSNHKGKDVNSIKSTSR | N607A | 2236 |
| cCas9-v16 | Staphylococcus aureus | MKRNYILGLDIGITSVGYGIIDYETRDVIDAGVRLFKEANVENNEGRRSKRGAARLKRRRHRIQR VKKLLFDYNLLTDHSELSGINPYEARVKGLSQKLSEEEFSAALLHLAKRRGVHNVNEVEEDTGNE LSTKEQISRNSKALEEKYVAELQLERLKKDGEVRGSINRFKTSDVVKEAKQLLKVQKAYHQLDQS FIDTYIDLLETRRTYYEBGPGEGSPFGWKDIKEWYEMLMGHCTYFPEELRSVKYAYNADLYNALN DLNNLVITRDENEKLEYYEKFQIIENVFKQKKKPTLKQIAKEILVNEEDIKGYRVTSTGKPEFTNLK VYHDIKDITARKEIIENAELLDQIAKILTIYQSSEDIQEELTNLNSELTQEEIEQISNLKGYTGTHNLSL KAINLLIDELWHTNDNQIAIFNRLKLVPKKVDLSQQKEIPTTLVDDFILSPVVKRSFIQSIKVINAIIK KYGLPNDIIIELAREKNSKDAQKMINEMQKRNPTNERIEEIIRTTGKENAKYLIEKIKLHDMQEGK CLYSLEAIPLEDLLNNPFNYEVDHIIPRSVSFDNSFNNKVLVKQEENSKKGNRTPFQYLSSSDSKISY ETFKKHILNLAKGKGRISKTKKEYLLEERDINRFSVQKDFINRNLVDTRYATRGLMNLLRSYFRVN NLDVKVKSINGGFTSFLRRKWKFKKERNKGYKHHAEDALIIANADFIFKEWKKLDKAKKVMENQ MFEEKQAESMPEIETEQEYKEIFITPHQIKHIKDFKDYKYSHRVDKKKPNRKLINDTLYSTRKDDKG | N580A | 2237 |

TABLE 9-continued

CRISPR/Cas Proteins, Species, and Mutations

| Variant | Parental Host | Protein Sequence | Nickase Mutation | SEQ ID NO: |
|---|---|---|---|---|
| | | NTLIVNNLNGLYDKDNDKLKLLINKSPEKLLMYHHDPQTYQKLKLIMEQYGDEKNPLYKYEET GNYLTKYSKKDNGPVIKKIKYYGNKLNAHLDITDDYPNSRNKVVKLSLKPYRFDVYLDNGVYKF VTVKNLDVIKKENYYEVNSKCYEEAAKLKKISNQAEFIASFYKNDLIKINGELYRVIGVNSDKNNL IEVNMIDITYREYLENMNDKRPPHIIKTIASKTQSIKKYSTDILGNLYEVKSKKHPQIIKKG | | 2238 |
| cCas9-v17 | Staphylococcus aureus | MKRNYILGLDIGITSVGYGIIDYETRDVIDAGVRLFKEAAVENNEGRRSKRGARRLKRRRHRIQR VKKLLFDYNLLTDHSELSGINPYEARVKGLSQKLSEEFSAALLHLAKRRGVHNVNEVEEDTGNE LSTKEQISRNSKALEEKYVAELQLERLKKDGEVRGSINRFKTSDYVKEAKQLLKVQKAYHQLDQS FIDTYIDLLETRRTYYEGPGEGSPFGWKDIKEWYEMLMGHCTYFPEELRSVKYAYNADLYNALN DLNNLVITRDENEKLEYYEKFQIIENVFKQKKKPTLKQIAKEILVNEEDIKGYRVTSTGKPEFTNLK VYHDIKDITARKEIIENAELLDQIAKILTIYQSSEDIQEELTNLNSELTQEEIEQISNLKGYTGTHNLSL KAINLLLDELWHTNDNQIAIFNRLKLVPKKVDLSQQKEIPTTLVDDFILSPVVKRSFIQSIKVINAIIK KYGLPNDIIIELAREKNSKDAQKMINEMQKRNRQTNERIEEIIRTTGKENAKYLIEKIKLHDMQEGK CLYSLEAIPLEDLLNNPFNYEVDHIIPRSVSFDNSFNNKVLVKQEENSKKGNRTPQYLSSSDSKISY ETFKKHILNLAKGKGRISKTKEYLLEERDINRFSVQKDFINRNLVDTRYATRGLMNLLRSYFRVN NLDVKVKSINGGFTSFLRRKWFKKERNKGYKHHAEDALIIANADPIFKEWKKLDKAKKVMENQ MFEEKQAESMPEIETEQEYKEIFITPHQIKHIKDFKDYKYSHRVDKKPNRKLINDTLYSTRKDDKG NTLIVNNLNGLYDKDNDKLKLLINKSPEKLLMYHHDPQTYQKLKLIMEQYGDEKNPLYKYEET GNYLTKYSKKDNGPVIKKIKYYGNKLNAHLDITDDYPNSRNKVVKLSLKPYRFDVYLDNGVYKF VTVKNLDVIKKENYYEVNSKCYEEAAKLKKISNQAEFIASFYKNDLIKINGELYRVIGVNNSTRNI VELNMIDITYREYLENMNDKRPPHIIKTIASKTQSIKKYSTDILGNLYEVKSKKHPQIIKKG | N580A | 2239 |
| cCas9-v21 | Staphylococcus aureus | MKRNYILGLDIGITSVGYGIIDYETRDVIDAGVRLFKEAAVENNEGRRSKRGARRLKRRRHRIQR VKKLLFDYNLLTDHSELSGINPYEARVKGLSQKLSEEFSAALLHLAKRRGVHNVNEVEEDTGNE LSTKEQISRNSKALEEKYVAELQLERLKKDGEVRGSINRFKTSDYVKEAKQLLKVQKAYHQLDQS FIDTYIDLLETRRTYYEGPGEGSPFGWKDIKEWYEMLMGHCTYFPEELRSVKYAYNADLYNALN DLNNLVITRDENEKLEYYEKFQIIENVFKQKKKPTLKQIAKEILVNEEDIKGYRVTSTGKPEFTNLK VYHDIKDITARKEIIENAELLDQIAKILTIYQSSEDIQEELTNLNSELTQEEIEQISNLKGYTGTHNLSL KAINLLLDELWHTNDNQIAIFNRLKLVPKKVDLSQQKEIPTTLVDDFILSPVVKRSFIQSIKVINAIIK KYGLPNDIIIELAREKNSKDAQKMINEMQKRNRQTNERIEEIIRTTGKENAKYLIEKIKLHDMQEGK CLYSLEAIPLEDLLNNPFNYEVDHIIPRSVSFDNSFNNKVLVKQEENSKKGNRTPQYLSSSDSKISY ETFKKHILNLAKGKGRISKTKEYLLEERDINRFSVQKDFINRNLVDTRYATRGLMNLLRSYFRVN NLDVKVKSINGGFTSFLRRKWFKKERNKGYKHHAEDALIIANADPIFKEWKKLDKAKKVMENQ MFEEKQAESMPEIETEQEYKEIFITPHQIKHIKDFKDYKYSHRVDKKPNRKLINDTLYSTRKDDKG NTLIVNNLNGLYDKDNDKLKLLINKSPEKLLMYHHDPQTYQKLKLIMEQYGDEKNPLYKYEET GNYLTKYSKKDNGPVIKKIKYYGNKLNAHLDITDDYPNSRNKVVKLSLKPYRFDVYLDNGVYKF VTVKNLDVIKKENYYEVNSKCYEEAAKLKKISNQAEFIASFYKNDLIKINGELYRVIGVNSDDRNII ELNMIDITYREYLENMNDKRPPHIIKTIASKTQSIKKYSTDILGNLYEVKSKKHPQIIKKG | N580A | 2240 |
| cCas9-v42 | Staphylococcus aureus | MKRNYILGLDIGITSVGYGIIDYETRDVIDAGVRLFKEAAVENNEGRRSKRGARRLKRRRHRIQR VKKLLFDYNLLTDHSELSGINPYEARVKGLSQKLSEEFSAALLHLAKRRGVHNVNEVEEDTGNE LSTKEQISRNSKALEEKYVAELQLERLKKDGEVRGSINRFKTSDYVKEAKQLLKVQKAYHQLDQS FIDTYIDLLETRRTYYEGPGEGSPFGWKDIKEWYEMLMGHCTYFPEELRSVKYAYNADLYNALN DLNNLVITRDENEKLEYYEKFQIIENVFKQKKKPTLKQIAKEILVNEEDIKGYRVTSTGKPEFTNLK VYHDIKDITARKEIIENAELLDQIAKILTIYQSSEDIQEELTNLNSELTQEEIEQISNLKGYTGTHNLSL KAINLLLDELWHTNDNQIAIFNRLKLVPKKVDLSQQKEIPTTLVDDFILSPVVKRSFIQSIKVINAIIK KYGLPNDIIIELAREKNSKDAQKMINEMQKRNRQTNERIEEIIRTTGKENAKYLIEKIKLHDMQEGK CLYSLEAIPLEDLLNNPFNYEVDHIIPRSVSFDNSFNNKVLVKQEENSKKGNRTPQYLSSSDSKISY ETFKKHILNLAKGKGRISKTKEYLLEERDINRFSVQKDFINRNLVDTRYATRGLMNLLRSYFRVN | N580A | |

TABLE 9-continued

| Variant | Parental Host | CRISPR/Cas Proteins, Species, and Mutations Protein Sequence | Nickase Mutation | SEQ ID NO: |
|---|---|---|---|---|
| CdiCas9 | Corynebacterium diphtheriae | NLDVKVKSINGGFTSFLRRKMKFKKERNKGYKHHAEDALIIANADFIFKEWKKLDKAKKVMENQ MFEEKQAESMPEIETEQEYKEIFITPHQIKHIKDFKDYKYSHRVDKKPNRKLINDTLYSTRKDDKG NTLIVNNLNGLYDKDNDKLKKLINKSPEKLLMYHHDPQTYQKLKLIMEQYGDEKNPLYKYEET GNYLTKYSKKDNGPVIKKIKYYGNKLNAHLDITDDYPNSRNKVVKLSLKPYRFDVVLDNGVYKF VTVKNLDVIKENYYEVNSKCYEEAAKLKKISNQAEFIASFYKNDLIKINGELYRVIGVNNNRLNK IELNMIDITYREYLENMNDKRPPHIIKTIASKTQSIKKYSTDILGNLYEVKSKKHPQIIKKG<br>MKYHVGIDVGTFSVGLAAIEVDDAGMPIKTLSLVSHIHDSGLDPDEIKSAVTRLASSGIARRTRRL YRRKRRLQQLDKFIQRQGWPVIELEDYSDPLYPWKVRAELAASYIADEKERGEKLSVALRHIAR HRGWRNPYAKVSSLYLPDGPSDAFKAIREEIKRASGQPVPETATVGQMVTLCELGTLKLRGEGGV LSARLQQSDYAREIQEICRMQEIGQELYRKIIDVVFAAESPKGSASSRVGKDPLQPGKNRALKASD AFQRYRIAALIGNLRVRVDGEKRILSVEEKNLVFDHIVNLTPKKEPEWVTIAEILGIDRGQLIGTAT MTDDGERAGARPPTHDTNRSIVNSRIAPLVDWKTASALEQHAMVKALSNAEVDDFDSPEGAK VQAFFADLDDDVHAKLDSLHLPVGRAAYSEDTLVRLTRRMLSDGVDLYTARLQEFGIEPSWTPPT PRIGEPVGNPAVDRVLKTVSRWLESATKTWGAPERVIIEHVREGFVTEKRAREMDGDMRRRAAR NAKLFQEMQEKLNVQGKPSRADLMRYQSVQRONCQCAYCGSPITFSNSEMDHIVPRAGQGSTNT RENLVAVCHRCNQSKGNTPFAIWAKNTSIEGVSVKEAVERTRHWVTDTGMRSTDFKKFTKAVVE RFQRATMDEEIDARSMESVAMMANELRSRVAQHFASHGTTVRVYRGSLITAEFARRASGISGKLKF FDGVGKSRLDRRHHAIDAAVIAFTSDYVAETLAVRSNLKQSQAHRQEAPQWREFTGKDAEHRAA WRVWCQKMEKLSALLTEDLRDDRVVMSNVRLRLGNGSAHKETIGKLSKVLSSQLSVSDIDKA SSEALWCALTREPGFDPKEGLPANPERHIRVNGTHVYAGDNIGLFPVSAGSIALRGGYAELGSSFH HARVYKITSGKKFPAFAMLRVTIDLLPYRNQDLFSVELKPQTMSMRQAEKKLRDALATGNAEYL GWLVVDDELVDTSKIATDGVKLFSDGNVTVVRDSLGRVRLESTAHLPVTWKVQ SKIIDRPGWLPAVNKLFSDGNVTVVRDSLGRVRLESTAHLPVTWKVQ | H573A (Alternate) | 2241 |
| CjeCas9 | Campylobacter jejuni | MARILAFDIGISSIGWAFSENDELKDCGVRIFTKVENPKTGESLALPRRLARSARKRLARRKARLN HLKHLIANEFKLNYEDYQSFDESLAKAYKGSLISPYELRFRALNELLSKQDFARVILHIAKRRGYD DIKNSDDKEKGAILKAIKQNEEKLANYQSVGEYLYKEYFQKFKENSKEFTNVRNKKESYERCIAQ SFLKDELKLIFKKQREFRGFSFSKKFEEVLSVAFYKRALKDFSHLVGNCSFFTDEKRAPKNSPLAFM FVALTRIINLNNLKNTEGILYTKDDLNALLNEVLKNGTLTYKQTKKLLGLSDDYEFKGEKGTYFI EFKKYKEFIKALGEHNLSQDDLNEIAKDITLIKDEIKLKKALAKYDLNQNQIDSLSKLEFKDHLNIS FKALKLVTPLMLEGKVDEACNELNLKVAINEDKDFLPAFNETYYKDEVTNPVVLRAIKEYRK VLNALLKKYGKVHKINIELAREVGKNHSQRAKIEKEQNENYKAKKDAELECEKLGLKINSKNILK LRLFKEQKEFCAYSGEKIKISDLQDEKMLEIDHIYPYSRSFDDSYMNKVLVFTKQNQEKLNQTPFE AFGNDSAKWQKIEVLAKNLPTKKQKRILDKNYKEQKNFKDRNLNDTRYIARLVLNYTKDYLD FLPLSDENTKLNDTQKGSKVHVEAKSGMLTSALRHTWGFSAKDRNNHLHHAIDAVIIAYANNSI VKAFSDFKKEQESNSAELYAKKISELDYKNKRKFFEPFSGFRQKVLDKIDEIFVSKPERKKPSGALH EETFRKEEEFYQSYGGKEGVLKALELGKIRKVNGKIVKNGDMFRVDIFKHKTNKFYAVPIYTMD FALKVLPNKAVARSKKGEIKDWILMDENYEPFCFSLYKDSLILIQTKDMQEPEFVYYNAFTSSTVSLI VSKHDNKFETLSKNQKILFKNANEKEVIAKSIGIQNLKVFEKYIVSALGEVTKAEFRQREDFKK | N582A | 2242 |
| GeoCas9 | Geobacillus stearothermophilus | MRYKIGLDIGITSVGWAVMNLDIPRIEDLGVRIFDRAENPQTGESLALPRRLARSARRRLRRRKHR LERIRRLVIREGILTKEELDKLFEEKHEIDVWQLRVEALDRKLNNDELARVLIHLAKRRGFKSNRK SERSNKENSTMLKHIENRAILSSYYTWGEMIVKDFKALHKRNKGENYTNTIARDDLEREIRLIFS KQREFGNMSCTEFENEYITIWASQRPVASKDDIEKKVGFCTEPEKEKRAPKATYTFQSFIAWEHIN KLRLISPSGARGLTDEERRLLYEQAFQKNKITYHDIRTLLHLPDDTYFKGIVYDRGESRKQNENIRF LELDAYHQIRKAVDKVYGKGKSSSFLPIDFDTFGYALTLFKDDADIHSYLRNEYEQNGKRMPNLA NKVYDNELIEELLNLSFTKFGHLSLKALRSILPYMEQGEVYSSACERAGYTFTGPKKKQKTMLLPN IPPIANPVVMRALTQARKVNAIIKKYGSPVSIHIELARDLSQTFDERRKTKKEQDENRKKNETAIR | N605A | 2243 |

TABLE 9-continued

| Variant | Parental Host | Protein Sequence | Nickase Mutation | SEQ ID NO: |
|---|---|---|---|---|
| | | QLMEYGLTLNPTGHDIVKFKLWSEQNGRCAYSLQPIEIERLLEPGVVEVDHVIPYSRSLDDSYTNK VLVLTRENREKGNRIPAEYLGVGTERWQQFETFVLTNKQFSKKKRDRLLLRLHYDENEETEPKNRN LNDTRYISRFFANFIREHLKFAESDKQKVVTVNGRVTAHLRSRWEFNKNREESDLHHAVDAVIV ACTTPSDIAKVTAFYQRREQNKELAKKTEPHFPQPWPHFADELRARLSKHPKESIKALNLGNYDD QKLESLQPVFVSRMPKRSVTGAAHQETLRRYVGIDERSGKIQTVVKTKLSEIKLDASGHFPMYGK ESDPRTYEAIRQRLLEHNNDPKKAFQEPLYKPKKNGEPGPVIRTVKIIDTKNQVIPLNDGKTVAYN SNIVRVDVFEKDGKYYCVPVYTMDIMKGILPNKAIEPNKPYSEWKEMTEDYTFRESLYPNDLIRIE LPREKTVKTAAGEEINVKDVFVYKTIDSANGGLELISHDHRFSLRGVGSRTLKRFEKYQVDVLG NIYKVRGEKRVGLASSAHSKPGKTIRPLQSTRD | | |
| iSpyMacCas9 | Streptococcus spp. | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRKLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEBLLVKLKRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGRHKPENIVIEMARENQTTQKGQKNSRERMKRIEEGIKELG SQILKEHPVENTQLQNEKLYLYLQNGRDMVVDQELDINRLSDYDVDHIVPQSFLKDDSIDNKVL TRSDKNRGKSDNVPSEEVVKKMRNYWRQLLNAKLITQRKFDNLTKAERGGLSELDKAGFIKRQL VETRQITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFPKTEITL ANGEIRKRPLIETNGETGEIVWDKGRDFATVRKVLSMPQVNIVKKTEIQTVGQNGGLFDDNPKSPL EVTPSKLVPLKKELNPKKYGGYQKPTTAYPVLLITDTKQLIPISVMNKQFEQNPVKFLRDRGYQQ VGKNDFIKLPKYTLVDIGDGIKRLWASSKEIHKGNQLVVSKKSQILLYHAHHLDSDLSNDYLQNH NQQFDVLFNEIISFSKKCKLGKEHIQKIENVYSNKKNSASIEELAESFIKLLGFTQLGATSPFNFLGV KLNQKQYKGKKDYILPCTEGTLIRQSITGLYETRVDLSKIGEDSGSGSGSKRTADGSEFES | N863A | 2244 |
| NmeCas9 | Neisseria meningitidis | MAAFKPNSINYILGLDIGIASVGWAMVEIDEEENPIRLIDLGVRVFERAEVPKTGDSLAMARRLAR SVRRLTRRAHLLRTRRLKREGVLQAANFDENGLIKSLPNTPWQLRAAALDRKLTPLEWSAVL LHLIKHRGYLSQRKNEGETADKELGALLKGVAGNAHALQTGDFRTPAELALNKFEKESGHIRNQR SDYSHTFSRKDLQAELILTKLMLTQRPALSGDAVOKMLGHCTFEP AEPKAAKNTYTAERFIWLTKLNNLRILEQGSERPLTDTERATLMDEPYRKSKLTYAQARKLLGLE DTAFFKGLRYGKDNAEASTLMEMKAYHAISRALEKEGLKDKKSPLNLSPELQDEIGTAFSLFKTD EDITGRLKDRIQPEILEALLKHISFDKFVQLSLKALRRIVPLMEQGKRYDEACAEIYGDHYGKKNTE EKIYLPPIPADEIRNPVVLRALSQARKVINGVVRRYGSPARIHIETAREVGKSFKDRKEIEKRQEENR KDREKAAAKFREYFPNFVGEPKSKDIIKLRLYEQQHGKCLYSGKEINLGRLNEKGVEIDHALPFS RTWDDSFNNKVLVLGSENQNKGNQTPYEYFNGKDNSREWQEFKARVETSRFPRSKKQRILLQKF DEDGFKERNLNDTRYVNRFLCQFVADRMRLTGKGKKRVFASNGQITNLLRGFWGLRKVRAEND RHHALDAVVVACSTVAMQQKITRFVYKEMNAFDGKTIDKETGEVLHQKTHFPQPWEFFAQEV MIRVFGKPDGKPEFEEADTLEKLRTLLAEKLSSRPEAVHEYVTPLFVSRAPNRKMSGQGHMETVK SAKRLDEGVSVLRVPLTQLKLKDLEKMVNRERPKLYEAUKARLEAHKDDPAKAFAEPFYKDK AGNRTQQVKAVREQVQKTGWVRNHNGIADNATMVRVDVFEKGDKYYLVPIYSWQVAKGIL PDRAVVQGKDEEDWQLIDDSFNFKFSLHPNDLVEVITKKARMFGYPASCHRGTGNINIRIHDLDH KIGKNGILEGIGVKTALSFQKYQIDELGKEIRPCRLKKRPPVR | N611A | 2245 |

TABLE 9-continued

CRISPR/Cas Proteins, Species, and Mutations

| Variant | Parental Host | Protein Sequence | Nickase Mutation | SEQ ID NO: |
|---|---|---|---|---|
| ScaCas9 | Streptococcus canis | MEKKYSIGLDIGTNSVGWAVITDDYKVPSKKFKVLGNTNRKSIKKNLMGALLFDSGETAEATRLK RTARRRYTRRKNRIRYLQEIFANEMAKLDDSFFQRLEESFLVEEDKKNERHPIFGNLADEVAYHRN YPTIYHLRKKLADSPEKADLRLIYLALAHIIKFRGHFLIEGKLNAENSDVAKLFYQLIQTYNQLFEE SPLDEIEVDAKGILSARLSKSRRLEKLIAVPPNEKKNGLFGNIIALALGLTPNFKSNFDLTEDAKLQL SKDTYDDDLDELLGQIGDQYADLFSAAKNLSDAILLSDILRSNSEVTKAPLSASMVKRYDEHHQD LALLKTLVRQQFPEKYAEIFKDDTKNGYAGVVGIKHRKRTTKLATQEEFYKFIKPILEKMDGAE ELLAKLNRDDLLRKQRTFDNGSIPHQIHLKELHAILRRQEEFYPFLKENREKIEKILTFRIPYYVGPL ARGNSRFAWLTRKSEEAITPNFEEVVDKGASAQSFIERMTNFDEQLPNKKVLPKHSLLYEYFTV YNELTKVKYVTERMRKPEFLSGEQKKAIVDLLFKTNRKVTVKQLKEDYFKKIECFDSVEIIGVEDR FNASLGTYHDLLKIIKDKDFLDNEENEDILEDIVLTLFEDREMIEERLKTYAHLFDDKVMKQLK RRHYTGWGRLSRKMINGIRDKQSGKTILDFLKSDGFSNRNFMQLIHDDSLTFKEEIEKAQVSGQGD SLHEQIADLAGSPAIKKGILQTVKIVDELVKVMGHKPENIVIEMARENQTTTKGLQQSRERKKRIEE GIKELESQILKENPVENTQLQNEKLYLYYLQNGRDMVDQELDINRLSDYDVDHIVPQSFIKDDSI DNKVLTRSVENRGKSDNVPSEEVVKMKNYWRQLLNAKLITQRKFPDNLTKAERGGLSEADKAG FIKRQLVETRQITKHVARILDSRMNTKRDKNDKPIREVKVITLKSKLVSDFRKDFQLYKVRDINNY HHAHDAYLNAVVGTALIKKYPKLESEFVYGDYKVDVRKMIAKSEQEIGKATAKRFFYSNIMNF FKTEVKLANGEIRKRPLIETNGETGEVVWNKEKDFATVRKVLAMPQVNIVKKTEVQTGGFSKESI LSKRESAKLIPRKKGWDTRKYGGFGSPTVAYSILVVAKVEKGKAKLKSVKVLVGITIMEKGSYE KDPIGFLEAKGYKDIKKELIFKLPKYSLFELENGRRRMLASATELQKANELVLPQHLVRLLIYTQN ISATTGSNNLGYIEQHREEFKEIFEKIIDFSEKYILKNKVNSNLKSSFDEQFAVSDSILLSNSFVSLLK YTSFGASGGFTFLDLDVKQGRLRYQTVTEVLDATLIYQSITGLYETRTDLSQLGGD | N872A | 2246 |
| ScaCas9-HiFi-Sc++ | Streptococcus canis | MEKKYSIGLDIGTNSVGWAVITDDYKVPSKKFKVLGNTNRKSIKKNLMGALLFDSGETAEATRLK RTARRRYTRRKNRIRYLQEIFANEMAKLDDSFFQRLEESFLVEEDKKNERHPIFGNLADEVAYHRN YPTIYHLRKKLADSPEKADLRLIYLALAHIIKFRGHFLIEGKLNAENSDVAKLFYQLIQTYNQLFEE SPLDEIEVDAKGILSARLSKSRRLEKLIAVPPNEKKNGLFGNIIALALGLTPNFKSNFDLTEDAKLQL SKDTYDDDLDELLGQIGDQYADLFSAAKNLSDAILLSDILRSNSEVTKAPLSASMVKRYDEHHQD LALLKTLVRQQFPEKYAEIFKDDTKNGYAGVVGADKKLRKRSGKLATEEEFYKFIKPILEKMDGA EELLAKLNRDDLLRKQRTFDNGSIPHQIHLKELHAILRRQEQEFYPFLKENREKIEKILTFRIPYYVGP LARGNSRFAWLTRKSEEAITPWNFEEVVDKGASAQSFIERMTNFDEQLPNKKVLPKHSLLYEYFT VYNELTKVKYVTERMRKPEFLSGEQKKAIVDLLFKTNRKVTVKQLKEDYFKKIECFDSVEIIGVED RFNASLGTYHDLLKIIKDKDFLDNEENEDILEDIVLTLFEDREMIEERLKTYAHLFDDKVMKQL KRRHYTGWGRLSRKMINGIRDKQSGKTILDFLKSDGFSNANFMQLIHDDSLTFKEEIEKAQVSGQ GDSLHEQIADLAGSPAIKKGILQTVKIVDELVKVMGHKPENIVIEMARENQTTTKGLQQSRERKR IEEGIKELESQILKENPVENTQLQNERDMVYDQELDINRLSDYDVDHIVPQSFIKD DSIDNKVLTRSVENRGKSDNVPSEEVVKKMKNYWRQLLNAKLITQRKFPDNLTKAERGGLSEADK AGFIKRQLVETRQITKHVARILDSRMNTKRDKNDKPIREVKVITLKSKLVSDFRKDFQLYKVRDIN NYHHAHDAYLNAVVGTALIKKYPKLESEFVYGDYKVDVRKMIAKSEQEIGKATAKRFFYSNIM NFFKTEVKLANGEIRKRPLIETNGETGEVVWNKEKDFATVRKVLAMPQVNIVKKTEVQTGGFSKE SILSKRESAKLIPRKKGWDTRKYGGFGSPTVAYSILVVAKVEKGKAKLKSVKVLVGITIMEKGSY EKDPIGFLEAKGYKDIKKELIFKLPKYSLFELENGRRRMLASAKELQKANELVLPQHLVRLLIYTQ NISATTGSNNLGYIEQHREEFKEIFEKIIDFSEKYILKNKVNSNLKSSFDEQFAVSDSILLSNSFVSLL KYTSFGASGGFTFLDLDVKQGRLRYQTVTEVLDATLIYQSITGLYETRTDLSQLGGD | N872A | 2247 |
| SpyCas9-3var-NRRH | Streptococcus pyogenes | MDKKYSIGLDIGTNSVGWAVITDEYKVPSKKFKVLGNTDRHSIKKNLIGALLFDSGETARATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ | N863A | 2248 |

TABLE 9-continued

CRISPR/Cas Proteins, Species, and Mutations

| Variant | Parental Host | Protein Sequence | Nickase Mutation | SEQ ID NO: |
|---|---|---|---|---|
| SpyCas9-3var-NRTH | | LSKDTYDDDLDNLLAQIGDQYADLFLAAKNLSDAILLSDILRVNTEITKAPLSASMVKRYDEHHQ DLTLLKALVRQQLPEKYKEIFFDQSKNGYAGYIDGGASQEEFYKFIKPILEKMDGTEELLVKLNRE DLLRKQRTFDNGIIPHQIHLGELHAILRRQGDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRLRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGGHKPENIVIEMARENQTTQKGQKNSRERMKRIEEGIKELG SQILKEHPVENTQLQNEKLYLYLQNGRDMVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIWDKGRDFATVRKVLSMPQVNIVKKTEVQTGGFSKESILPKGNSDK LIARKKDWDPKKYGGFNSPTAAYSVLVVAKVEKGKSKKLKSVKELLGITIMERSSFEKNPIGFLEA KGYKEVKKDLIIKLPKYSLFELENGRKRMLASASVLHKGNELALPSKYVNFLYLASHYEKLKGSP EDNEQKQLFVEQHKHYLDEIIEQISEFSKRVILADANLDKVLSAYNKHRDKPIREQAENIIHLFTLT NLGVPAAFKYFDTTIDKKRYTSTKEVLDATLIHQSITGLYETRIDLSQLGGD | | |
| | | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMVKRYDEHHQ DLTLLKALVRQQLPEKYKEIFFDQSKNGYAGYIDGGASQEEFYKFIKPILEKMDGTEELLVKLNRE DLLRKQRTFDNGIIPHQIHLGELHAILRRQGDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRLRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGGHKPENIVIEMARENQTTQKGQKNSRERMKRIEEGIKELG SQILKEHPVENTQLQNEKLYLYLQNGRDMVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIWDKGRDFATVRKVLSMPQVNIVKKTEVQTGGFSKESILPKGNSDK LIARKKDWDPKKYGGFNSPTVAYSVLVVAKVEKGKSKKLKSVKELLGITIMERSSFEKNPIGFLEA KGYKEVKKDLIIKLPKYSLFELENGRKRMLASASVLHKGNELALPSKYVNFLYLASHYEKLKGSS EDNKQKQLFVEQHKHYLDEIIEQISEFSKRVILADANLDKVLSAYNKHRDKPIREQAENIIHLFTLT NLGASAAFKYFDTTIGRKLYTSTKEVLDATLIHQSITGLYETRIDLSQLGGD | N863A | 2249 |
| SpyCas9-3var-NRCH | Streptococcus pyogenes | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMVKRYDEHHQ DLTLLKALVRQQLPEKYKEIFFDQSKNGYAGYIDGGASQEEFYKFIKPILEKMDGTEELLVKLNRE DLLRKQRTFDNGIIPHQIHLGELHAILRRQGDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY | N863A | 2250 |

TABLE 9-continued

CRISPR/Cas Proteins, Species, and Mutations

| Variant | Parental Host | Protein Sequence | Nickase Mutation | SEQ ID NO: |
|---|---|---|---|---|
| | | HDLLKIIKDKDFPLDNEENEDILEDIVLTLTLFEDREMIEERLKTYAHLFDDKVMKQLKRLRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGGHKPENIVIEMARENQTTQKGQKNSRERMKRIEEGIKELG SQILKEHPVENTQLQNEKLYLYYLQNGRDMVVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKGNSDK LIARKKDWDPKKYGGFNSPTVAYSVLVVAKVEKGKSKKLKSVKELLGITIMERSSFEKNPIDFLEA KGYKEVKKDLIIKLPKYLSFELENGRKRMLASAGVLQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPAAFKYFDTTINRKQYNTTKEVLDATLIRQSITGLYETRIDLSQLGGD | | |
| SpyCas9-HF1 | Streptococcus pyogenes | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDSLTFKEDIQKAQVSGQGDSLHEHIANL AGSPAIKKGILQTVKVVDELVKVMGRHKPENIVIEMARENQTTQKGQKNSRERMKRIEEGIKELG SQILKEHPVENTQLQNEKLYLYYLQNGRDMVVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKRNSDK LIARKKDWDPKKYGGFDSPTVAYSVLVVAKVEKGKSKKLKSVKELLGITIMERSSFEKNPIDFLEA KGYKEVKKDLIIKLPKYSLFELENGRKRMLASAGELQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPAAFKYFDTTIDRKRYTSTKEVLDATLIHQSITGLYETRIDLSQLGGD | N863A | 2232 |
| SpyCas9-QQR1 | Streptococcus pyogenes | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFPLDNEENEDILEDIVLTLTLFEDREMIEERLKTYAHLFDDKVMKQLKRLRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGGHKPENIVIEMARENQTTQKGQKNSRERMKRIEEGIKELG SQILKEHPVENTQLQNEKLYLYYLQNGRDMVVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL | N863A | 2252 |

TABLE 9-continued

CRISPR/Cas Proteins, Species, and Mutations

| Variant | Parental Host | Protein Sequence | Nickase Mutation | SEQ ID NO: |
|---|---|---|---|---|
| | | VETRQITKHVAQILDSRMNTKYDENDKLIREVKVITLKSKLVSDFRKDFQFYKVREINNYHHAHD AYLNAVVGTALIKKYPKLESEFVYGDYKVDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKRNSDK LIARKKDWDPKKYGGFDSPTVAYSVLVVAKVEKGKSKKLKSVKELLGITIMERSSFEKNPIDFLEA KGYKEVKKDLIIKLPKYSLFELENGRKRMLASAREIQKGNELALPSKYVNFLYLASHYEKLKGSP EDNEQKQLFVEQHKHYLDEIIEQISEFSKRVILADAQLDKVLSAYNKHRDKPIREQAENIIHLFTLT NLGAPAAFKYFDTTFKQYRSTKEVLDATLIHQSITGLYETRIDLSQLGGD | | |
| SpyCas9-SpG | Streptococcus pyogenes | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEBLLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVKHPVENTQLQNEKLYLYLQNGRDMVVDQELDINRLSDYDVDHIVPQSFLKDDSIDNKVL SQILKEHPVENTQLQNEKLYLYLQNGRDMVVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLKSKLVSDFRKDFQFYKVREINNYHHAHD AYLNAVVGTALIKKYPKLESEFVYGDYKVDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKRNSDK LIARKKDWDPKKYGGFDSPTVAYSVLVVAKVEKGKSKKLKSVKELLGITIMERSSFEKNPIDFLEA AKGYKEVKKDLIIKLPKYSLFELENGRKRMLASAKQLQKGNELALPSKYVNFLYLASHYEKLKGS PEDNEQKQLFVEQHKHYLDEIIEQISEFSKRVILADANLDKVLSAYNKHRDKPIREQAENIIHLFTLT NLGAPAAFKYFDTTIDRKQYRSTKEVLDATLIHQSITGLYETRIDLSQLGGD | N863A | 2253 |
| SpyCas9-VQR | Streptococcus pyogenes | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEBLLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTIDFLKSDGFANRNFMQLIHDDSLTFKEDIQKAQVSGQGDSLHEHIANL AGSPAIKKGILQTVKVKHPVENTQLQNEKLYLYLQNGRDMVVDQELDINRLSDYDVDHIVPQSFLKDDSIDNKVL SQILKEHPVENTQLQNEKLYLYLQNGRDMVVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLKSKLVSDFRKDFQFYKVREINNYHHAHD AYLNAVVGTALIKKYPKLESEFVYGDYKVDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKRNSDK LIARKKDWDPKKYGGFDSPTVAYSVLVVAKVEKGKSKKLKSVKELLGITIMERSSFEKNPIDFLEA KGYKEVKKDLIIKLPKYSLFELENGRKRMLASAGELQKGNELALPSKYVNFLYLASHYEKLKGSP | N863A | 2254 |

TABLE 9-continued

CRISPR/Cas Proteins, Species, and Mutations

| Variant | Parental Host | Protein Sequence | Nickase Mutation | SEQ ID NO: |
|---|---|---|---|---|
| | | EDNEQKQLFVEQHKHYLDEIIEQISEFSKRVILADANLDKVLSAYNKHRDKPIREQAENIIHLFTLT NLGAPAAFKYFDTTIDRKQYRSTKEVLDATLIHQSITGLYETRIDLSQLGGD | | |
| SpyCas9-VRER | Streptococcus pyogenes | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEKVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECPDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGRHKPENIVIEMARENQTTQKGQKNSRERMKRIEEGIKELG SQILKEHPVENTQLQNEKLYLYYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKRNSDK LIARKKDWDPKKYGGFVSPTVAYSVLVVAKVEKGKSKKLKSVKELLGITIMERSSFEKNPIDFLEA KGYKEVKKDLIIKLPKYSLFELENGRKRMLASAREIQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPAAFKYFDTTIDRKEYRTSTKEVLDATLIHQSITGLYETRIDLSQLGGD | N863A | 2255 |
| SpyCas9-xCas | Streptococcus pyogenes | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDTKLQ LSKDTYDDDLDNLLAQIGDQYADLFLAAKNLSDAILLSDILRVNTEITKAPLSASMIKLYDEHHQD LTLLKALVRQQLPEKYKEIFFDQSKNGYAGYIDGGASQEEFYKFIKPILEKMDGTEELLVKLNRED LLRKQRTFDNGIIPHQIHLGELHAILRRQEDFYPFLKDNRREKIEKILTFRIPYYVGPLARGNSRFAW MTRKSEETITPWNFEKVVDKGASAQSFIERMTNFDKNLPNEKVLPKHSLLYEYFTVYNELTKVKY VTEGMRKPAFLSGDQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFIQLIHDDSLTFKEDIQKAQVSGQGDSLHEHIANL AGSPAIKKGILQTVKVVDELVKVMGRHKPENIVIEMARENQTTQKGQKNSRERMKRIEEGIKELG SQILKEHPVENTQLQNEKLYLYYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKRNSDK LIARKKDWDPKKYGGFDSPTVAYSVLVVAKVEKGKSKKLKSVKELLGITIMERSSFEKNPIDFLEA KGYKEVKKDLIIKLPKYSLFELENGRKRMLASAGVLQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPAAFKYFDTTIDRKRYTSTKEVLDATLIHQSITGLYETRIDLSQLGGD | N863A | 2256 |
| SpyCas9-xCas-NG | Streptococcus pyogenes | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY | N863A | 2257 |

TABLE 9-continued

CRISPR/Cas Proteins, Species, and Mutations

| Variant | Parental Host | Protein Sequence | Nickase Mutation | SEQ ID NO: |
|---|---|---|---|---|
| | | PTIYHLRKKLVDSTDKADLRLIYLALAHMIKFRGHFLIEGDLNPDNSDVDKLFIQLVQTYNQLFEE<br>NPINASGVDAKAILSARLSKSRRLENLIAQLPGEKKNGLFGNLIALSLGLTPNFKSNFDLAEDTKLQ<br>LSKDTYDDDLDNLLAQLGDQYADLFLAAKNLSDAILLSDILRVNTEITKAPLSASMIKLYDEHHQD<br>LTLLKALVRQQLPEKYKEIFFDQSKNGYAGYIDGGASQEEFYKFIKPILEKMDGTEELLVKLNRED<br>LLRKQRTFDNGIIPHQIHLGELHAILRRQEDFYPFLKDNREKIEKILTFRIPYYVGPLARGNSRFAM<br>MTRKSEETITPWNFEKVVDKGASAQSFIERMTNFDKNLPNEKVLPKHSLLYEYFTVYNELTKVKY<br>VTEGMRKPAFLSGDQKKAIVDLLFKTNRKVTVKQLKEDYFKKIECFDSVEISGVEDRFNASLGTY<br>HDLLKIIKDKDFLDNEENEDILEDIVLTLTLFEDREMIEERLKTYAHLFDDKVMKQLKRRRYTGWG<br>RLSRKLINGIRDKQSGKTILDFLKSDGFANRNFIQLIHDDSLTFKEDIQKAQVSQGQDSLHEHIANL<br>AGSPAIKKGILQTVKVVDELVKVMGRHKPENIVIEMARENQTTQKGQKNSRERMKRIEEGIKELG<br>SQILKEHPVENTQLQNEKLYLYLYQNGRDMVDQELDINRLSDYDVDHIVPQSFLKDDSIDNKVL<br>TRSDKNRGKSDNVPSEEVVKKMKNYWRQLLNAKLITQRKFDNLTKAERGGLSELDKAGFIKRQL<br>VETRQITKHVAQILDSRMNTKYDENDKLIREVKVITLKSKLVSDFRKDFQFYKVREINNYHHAHD<br>AYLNAVVGTALIKKYPKLESEFVYGDYKVYDVRKMIAKSEQEIGKATAKYFFYSNIMNFKTEITL<br>ANGEIRKRKPLIETNGETGEIVWDKGRDFATVRKVLSMPQVNIVKKTEVQTGGFSKESIRPKRNSDK<br>LIARKDWDPKKYGGFVSPTVAYSVLVVAKVEKGKSKKLKSVKELLGITIMERSSFEKNPIDFLEA<br>KGYKEVKKDLIIKLPKYSLFELENGRKRMLASARFLQKGNELALPSKYVNFLYLASHYEKLKGSP<br>EDNEQKQLFVEQHKHYLDEIIEQISEFSKRVILADANLDKVLSAYNKHRDKPIREQAENIIHLFTLT<br>NLGAPRAFKYFDTTIDRKVFRSTKEVLDATLIHQSITGLYETRIDLSQLGGD | | |
| St1Cas9-<br>CNRZ1066 | Streptococcus<br>thermophilus | MSDLVLGLDIGIGSVGVGIILNKVTGEIIHKNSRIFPAAQAENNLVRRTNRQGRRLARRKKHRRVRL<br>NRLFEESGLITDFTKISINLNPYQLRVKGLTDELSNEELFIALKNMVKHRGISYLDDASDDGNSSVG<br>DYAQIVKENSKQLETKTPGQIQLERYQTYGQLRGDFTVEKDGKKHRLINVFPTSAYRSEALRILQT<br>QQEFNPQITDEFINRYLEILTGKRKYHGPGNEKSRTDYGYRTSGETLDNIFGILIGKCTFYPDEFR<br>AAKASYTAQEFNLLNDLNNLIVPTETKKLSKEQKNQIINVVKNEKAMGPAKLFKYIAKLLSCDVA<br>DIKGYRIDKSGKAEIHTFEAYRKMKTLETLDIEQMDRETLDKLAVVLTLNTEREGIQEALEHEFAD<br>GSFSQKQVDELVQFRKANSSIFGKGWHNFSVKLMMELIPELYETSBEQMTILTRLGKQKTTSSSNK<br>TKYIDEKLLTEEIYNPVVAKSVRQAIKIVNAAIKEYGDFDNIVIEMARETNEDDEKKAIQKIQKANK<br>DEKDAAMLKAANQYNGKAELPHSVFHGHKQLATKIRLWHQQGERCLYTGKTISIHDLINNSNQF<br>EVDHILPLSITFDDSLANKVLVYATANQEKGQRTPYQALDSMDDAWSFRELKAFVRESKTLSNKK<br>KEYLLTEEDISKFDVRKKFIERNLVDTRYASRVVLNALQEHPRAAHKIDTKVSVVRGQFTSQLRRH<br>WGIEKTRDTYHHHAVDALIIAASSQLNLWKKQKNTLVSYSEEQLLDIETGELISDDEYKESVFKAP<br>YQHFVDTLKSKEFEDSILFSYQVDSKFPNRKISDATIYATRQAKVGKDKKDETYVLGKIKDIYTQDG<br>YDAFMKIYKKDKSKFLMYRHDPQTFBKVIEPILENYPNKQMNEKGKEVPCNPFLKYKEEHGYIRK<br>YSKKGNGPEIKSLKYIKSQEKYNDLKKEGVDSDEFFKTLYKNDLLLVDTETKEQQLFRFLSRTLPKQ<br>KHYVELKPYDKQKFEGGEALIKVLGNVANGGQCIKGLAKSNISIYKVRTDVLGNQHIIKNEGDKP<br>KLDF | N622A | 2258 |
| St1Cas9-<br>LMG1831 | Streptococcus<br>thermophilus | MSDLVLGLDIGIGSVGVGIILNKVTGEIIHKNSRIFPAAQAENNLVRRTNRQGRRLARRKKHRRVRL<br>NRLFEESGLITDFTKISINLNPYQLRVKGLTDELSNEELFIALKNMVKHRGISYLDDASDDGNSSVG<br>DYAQIVKENSKQLETKTPGQIQLERYQTYGQLRGDFTVEKDGKKHRLINVFPTSAYRSEALRILQT<br>QQEFNPQITDEFINRYLEILTGKRKYHGPGNEKSRTDYGYRTSGETLDNIFGILIGKCTFYPDEFR<br>AAKASYTAQEFNLLNDLNNLIVPTETKKLSKEQKNQIINVVKNEKAMGPAKLFKYIAKLLSCDVA<br>DIKGYRIDKSGKAEIHTFEAYRKMKTLETLDIEQMDRETLDKLAVVLTLNTEREGIQEALEHEFAD<br>GSFSQKQVDELVQFRKANSSIFGKGWHNFSVKLMMELIPELYETSBEQMTILTRLGKQKTTSSSNK<br>TKYIDEKLLTEEIYNPVVAKSVRQAIKIVNAAIKEYGDFDNIVIEMARETNEDDEKKAIQKIQKANK<br>DEKDAAMLKAANQYNGKAELPHSVFHGHKQLATKIRLWHQQGERCLYTGKTISIHDLINNSNQF<br>EVDHILPLSITFDDSLANKVLVYATANQEKGQRTPYQALDSMDDAWSFRELKAFVRESKTLSNKK | N622A | 2259 |

TABLE 9-continued

CRISPR/Cas Proteins, Species, and Mutations

| Variant | Parental Host | Protein Sequence | Nickase Mutation | SEQ ID NO: |
|---|---|---|---|---|
| St1Cas9-MTH17CL396 | Streptococcus thermophilus | MSDLVLGLDIGIGSVGVGILNKVTGEIIHKNSRIFPAAQAENNLVRTNRQGRRLARRKKHRRVRL NRLFEESGLIITDFTKLISINLNPYQLRVKGLTDELSNEELFIALKNMVKHRGISYLDDASDDGNSSVG DYAQIVKENSKQLETKTPGQIQLERYQTYGQLRGDFTVEKDGKKHRLINVFPTSAYRSEALRILQT QQEFNPQITDEFINRYLEILTGKRKYYHGPGNEKSRTDYGRYRTSGETLDNIFGILIGKCTFYPDEFR AAKASYTAQEFNLLNDLNNLTVPTETKKLSKEQKNQIINYVKNEKAMGPAKLFKYIAKLLSCDVA DIKGYRIDKSGKAEIHTFEAYRKMKTLETLDIEQMDRETLDKLAYVLTLNTEREGIQEALEHEFAD GSFSQKQVDELVQFRKANSSIFGKGWHNFSVKLMMELIPELYETSEEQMTILTRLGKQKTTSSSNK TKYIDEKLLTEEIYNPVVAKSVRQAIKIVNAAIKEYGDFDNIVIEMARETNEDDEKKAIQKIQKANK DEKDAAMLKAANQYNGKAELPHSVFHGHKQLATKIRLMHQQGERCLYTGKTISIHDLINNSNQF EVDHILPLSITFDDSLANKVLVYATANQEKGQRTPYQALDSMDDAWSFRELKAFVRESKTLSNKK KEYLLTEEDISKFDVRKKFIERNLVDTRYASRVVLNALQEHFRAHKIDTKVSVRGQFTSQLRRH WGIEKTRDTYHHAVDALIIAASSQLNLWKKQKNTLVSYSEDQLLDIETGELISDDEYKESVFKAP YQHFVDTLKSKEFEDSILFSYQVDSKFNRKISDATIYATRQAKVGDKADETYVLGKIKDIYTQDG YDAFMKIYKKDKSKFLMYRHDPQTFEKVIEPILENYPNKQINEKGKEVPCNPFLKYKEEHGYIRKY SKKGNGPEIKSLKYDSKLGNHIDITPKDSNNKVVLQSLKPWRTDVYFNKNTGKYEILGLKYSDM QFEKGTGKYSISKEQYENIKVREGVDENSEFKFTLYKNDLLLLKDSENGEQILLRFTSRNDTSKHY VELKPYNRQKFEGSEYLIKSLGTVAKGGCIKGLGKSNISIYKVRTDVLGNQHIIKNEGDKPKLDF | N622A | 2260 |
| St1Cas9-TH1477 | Streptococcus thermophilus | MSDLVLGLDIGIGSVGVGILNKVTGEIIHKNSRIFPAAQAENNLVRTNRQGRRLARRKKHRRVRL NRLFEESGLIITDFTKLISINLNPYQLRVKGLTDELSNEELFIALKNMVKHRGISYLDDASDDGNSSVG DYAQIVKENSKQLETKTPGQIQLERYQTYGQLRGDFTVEKDGKKHRLINVFPTSAYRSEALRILQT QQEFNPQITDEFINRYLEILTGKRKYYHGPGNEKSRTDYGRYRTSGETLDNIFGILIGKCTFYPDEFR AAKASYTAQEFNLLNDLNNLTVPTETKKLSKEQKNQIINYVKNEKAMGPAKLFKYIAKLLSCDVA DIKGYRIDKSGKAEIHTFEAYRKMKTLETLDIEQMDRETLDKLAYVLTLNTEREGIQEALEHEFAD GSFSQKQVDELVQFRKANSSIFGKGWHNFSVKLMMELIPELYETSEEQMTILTRLGKQKTTSSSNK TKYIDEKLLTEEIYNPVVAKSVRQAIKIVNAAIKEYGDFDNIVIEMARETNEDDEKKAIQKIQKANK DEKDAAMLKAANQYNGKAELPHSVFHGHKQLATKIRLMHQQGERCLYTGKTISIHDLINNSNQF EVDHILPLSITFDDSLANKVLVYATANQEKGQRTPYQALDSMDDAWSFRELKAFVRESKTLSNKK KEYLLTEEDISKFDVRKKFIERNLVDTRYASRVVLNALQEHFRAHKIDTKVSVRGQFTSQLRRH WGIEKTRDTYHHAVDALIIAASSQLNLWKKQKNTLVSYSEDQLLDIETGELISDDEYKESVFKAP YQHFVDTLKSKEFEDSILFSYQVDSKFNRKISDATIYATRQAKVGDKADETYVLGKIKDIYTQDG YDAFMKIYKKDKSKFLMYRHDPQTFEKVIEPILENYPNKQINEKGKEVPCNPFLKYKEEHGYIRKY SKKGNGPEIKSLKYDSKLGNHIDITPKDSNNKVVLQSLKPWRTDVYFNKNTGKYEILGLKYSDM QFEKGTGKYSISKEQYENIKVREGVDENSEFKFTLYKNDLLLLKDSENGEQILLRFTSRNDTSKHY VELKPYNRQKFEGSEYLIKSLGTVVKGGRCIKGLGKSNISIYKVRTDVLGNQHIIKNEGDKPKLDF | N622A | 2261 |

Table 9B provides parameters to define the necessary components for designing gRNA and/or Template RNAs to apply Cas variants listed in Table 3A for Gene Writing. Tier indicates preferred Cas variants if they are available for use at a given locus. The cut site indicates the validated or predicted protospacer adjacent motif (PAM) requirements, validated or predicted location of cut site (relative to the most upstream base of the PAM site). The gRNA for a given enzyme can be assembled by concatenating the crRNA, Tetraloop, and tracrRNA sequences, and further adding a 5' spacer of a length within Spacer (min) and Spacer (max) that matches a protospacer at a target site. Further, the predicted location of the ssDNA nick at the target is important for designing the 3' region of a Template RNA that needs to anneal to the sequence immediately 5' of the nick in order to initiate target primed reverse transcription.

TABLE 9B parameters to define the necessary components for designing gRNA and/or Template RNAs to apply Cas variants listed in Table 9A for Gene Writing

| Variant | PAM(s) | Cut | Tier | Spacer (min) | Spacer (max) | crRNA | Tetraloop | tracrRNA |
|---|---|---|---|---|---|---|---|---|
| Nme2Cas9 | NNNNCC | -3 | 1 | 22 | 24 | GTTGTAGCTCC CTTTCTCATTT CG (SEQ ID NO: 2262) | GAAA | CGAAATGAGAACCG TTGCTACAATAAGG CCGTCTGAAAAGAT GTGCCGCAACGCTC TGCCCCTTAAAGCTT CTGCTTTAAGGGGC ATCGTTTA (SEQ ID NO: 2274) |
| PpnCas9 | NNNNRTT | | 1 | 21 | 24 | GTTGTAGCTCC CTTTTTCATTT CGC (SEQ ID NO: 2263) | GAAA | GCGAAATGAAAAAC GTTGTTACAATAAG AGATGAATTTCTCGC AAAGCTCTGCCTCTT GAAATTTCGGTTTCA AGAGGCATCTTTTT (SEQ ID NO: 2275) |
| SauCas9 | NNGRR; NNGRRT | -3 | 1 | 21 | 23 | GTTTTAGTACT CTG (SEQ ID NO: 2264) | GAAA | CAGAATCTACTAAA ACAAGGCAAAATGC CGTGTTTATCTCGTC AACTTGTTGGCGAG A (SEQ ID NO: 2276) |
| SauCas9-KKH | NNNRR; NNNRRT | -3 | 1 | 21 | 21 | GTTTTAGTACT CTGTAAT (SEQ ID NO: 2265) | GAAA | ATTACAGAATCTACT AAAACAAGGCAAAA TGCCGTGTTTATCTC GTCAACTTGTTGGCG AGA (SEQ ID NO: 2277) |
| SauriCas9 | NNGG | -3 | 1 | 21 | 21 | GTTTTAGTACT CTG (SEQ ID NO: 2264) | GAAA | CAGAATCTACTAAA ACAAGGCAAAATGC CGTGTTTATCTCGTC AACTTGTTGGCGAG ATTTTT (SEQ ID NO: 2278) |
| SauriCas9-KKH | NNRG | -3 | 1 | 21 | 21 | GTTTTAGTACT CTG (SEQ ID NO: 2264) | GAAA | CAGAATCTACTAAA ACAAGGCAAAATGC CGTGTTTATCTCGTC AACTTGTTGGCGAG ATTTTT (SEQ ID NO: 2278) |
| ScaCas9-Sc++ | NNG | -3 | 1 | 20 | 20 | GTTTTAGAGCT A (SEQ ID NO: 2266) | GAAA | TAGCAAGTTAAAAT AAGGCTAGTCCGTT ATCAACTTGAAAAA GTGGCACCGAGTCG GTGC (SEQ ID NO: 2279) |
| SpyCas9 | NGG | -3 | 1 | 20 | 20 | GTTTTAGAGCT A (SEQ ID NO: 2266) | GAAA | TAGCAAGTTAAAAT AAGGCTAGTCCGTT ATCAACTTGAAAAA GTGGCACCGAGTCG GTGC (SEQ ID NO: 2279) |
| SpyCas9-NG | NG (NGG = NGA = NGT > | -3 | 1 | 20 | 20 | GTTTAAGAGCT ATGCTG (SEQ ID NO: 2267) | GAAA | CAGCATAGCAAGTT TAAATAAGGCTAGT CCGTTATCAACTTGA AAAAGTGGCACCGA |

TABLE 9B-continued parameters to define the necessary components for designing gRNA and/or Template RNAs to apply Cas variants listed in Table 9A for Gene Writing

| Variant | PAM(s) | Cut | Tier | Spacer (min) | Spacer (max) | crRNA | Tetraloop | tracrRNA |
|---|---|---|---|---|---|---|---|---|
| | NGC) | | | | | | | GTCGGTGC (SEQ ID NO: 2280) |
| SpyCas9-SpRY | NRN > NYN | -3 | 1 | 20 | 20 | GTTTTAGAGCTA (SEQ ID NO: 2266) | GAAA | TAGCAAGTTAAAATAAGGCTAGTCCGTTATCAACTTGAAAAAGTGGCACCGAGTCGGTGC (SEQ ID NO: 2279) |
| St1Cas9 | NNAGAAW > NNAGGAW = NNGGAAW | -3 | 1 | 20 | 20 | GTCTTTGTACTCTG (SEQ ID NO: 2268) | GTAC | CAGAAGCTACAAGATAAGGCTTCATGCCGAAATCAACACCCTGTCATTTTATGGCAGGGTGTTTT (SEQ ID NO: 2281) |
| BlatCas9 | NNNNCNAA > NNNNCNDD > NNNNC | -3 | 1 | 19 | 23 | GCTATAGTTCCTTACT (SEQ ID NO: 2269) | GAAA | GGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT (SEQ ID NO: 2282) |
| cCas9-v16 | NNVACT; NNVATGM; NNVATT; NNVGCT; NNVGTG; NNVGTT | -3 | 2 | 21 | 21 | GUCUUAGUACUCUG (SEQ ID NO: 2270) | GAAA | CAGAAUCUACUAAGACAAGGCAAAAUGCCGUGUUUAUCUCGUCAACUUGUUGGCGAGAUUUUUUU (SEQ ID NO: 2283) |
| cCas9-v17 | NNVRRN | -3 | 2 | 21 | 21 | GUCUUAGUACUCUG (SEQ ID NO: 2270) | GAAA | CAGAAUCUACUAAGACAAGGCAAAAUGCCGUGUUUAUCUCGUCAACUUGUUGGCGAGAUUUUUUU (SEQ ID NO: 2283) |
| cCas9-v21 | NNVACT; NNVATGM; NNVATT; NNVGCT; NNVGTG; NNVGTT | -3 | 2 | 21 | 21 | GUCUUAGUACUCUG (SEQ ID NO: 2270) | GAAA | CAGAAUCUACUAAGACAAGGCAAAAUGCCGUGUUUAUCUCGUCAACUUGUUGGCGAGAUUUUUUU (SEQ ID NO: 2283) |
| cCas9-v42 | NNVRRN | -3 | 2 | 21 | 21 | GUCUUAGUACUCUG (SEQ ID NO: 2270) | GAAA | CAGAAUCUACUAAGACAAGGCAAAAUGCCGUGUUUAUCUCGUCAACUUGUUGGCGAGAUUUUUUU (SEQ ID NO: 2283) |
| CdiCas9 | NNRHHHY; NNRAAAY | | 2 | 22 | 22 | ACUGGGGUUCAG (SEQ ID NO: 2271) | GAAA | CUGAACCUCAGUAAGCAUUGGCUCGUUUCCAAUGUUGAUUGCUCCGCCGGUGCUCCUUAUUUUUAAGGGCGCCGGC (SEQ ID NO: 2284) |
| CjeCas9 | NNNNRYAC | -3 | 2 | 21 | 23 | GTTTTAGTCCCT (SEQ ID NO: 2272) | GAAA | AGGGACTAAAATAAAGAGTTTGCGGGACTCTGCGGGGTTACAATCCCCTAAAACCGCTTTTTT (SEQ ID NO: 2285) |
| GeoCas9 | NNNNCRAA | | 2 | 21 | 23 | GUCAUAGUUCCCCUGA (SEQ ID NO: 2273) | GAAA | UCAGGGUUACUAUGAUAAGGGCUUUCUGCCUAAGGCAGACUG |

TABLE 9B-continued parameters to define the necessary components for designing gRNA and/or
Template RNAs to apply Cas variants listed in Table 9A for Gene Writing

| Variant | PAM(s) | Cut | Tier | Spacer (min) | Spacer (max) | crRNA | Tetraloop | tracrRNA |
|---|---|---|---|---|---|---|---|---|
| | | | | | | | | ACCCGCGGCGUUGG GGAUCGCCUGUCGC CCGCUUUUGGCGGG CAUUCCCCAUCCUU (SEQ ID NO: 2286) |
| iSpyMacCas9 | NAAN | -3 | 2 | 19 | 21 | GTTTTAGAGCTA (SEQ ID NO: 2266) | GAAA | TAGCAAGTTAAAAT AAGGCTAGTCCGTT ATCAACTTGAAAAA GTGGCACCGAGTCG GTGC (SEQ ID NO: 2279) |
| NmeCas9 | NNNNGAYT; NNNNGYTT; NNNNGAYA; NNNNGTCT | -3 | 2 | 20 | 24 | GTTGTAGCTCC CTTTCTCATTT CG (SEQ ID NO: 2262) | GAAA | CGAAATGAGAACCG TTGCTACAATAAGG CCGTCTGAAAAGAT GTGCCGCAACGCTC TGCCCCTTAAAGCTT CTGCTTTAAGGGGC ATCGTTTA (SEQ ID NO: 2274) |
| ScaCas9 | NNG | -3 | 2 | 20 | 20 | GTTTTAGAGCTA (SEQ ID NO: 2266) | GAAA | TAGCAAGTTAAAAT AAGGCTAGTCCGTT ATCAACTTGAAAAA GTGGCACCGAGTCG GTGC (SEQ ID NO: 2279) |
| ScaCas9-HiFi-Sc++ | NNG | -3 | 2 | 20 | 20 | GTTTTAGAGCTA (SEQ ID NO: 2266) | GAAA | TAGCAAGTTAAAAT AAGGCTAGTCCGTT ATCAACTTGAAAAA GTGGCACCGAGTCG GTGC (SEQ ID NO: 2279) |
| SpyCas9-3var-NRRH | NRRH | -3 | 2 | 20 | 20 | GTTTAAGAGCT ATGCTG (SEQ ID NO: 2267) | GAAA | CAGCATAGCAAGTT TAAATAAGGCTAGT CCGTTATCAACTTGA AAAAGTGGCACCGA GTCGGTGC (SEQ ID NO: 2280) |
| SpyCas9-3var-NRTH | NRTH | -3 | 2 | 20 | 20 | GTTTAAGAGCT ATGCTG (SEQ ID NO: 2267) | GAAA | CAGCATAGCAAGTT TAAATAAGGCTAGT CCGTTATCAACTTGA AAAAGTGGCACCGA GTCGGTGC (SEQ ID NO: 2280) |
| SpyCas9-3var-NRCH | NRCH | -3 | 2 | 20 | 20 | GTTTAAGAGCT ATGCTG (SEQ ID NO: 2267) | GAAA | CAGCATAGCAAGTT TAAATAAGGCTAGT CCGTTATCAACTTGA AAAAGTGGCACCGA GTCGGTGC (SEQ ID NO: 2280) |
| SpyCas9-HF1 | NGG | -3 | 2 | 20 | 20 | GTTTTAGAGCTA (SEQ ID NO: 2266) | GAAA | TAGCAAGTTAAAAT AAGGCTAGTCCGTT ATCAACTTGAAAAA GTGGCACCGAGTCG GTGC (SEQ ID NO: 2279) |
| SpyCas9-QQR1 | NAAG | -3 | 2 | 20 | 20 | GTTTTAGAGCTA (SEQ ID NO: 2266) | GAAA | TAGCAAGTTAAAAT AAGGCTAGTCCGTT ATCAACTTGAAAAA GTGGCACCGAGTCG GTGC (SEQ ID NO: 2279) |
| SpyCas9-SpG | NGN | -3 | 2 | 20 | 20 | GTTTTAGAGCTA (SEQ ID NO: 2266) | GAAA | TAGCAAGTTAAAAT AAGGCTAGTCCGTT ATCAACTTGAAAAA GTGGCACCGAGTCG |

TABLE 9B-continued parameters to define the necessary components for designing gRNA and/or
Template RNAs to apply Cas variants listed in Table 9A for Gene Writing

| Variant | PAM(s) | Cut | Tier | Spacer (min) | Spacer (max) | crRNA | Tetraloop | tracrRNA |
|---|---|---|---|---|---|---|---|---|
| | | | | | | | | GTGC (SEQ ID NO: 2279) |
| SpyCas9-VQR | NGAN | -3 | 2 | 20 | 20 | GTTTTAGAGCTA (SEQ ID NO: 2266) | GAAA | TAGCAAGTTAAAAT AAGGCTAGTCCGTT ATCAACTTGAAAAA GTGGCACCGAGTCG GTGC (SEQ ID NO: 2279) |
| SpyCas9-VRER | NGCG | -3 | 2 | 20 | 20 | GTTTTAGAGCTA (SEQ ID NO: 2266) | GAAA | TAGCAAGTTAAAAT AAGGCTAGTCCGTT ATCAACTTGAAAAA GTGGCACCGAGTCG GTGC (SEQ ID NO: 2279) |
| SpyCas9-xCas | NG; GAA; GAT | -3 | 2 | 20 | 20 | GTTTAAGAGCT ATGCTG (SEQ ID NO: 2267) | GAAA | CAGCATAGCAAGTT TAAATAAGGCTAGT CCGTTATCAACTTGA AAAAGTGGCACCGA GTCGGTGC (SEQ ID NO: 2280) |
| SpyCas9-xCas-NG | NG | -3 | 2 | 20 | 20 | GTTTAAGAGCT ATGCTG (SEQ ID NO: 2267) | GAAA | CAGCATAGCAAGTT TAAATAAGGCTAGT CCGTTATCAACTTGA AAAAGTGGCACCGA GTCGGTGC (SEQ ID NO: 2280) |
| St1Cas9-CNRZ1066 | NNACAA | -3 | 2 | 20 | 20 | GTCTTTGTACT CTG (SEQ ID NO: 2268) | GTAC | CAGAAGCTACAAAG ATAAGGCTTCATGC CGAAATCAACACCC TGTCATTTTATGGCA GGGTGTTTT (SEQ ID NO: 2281) |
| St1Cas9-LMG1831 | NNGCAA | -3 | 2 | 20 | 20 | GTCTTTGTACT CTG (SEQ ID NO: 2268) | GTAC | CAGAAGCTACAAAG ATAAGGCTTCATGC CGAAATCAACACCC TGTCATTTTATGGCA GGGTGTTTT (SEQ ID NO: 2281) |
| St1Cas9-MTH17CL396 | NNAAAA | -3 | 2 | 20 | 20 | GTCTTTGTACT CTG (SEQ ID NO: 2268) | GTAC | CAGAAGCTACAAAG ATAAGGCTTCATGC CGAAATCAACACCC TGTCATTTTATGGCA GGGTGTTTT (SEQ ID NO: 2281) |
| St1Cas9-TH1477 | NNGAAA | -3 | 2 | 20 | 20 | GTCTTTGTACT CTG (SEQ ID NO: 2268) | GTAC | CAGAAGCTACAAAG ATAAGGCTTCATGC CGAAATCAACACCC TGTCATTTTATGGCA GGGTGTTTT (SEQ ID NO: 2281) |

In some embodiments, the opener molecule is exogenous to the cell comprising the Gene Writer polypeptide and or template nucleic acid. In some embodiments, the opener molecule comprises an endogenous agent (e.g., endogenous to the cell comprising the Gene Writer polypeptide and or template nucleic acid comprising the gRNA and blocking domain). For example, an inducible gRNA, blocking domain, and opener molecule may be chosen such that the opener molecule is an endogenous agent expressed in a target cell or tissue, e.g., thereby ensuring activity of a Gene Writer system in the target cell or tissue. As a further example, an inducible gRNA, blocking domain, and opener molecule may be chosen such that the opener molecule is absent or not substantially expressed in one or more non-target cells or tissues, e.g., thereby ensuring that activity of a Gene Writer system does not occur or substantially occur in the one or more non-target cells or tissues, or occurs at a reduced level compared to a target cell or tissue. Exemplary blocking domains, opener molecules, and uses thereof are described in PCT App. Publication WO2020044039A1, which is incorporated herein by reference in its entirety. In some embodiments, the template nucleic acid, e.g., template RNA, may comprise one or more UTRs (e.g. from an R2-type retrotransposon) and a gRNA. In some embodiments, the UTR facilitates interaction of the template nucleic acid (e.g., template RNA) with the writing domain, e.g., reverse transcriptase domain, of the Gene Writer polypeptide. In some embodiments, the gRNA facilitates interaction with the template nucleic acid binding domain (e.g., RNA binding domain) of the polypeptide. In some embodiments, the gRNA directs the polypeptide to the matching target sequence, e.g., in a target cell genome. In some embodiments, the template nucleic acid may contain only the reverse transcriptase binding motif (e.g. 3' UTR from R2) and the gRNA may be provided as a second nucleic acid molecule (e.g., second RNA molecule) for target site recognition. In some embodiments, the template nucleic acid containing the RT-binding motif may exist on the same molecule as the gRNA, but be processed into two RNA molecules by cleavage activity (e.g. ribozyme).

In some embodiments, a template RNA may be customized to correct a given mutation in the genomic DNA of a target cell (e.g., ex vivo or in vivo, e.g., in a target tissue or organ, e.g., in a subject). For example, the mutation may be a disease-associated mutation relative to the wild-type sequence. Without wishing to be bound by theory, sets of empirical parameters help ensure optimal initial in silico designs of template RNAs or portions thereof. As a non-limiting illustrative example, for a selected mutation, the following design parameters may be employed. In some embodiments, design is initiated by acquiring approximately 500 bp (e.g., up to 50, 100, 150, 200, 250, 300, 350, 400, 450, 500, 550, 600, 650, or 700 bp, and optionally at least 20, 30, 40, 50, 100, 150, 200, 250, 300, 350, 400, 450, 500, 550, 600, or 650 bp) flanking sequence on either side of the mutation to serve as the target region. In some embodiments, a template nucleic acid comprises a gRNA. Methodology for designing gRNAs is known to those of skill in the art. In some embodiments, a gRNA comprises a sequence (e.g., a CRISPR spacer) that binds a target site. In some embodiments, the sequence (e.g., a CRISPR spacer) that binds a target site for use in targeting a template nucleic acid to a target region is selected by considering the particular Gene Writer polypeptide (e.g., endonuclease domain or writing domain, e.g., comprising a CRISPR/Cas domain) being used (e.g., for Cas9, a protospacer-adjacent motif (PAM) of NGG immediately 3' of a 20 nt gRNA binding region). In some embodiments, the CRISPR spacer is selected by ranking first by whether the PAM will be disrupted by the Gene Writing induced edit. In some embodiments, disruption of the PAM may increase edit efficiency. In some embodiments, the PAM can be disrupted by also introducing (e.g., as part of or in addition to another modification to a target site in genomic DNA) a silent mutation (e.g., a mutation that does not alter an amino acid residue encoded by the target nucleic acid sequence, if any) in the target site during Gene Writing. In some embodiments, the CRISPR spacer is selected by ranking sequences by the proximity of their corresponding genomic site to the desired edit location. In some embodiments, the gRNA comprises a gRNA scaffold. In some embodiments, the gRNA scaffold used may be a standard scaffold (e.g., for Cas9, 5'-GTTT-TAGAGCTAGAAATAGCAAGT-TAAAATAAGGCTAGTCCGTTATCAACTTGAAAA AGTGGGACCGAGTCGGTCC-3' (SEQ ID NO: 1578)), or may contain one or more nucleotide substitutions. In some embodiments, the heterologous object sequence has at least 90% identity, e.g., at least 90%, 95%, 98%, 99%, or 100% identity, or comprises no more than 1, 2, 3, 4, or 5 positions of non-identity to the target site 3' of the first strand nick (e.g., immediately 3' of the first strand nick or up to 1, 2, 3, 4, or 5 nucleotides 3' of the first strand nick), with the exception of any insertion, substitution, or deletion that may be written into the target site by the Gene Writer. In some embodiments, the 3' target homology domain contains at least 90% identity, e.g., at least 90%, 95%, 98%, 99%, or 100% identity, or comprises no more than 1, 2, 3, 4, or 5 positions of non-identity to the target site 5' of the first strand nick (e.g., immediately 5' of the first strand nick or up to 1, 2, 3, 4, or 5 nucleotides 3' of the first strand nick).

In some embodiments, a template RNA can comprise a gRNA sequence, e.g., to direct the GeneWriter to a target site of interest. In some embodiments, a template RNA comprises (e.g., from 5' to 3') (i) optionally a sequence (e.g., a CRISPR spacer) that binds a target site (e.g., a second strand of a site in a target genome), (ii) optionally a sequence that binds a polypeptide described herein (e.g., a GeneWriter or a Cas polypeptide), (iii) a heterologous object sequence, and (iv) 5' homology domain and/or a 3' target homology domain.

In some embodiments, the template nucleic acid molecule comprises a 5' homology domain and/or a 3' homology domain. In some embodiments, the 5' homology domain comprises a nucleic acid sequence having at least 85%, 90%, 95%, 96%, 97%, 98%, 99%, or 100% sequence identity with a nucleic acid sequence comprised in a target nucleic acid molecule. In embodiments, the nucleic acid sequence in the target nucleic acid molecule is within about 1, 2, 3, 4, 5, 6, 7, 8, 9, 10, 15, 20, 25, 30, 35, 40, 45, 50, 60, 70, 80, 90, or 100 nucleotides of (e.g., 5' relative to) a target insertion site, e.g., for a heterologous object sequence, e.g., comprised in the template nucleic acid molecule.

In some embodiments, the 3' homology domain comprises a nucleic acid sequence having at least 85%, 90%, 95%, 96%, 97%, 98%, 99%, or 100% sequence identity with a nucleic acid sequence comprised in a target nucleic acid molecule. In embodiments, the nucleic acid sequence in the target nucleic acid molecule is within about 1, 2, 3, 4, 5, 6, 7, 8, 9, 10, 15, 20, 25, 30, 35, 40, 45, 50, 60, 70, 80, 90, or 100 nucleotides of (e.g., 3' relative to) a target insertion site, e.g., for a heterologous object sequence, e.g., comprised in the template nucleic acid molecule. In some embodiments, the 5' homology domain is heterologous to the remainder of the template nucleic acid molecule. In some embodiments, the 3' homology domain is heterologous to the remainder of the template nucleic acid molecule.

In some embodiments, a template nucleic acid (e.g., template RNA) comprises a 3' target homology domain. In some embodiments, a 3' target homology domain is disposed 3' of the heterologous object sequence and is complementary to a sequence adjacent to a site to be modified by a system described herein, or comprises no more than 1, 2, 3, 4, or 5 mismatches to a sequence complementary to the sequence adjacent to a site to be modified by the system/Gene Writer™. In some embodiments, the 3' homology domain binds within 1, 2, 3, 4, 5, 6, 7, 8, 9, or 10 nucleotides of a nick site in the target nucleic acid molecule. In some embodiments, binding of the 3' homology domain to the target nucleic acid molecule permits initiation of target-primed reverse transcription (TPRT), e.g., with the 3' homology domain acting as a primer for TPRT.

Methods and Compositions for Modified RNA (e.g., gRNA or Template RNA)

In some embodiments, an RNA component of the system (e.g., a template RNA or a gRNA, e.g., as described herein) comprises one or more nucleotide modifications. In some embodiments, the modification pattern of a gRNA can significantly affect in vivo activity compared to unmodified or end-modified guides (e.g., as shown in FIG. 1D from Finn et al. *Cell Rep* 22(9):2227-2235 (2018); incorporated herein by reference in its entirety). Without wishing to be bound by theory, this process may be due, at least in part, to a stabilization of the RNA conferred by the modifications. Non-limiting examples of such modifications may include 2'-O-methyl (2'-O-Me), 2'-O-(2-methoxyethyl) (2'-O-MOE), 2'-fluoro (2'-F), phosphorothioate (PS) bond between nucleotides, G-C substitutions, and inverted abasic linkages between nucleotides and equivalents thereof.

In some embodiments, the template RNA (e.g., at the portion thereof that binds a target site) or the guide RNA comprises a 5' terminus region. In some embodiments, the template RNA or the guide RNA does not comprise a 5' terminus region. In some embodiments, the 5' terminus region comprises a CRISPR spacer region, e.g., as described with respect to sgRNA in Briner A E et al, Molecular Cell 56: 333-339 (2014) (incorporated herein by reference in its entirety; applicable herein, e.g., to all guide RNAs). In some embodiments, the 5' terminus region comprises a 5' end modification. In some embodiments, a 5' terminus region with or without a spacer region may be associated with a crRNA, trRNA, sgRNA and/or dgRNA. The CRISPR spacer region can, in some instances, comprise a guide region, guide domain, or targeting domain. In some embodiments, a target domain or target sequence may comprise a sequence of nucleic acid to which the guide region/domain directs a nuclease for cleavage. In some embodiments, a spyCas9 protein may be directed by a guide region/domain to a target sequence of a target nucleic acid molecule by the nucleotides present in the CRISPR spacer region.

In some embodiments, the template RNA (e.g., at the portion thereof that binds a target site) or guide RNA, e.g., as described herein, comprises any of the sequences shown in Table 4 of WO2018107028A1, incorporated herein by reference in its entirety. In some embodiments, where a sequence shows a guide and/or spacer region, the composition may comprise this region or not. In some embodiments, a guide RNA comprises one or more of the modifications of any of the sequences shown in Table 4 of WO2018107028A1, e.g., as identified therein by a SEQ ID NO. In embodiments, the nucleotides may be the same or different, and/or the modification pattern shown may be the same or similar to a modification pattern of a guide sequence as shown in Table 4 of WO2018107028A1. In some embodiments, a modification pattern includes the relative position and identity of modifications of the gRNA or a region of the gRNA (e.g. 5' terminus region, lower stem region, bulge region, upper stem region, nexus region, hairpin 1 region, hairpin 2 region, 3' terminus region). In some embodiments, the modification pattern contains at least 50%, 55%, 60%, 70%, 75%, 80%, 85%, 90%, 95%, 96%, 97%, 98%, 99%, or 100% of the modifications of any one of the sequences shown in the sequence column of Table 4 of WO2018107028A1, and/or over one or more regions of the sequence. In some embodiments, the modification pattern is at least 50%, 55%, 60%, 70%, 75%, 80%, 85%, 90%, 95%, 96%, 97%, 98%, 99%, or 100% identical to the modification pattern of any one of the sequences shown in the sequence column of Table 4 of WO2018107028A1. In some embodiments, the modification pattern is at least 50%, 55%, 60%, 70%, 75%, 80%, 85%, 90%, 95%, 96%, 97%, 98%, 99%, or 100% identical over one or more regions of the sequence shown in Table 4 of WO2018107028A1, e.g., in a 5 ' terminus region, lower stem region, bulge region, upper stem region, nexus region, hairpin 1 region, hairpin 2 region, and/or 3' terminus region. In some embodiments, the modification pattern is least 50%, 55%, 60%, 70%, 75%, 80%, 85%, 90%, 95%, 96%, 97%, 98%, 99%, or 100% identical to the modification pattern of a sequence over the 5' terminus region. In some embodiments, the modification pattern is least 50%, 55%, 60%, 70%, 75%, 80%, 85%, 90%, 95%, 96%, 97%, 98%, 99%, or 100% identical over the lower stem. In some embodiments, the modification pattern is least 50%, 55%, 60%, 70%, 75%, 80%, 85%, 90%, 95%, 96%, 97%, 98%, 99%, or 100% identical over the bulge. In some embodiments, the modification pattern is least 50%, 55%, 60%, 70%, 75%, 80%, 85%, 90%, 95%, 96%, 97%, 98%, 99%, or 100% identical over the upper stem. In some embodiments, the modification pattern is least 50%, 55%, 60%, 70%, 75%, 80%, 85%, 90%, 95%, 96%, 97%, 98%, 99%, or 100% identical over the nexus. In some embodiments, the modification pattern is least 50%, 55%, 60%, 70%, 75%, 80%, 85%, 90%, 95%, 96%, 97%, 98%, 99%, or 100% identical over the hairpin 1. In some embodiments, the modification pattern is least 50%, 55%, 60%, 70%, 75%, 80%, 85%, 90%, 95%, 96%, 97%, 98%, 99%, or 100% identical over the hairpin 2. In some embodiments, the modification pattern is least 50%, 55%, 60%, 70%, 75%, 80%, 85%, 90%, 95%, 96%, 97%, 98%, 99%, or 100% identical over the 3' terminus. In some embodiments, the modification pattern differs from the modification pattern of a sequence of Table 4 of WO2018107028A1, or a region (e.g. 5' terminus, lower stem, bulge, upper stem, nexus, hairpin 1, hairpin 2, 3' terminus) of such a sequence, e.g., at 0, 1, 2, 3, 4, 5, 6, or more nucleotides. In some embodiments, the gRNA comprises modifications that differ from the modifications of a sequence of Table 4 of WO2018107028A1, e.g., at 0, 1, 2, 3, 4, 5, 6, or more nucleotides. In some embodiments, the gRNA comprises modifications that differ from modifications of a region (e.g. 5 ' terminus, lower stem, bulge, upper stem, nexus, hairpin 1, hairpin 2, 3' terminus) of a sequence of Table 4 of WO2018107028A1, e.g., at 0, 1, 2, 3, 4, 5, 6, or more nucleotides.

In some embodiments, the template RNA (e.g., at the portion thereof that binds a target site) or the gRNA comprises a 2'-O-methyl (2'-O-Me) modified nucleotide. In some embodiments, the gRNA comprises a 2'-O-(2-methoxy ethyl) (2'-O-moe) modified nucleotide. In some embodiments, the gRNA comprises a 2'-fluoro (2'-F) modified nucleotide. In some embodiments, the gRNA comprises a phosphorothioate (PS) bond between nucleotides. In some embodiments, the gRNA comprises a 5' end modification, a 3' end modification, or 5' and 3' end modifications. In some embodiments, the 5' end modification comprises a phosphorothioate (PS) bond between nucleotides. In some embodiments, the 5' end modification comprises a 2'-O-methyl (2'-O-Me), 2'-O-(2-methoxy ethyl) (2'-O-MOE), and/or 2'-fluoro (2'-F) modified nucleotide. In some embodiments, the 5' end modification comprises at least one phosphorothioate (PS) bond and one or more of a 2'-O-methyl (2'-O-Me), 2'-O-(2-methoxyethyl) (2'-O-MOE), and/or 2'-fluoro (2'-F) modified nucleotide. The end modification may comprise a phosphorothioate (PS), 2'-O-methyl (2'-O-Me), 2'-O-(2-methoxyethyl) (2'-O-MOE), and/or 2'-fluoro (2'-F) modification. Equivalent end modifications are also encompassed by embodiments described herein. In some embodiments, the template RNA or gRNA comprises an end modification in combination with a modification of one or more regions of the template RNA or gRNA. Additional exemplary modifications and methods for protecting RNA, e.g., gRNA, and formulae thereof, are described in WO2018126176A1, which is incorporated herein by reference in its entirety.

In some embodiments, structure-guided and systematic approaches are used to introduce modifications (e.g., 2'-OMe-RNA, 2'-F-RNA, and PS modifications) to a template RNA or guide RNA, for example, as described in Mir et al. *Nat Commun* 9:2641 (2018) (incorporated by reference herein in its entirety). In some embodiments, the incorporation of 2'-F-RNAs increases thermal and nuclease stability of RNA:RNA or RNA:DNA duplexes, e.g., while minimally interfering with C3'-endo sugar puckering. In some embodiments, 2'-F may be better tolerated than 2'-OMe at positions where the 2'-OH is important for RNA:DNA duplex stability. In some embodiments, a crRNA comprises one or more modifications that do not reduce Cas9 activity, e.g., C10, C20, or C21 (fully modified), e.g., as described in Supplementary Table 1 of Mir et al. *Nat Commun* 9:2641 (2018), incorporated herein by reference in its entirety. In some embodiments, a tracrRNA comprises one or more modifications that do not reduce Cas9 activity, e.g., T2, T6, T7, or T8 (fully modified) of Supplementary Table 1 of Mir et al. *Nat Commun* 9:2641 (2018). In some embodiments, a crRNA comprises one or more modifications (e.g., as described herein) may be paired with a tracrRNA comprising one or more modifications, e.g., C20 and T2. In some embodiments, a gRNA comprises a chimera, e.g., of a crRNA and a tracrRNA (e.g., Jinek et al. Science 337(6096): 816-821 (2012)). In embodiments, modifications from the crRNA and tracrRNA are mapped onto the single-guide chimera, e.g., to produce a modified gRNA with enhanced stability.

In some embodiments, gRNA molecules may be modified by the addition or subtraction of the naturally occurring structural components, e.g., hairpins. In some embodiments, a gRNA may comprise a gRNA with one or more 3' hairpin elements deleted, e.g., as described in WO2018106727, incorporated herein by reference in its entirety. In some embodiments, a gRNA may contain an added hairpin structure, e.g., an added hairpin structure in the spacer region, which was shown to increase specificity of a CRISPR-Cas system in the teachings of Kocak et al. *Nat Biotechnol* 37(6):657-666 (2019). Additional modifications, including examples of shortened gRNA and specific modifications improving in vivo activity, can be found in US20190316121, incorporated herein by reference in its entirety.

In some embodiments, structure-guided and systematic approaches (e.g., as described in Mir et al. *Nat Commun* 9:2641 (2018); incorporated herein by reference in its entirety) are employed to find modifications for the template RNA. In embodiments, the modifications are identified with the inclusion or exclusion of a guide region of the template RNA. In some embodiments, a structure of polypeptide bound to template RNA is used to determine non-protein-contacted nucleotides of the RNA that may then be selected for modifications, e.g., with lower risk of disrupting the association of the RNA with the polypeptide. Secondary structures in a template RNA can also be predicted in silico by software tools, e.g., the RNAstructure tool available at rna.urmc.rochester.edu/RNAstructureWeb (Bellaousov et al. *Nucleic Acids Res* 41:W471-W474 (2013); incorporated by reference herein in its entirety), e.g., to determine secondary structures for selecting modifications, e.g., hairpins, stems, and/or bulges.

It is contemplated that it may be useful to employ circular and/or linear RNA states during the formulation, delivery, or Gene Writing reaction within the target cell. Thus, in some embodiments of any of the aspects described herein, a Gene Writing system comprises one or more circular RNAs (circRNAs). In some embodiments of any of the aspects described herein, a Gene Writing system comprises one or more linear RNAs. In some embodiments, a nucleic acid as described herein (e.g., a template nucleic acid, a nucleic acid molecule encoding a Gene Writer polypeptide, or both) is a circRNA. In some embodiments, a circular RNA molecule encodes the Gene Writer polypeptide. In some embodiments, the circRNA molecule encoding the Gene Writer polypeptide is delivered to a host cell. In some embodiments, a circular RNA molecule encodes a recombinase, e.g., as described herein. In some embodiments, the circRNA molecule encoding the recombinase is delivered to a host cell. In some embodiments, the circRNA molecule encoding the Gene Writer polypeptide is linearized (e.g., in the host cell, e.g., in the nucleus of the host cell) prior to translation.

Circular RNAs (circRNAs) have been found to occur naturally in cells and have been found to have diverse functions, including both non-coding and protein coding roles in human cells. It has been shown that a circRNA can be engineered by incorporating a self-splicing intron into an RNA molecule (or DNA encoding the RNA molecule) that results in circularization of the RNA, and that an engineered circRNA can have enhanced protein production and stability (Wesselhoeft et al. *Nature Communications* 2018). In some embodiments, the Gene Writer™ polypeptide is encoded as circRNA. In certain embodiments, the template nucleic acid is a DNA, such as a dsDNA or ssDNA.

In some embodiments, the circRNA comprises one or more ribozyme sequences. In some embodiments, the ribozyme sequence is activated for autocleavage, e.g., in a host cell, e.g., thereby resulting in linearization of the circRNA. In some embodiments, the ribozyme is activated when the concentration of magnesium reaches a sufficient level for cleavage, e.g., in a host cell. In some embodiments the circRNA is maintained in a low magnesium environment prior to delivery to the host cell. In some embodiments, the ribozyme is a protein-responsive ribozyme. In some embodiments, the ribozyme is a nucleic acid-responsive ribozyme. In some embodiments, the circRNA comprises a cleavage site. In some embodiments, the circRNA comprises a second cleavage site.

In some embodiments, the circRNA is linearized in the nucleus of a target cell. In some embodiments, linearization of a circRNA in the nucleus of a cell involves components present in the nucleus of the cell, e.g., to activate a cleavage event. For example, the B2 and ALU retrotransposons contain self-cleaving ribozymes whose activity is enhanced by interaction with the Polycomb protein, EZH2 (Hernandez et al. PNAS 117(1):415-425 (2020)). Thus, in some embodiments, a ribozyme, e.g., a ribozyme from a B2 or ALU element, that is responsive to a nuclear element, e.g., a nuclear protein, e.g., a genome-interacting protein, e.g., an epigenetic modifier, e.g., EZH2, is incorporated into a circRNA, e.g., of a Gene Writing system. In some embodiments, nuclear localization of the circRNA results in an increase in autocatalytic activity of the ribozyme and linearization of the circRNA.

In some embodiments, the ribozyme is heterologous to one or more of the other components of the Gene Writing system. In some embodiments, an inducible ribozyme (e.g., in a circRNA as described herein) is created synthetically, for example, by utilizing a protein ligand-responsive aptamer design. A system for utilizing the satellite RNA of tobacco ringspot virus hammerhead ribozyme with an MS2 coat protein aptamer has been described (Kennedy et al. Nucleic Acids Res 42(19):12306-12321 (2014), incorporated herein by reference in its entirety) that results in activation of the ribozyme activity in the presence of the MS2 coat protein. In embodiments, such a system responds to protein ligand localized to the cytoplasm or the nucleus. In some embodiments the protein ligand is not MS2. Methods for generating RNA aptamers to target ligands have been described, for example, based on the systematic evolution of ligands by exponential enrichment (SELEX) (Tuerk and Gold, Science 249(4968):505-510 (1990); Ellington and Szostak, Nature 346(6287):818-822 (1990); the methods of each of which are incorporated herein by reference) and have, in some instances, been aided by in silico design (Bell et al. PNAS 117(15):8486-8493, the methods of which are incorporated herein by reference). Thus, in some embodiments, an aptamer for a target ligand is generated and incorporated into a synthetic ribozyme system, e.g., to trigger ribozyme-mediated cleavage and circRNA linearization, e.g., in the presence of the protein ligand. In some embodiments, circRNA linearization is triggered in the cytoplasm, e.g., using an aptamer that associates with a ligand in the cytoplasm. In some embodiments, circRNA linearization is triggered in the nucleus, e.g., using an aptamer that associates with a ligand in the nucleus. In embodiments, the ligand in the nucleus comprises an epigenetic modifier or a transcription factor. In some embodiments the ligand that triggers linearization is present at higher levels in on-target cells than off-target cells.

It is further contemplated that a nucleic acid-responsive ribozyme system can be employed for circRNA linearization. For example, biosensors that sense defined target nucleic acid molecules to trigger ribozyme activation are described, e.g., in Penchovsky (Biotechnology Advances 32(5): 1015-1027 (2014), incorporated herein by reference). By these methods, a ribozyme naturally folds into an inactive state and is only activated in the presence of a defined target nucleic acid molecule (e.g., an RNA molecule). In some embodiments, a circRNA of a Gene Writing system comprises a nucleic acid-responsive ribozyme that is activated in the presence of a defined target nucleic acid, e.g., an RNA, e.g., an mRNA, miRNA, guide RNA, gRNA, sgRNA, ncRNA, lncRNA, tRNA, snRNA, or mtRNA. In some embodiments the nucleic acid that triggers linearization is present at higher levels in on-target cells than off-target cells.

In some embodiments of any of the aspects herein, a Gene Writing system incorporates one or more ribozymes with inducible specificity to a target tissue or target cell of interest, e.g., a ribozyme that is activated by a ligand or nucleic acid present at higher levels in a target tissue or target cell of interest. In some embodiments, the Gene Writing system incorporates a ribozyme with inducible specificity to a subcellular compartment, e.g., the nucleus, nucleolus, cytoplasm, or mitochondria. In some embodiments, the ribozyme that is activated by a ligand or nucleic acid present at higher levels in the target subcellular compartment. In some embodiments, an RNA component of a Gene Writing system is provided as circRNA, e.g., that is activated by linearization. In some embodiments, linearization of a circRNA encoding a Gene Writing polypeptide activates the molecule for translation. In some embodiments, a signal that activates a circRNA component of a Gene Writing system is present at higher levels in on-target cells or tissues, e.g., such that the system is specifically activated in these cells.

In some embodiments, an RNA component of a Gene Writing system is provided as a circRNA that is inactivated by linearization. In some embodiments, a circRNA encoding the Gene Writer polypeptide is inactivated by cleavage and degradation. In some embodiments, a circRNA encoding the Gene Writing polypeptide is inactivated by cleavage that separates a translation signal from the coding sequence of the polypeptide. In some embodiments, a signal that inactivates a circRNA component of a Gene Writing system is present at higher levels in off-target cells or tissues, such that the system is specifically inactivated in these cells.

Further included here are compositions and methods for the assembly of full or partial template RNA molecules (e.g., Gene Writing template RNA molecules optionally comprising a gRNA, or separate gRNA molecules). In some embodiments, RNA molecules may be assembled by the connection of two or more (e.g., two, three, four, five, six, seven, eight, nine, ten, or more) RNA segments with each other. In an aspect, the disclosure provides methods for producing nucleic acid molecules, the methods comprising contacting two or more linear RNA segments with each other under conditions that allow for the 5' terminus of a first RNA segment to be covalently linked with the 3' terminus of a second RNA segment. In some embodiments, the joined molecule may be contacted with a third RNA segment under conditions that allow for the 5' terminus of the joined molecule to be covalently linked with the 3' terminus of the third RNA segment. In embodiments, the method further comprises joining a fourth, fifth, or additional RNA segments to the elongated molecule. This form of assembly may, in some instances, allow for rapid and efficient assembly of RNA molecules.

Figure 10:
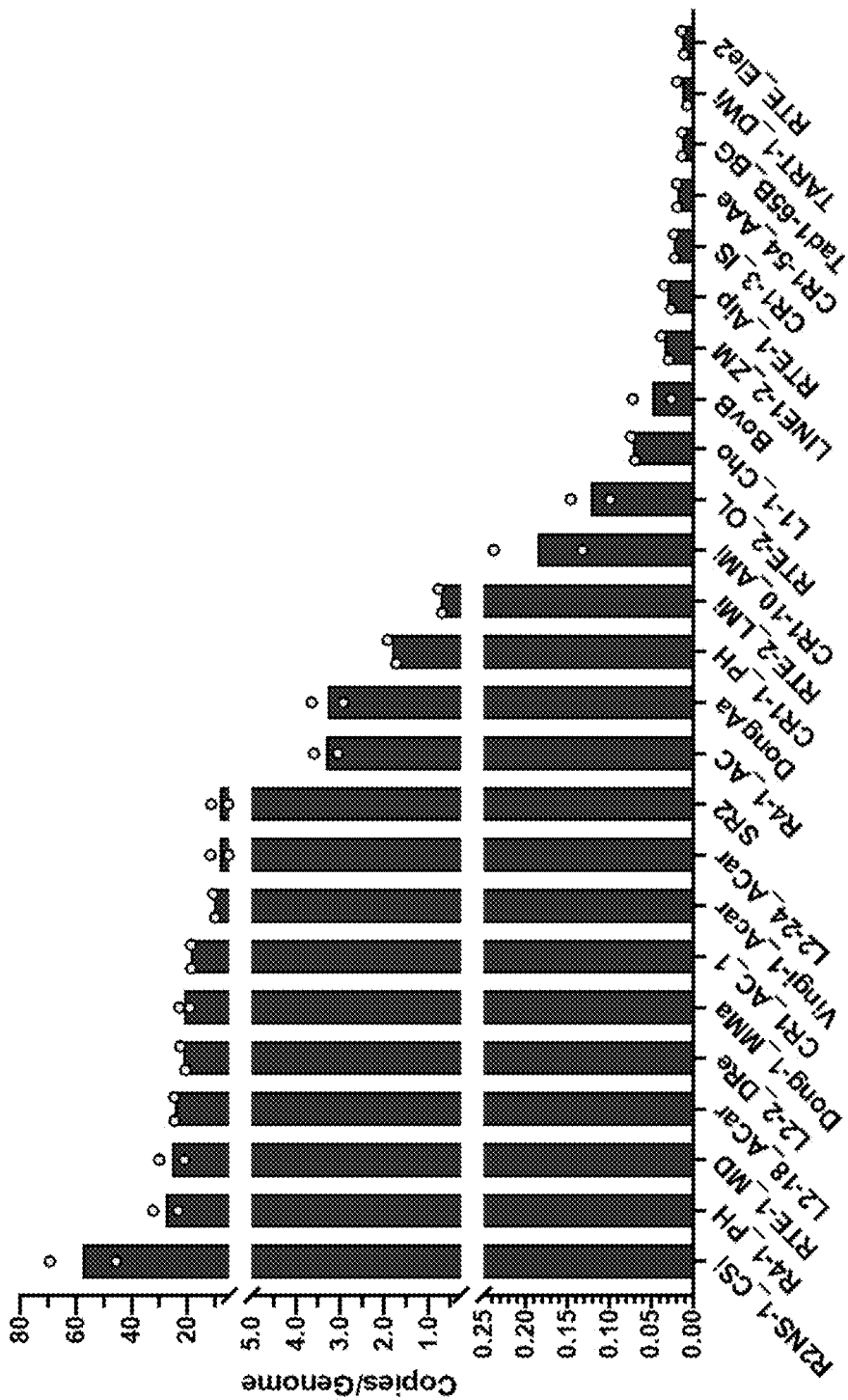
FIG. 10: High-activity Gene Writing configurations based on retrotransposon hits from Table 3B and further improved in Examples 7, 8, and 9. Where multiple configurations of a given system, e.g., alternate coding sequence of the retrotransposase (Example 8) or addition of homology arms (Example 9) were tested, only the highest performing configuration is shown. For systems improved beyond the initial configuration set forth in Table 3B and evaluated in Example 7, the improvements described in Example 5 (FIG. 11) and Example 6 (FIG. 12) are detailed in Table 11.

The present disclosure also provides compositions and methods for the connection (e.g., covalent connection) of crRNA molecules and tracrRNA molecules. In some embodiments, guide RNA molecules with specificity for different target sites can be generated using a single tracrRNA molecule/segment connected to a target site specific crRNA molecule/segment (e.g., as shown in FIG. 10 of US20160102322A1; incorporated herein by reference in its entirety). For example, FIG. 10 of US20160102322A1 shows four tubes with different crRNA molecules with crRNA molecule 3 being connected to a tracrRNA molecule to form a guide RNA molecule, thereby depicting an exemplary connection of two RNA segments to form a product RNA molecule.

The disclosure also provides compositions and methods for the production of template RNA molecules with specificity for a Gene Writer polypeptide and/or a genomic target site. In an aspect, the method comprises: (1) identification of the target site and desired modification thereto, (2) production of RNA segments including an upstream homology segment, a heterologous object sequence segment, a Gene Writer polypeptide binding motif, and a gRNA segment, and/or (3) connection of the four or more segments into at least one molecule, e.g., into a single RNA molecule. In some embodiments, some or all of the template RNA segments comprised in (2) are assembled into a template RNA molecule, e.g., one, two, three, or four of the listed components. In some embodiments, the segments comprised in (2) may be produced in further segmented molecules, e.g., split into at least 2, at least 3, at least 4, or at least 5 or more sub-segments, e.g., that are subsequently assembled, e.g., by one or more methods described herein.

In some embodiments, RNA segments may be produced by chemical synthesis. In some embodiments, RNA segments may be produced by in vitro transcription of a nucleic acid template, e.g., by providing an RNA polymerase to act on a cognate promoter of a DNA template to produce an RNA transcript. In some embodiments, in vitro transcription is performed using, e.g., a T7, T3, or SP6 RNA polymerase, or a derivative thereof, acting on a DNA, e.g., dsDNA, ssDNA, linear DNA, plasmid DNA, linear DNA amplicon, linearized plasmid DNA, e.g., encoding the RNA segment, e.g., under transcriptional control of a cognate promoter, e.g., a T7, T3, or SP6 promoter. In some embodiments, a combination of chemical synthesis and in vitro transcription is used to generate the RNA segments for assembly. In embodiments, the gRNA, upstream target homology, and Gene Writer polypeptide binding segments are produced by chemical synthesis and the heterologous object sequence segment is produced by in vitro transcription. Without wishing to be bound by theory, in vitro transcription may be better suited for the production of longer RNA molecules. In some embodiments, reaction temperature for in vitro transcription may be lowered, e.g., be less than 37° C. (e.g., between 0-10 C, 10-20 C, or 20-30 C), to result in a higher proportion of full-length transcripts (Krieg *Nucleic Acids Res* 18:6463 (1990)). In some embodiments, a protocol for improved synthesis of long transcripts is employed to synthesize a long template RNA, e.g., a template RNA greater than 5 kb, such as the use of e.g., T7 RiboMAX Express, which can generate 27 kb transcripts in vitro (Thiel et al. *J Gen Virol* 82(6):1273-1281 (2001)). In some embodiments, modifications to RNA molecules as described herein may be incorporated during synthesis of RNA segments (e.g., through the inclusion of modified nucleotides or alternative binding chemistries), following synthesis of RNA segments through chemical or enzymatic processes, following assembly of one or more RNA segments, or a combination thereof.

In some embodiments, an mRNA of the system (e.g., an mRNA encoding a Gene Writer polypeptide) is synthesized in vitro using T7 polymerase-mediated DNA-dependent RNA transcription from a linearized DNA template, where UTP is optionally substituted with 1-methylpseudoUTP. In some embodiments, the transcript incorporates 5' and 3' UTRs, e.g., GGGAAAUAAGAGAGAAAAGAAGAGUAAGAAGAA AUAUAAGAGCCACC (SEQ ID NO: 1579) and UGAUAAUAGGCUGGAGCCUCGGUGGCCAUGC-UUCUUGCCCCUUGGGCCUCCCCCC AGCCCCUC-CUCCCCUUCCUGCACCCGUACCCCCGUGGUC-UUUGAAUAAAGUCUGA (SEQ ID NO: 1580), or functional fragments or variants thereof, and optionally includes a poly-A tail, which can be encoded in the DNA template or added enzymatically following transcription. In some embodiments, a donor methyl group, e.g., S-adenosylmethionine, is added to a methylated capped RNA with cap 0 structure to yield a cap 1 structure that increases mRNA translation efficiency (Richner et al. *Cell* 168(6): P1114-1125 (2017)).

In some embodiments, the transcript from a T7 promoter starts with a GGG motif. In some embodiments, a transcript from a T7 promoter does not start with a GGG motif. It has been shown that a GGG motif at the transcriptional start, despite providing superior yield, may lead to T7 RNAP synthesizing a ladder of poly(G) products as a result of slippage of the transcript on the three C residues in the template strand from +1 to +3 (Imburgio et al. *Biochemistry* 39(34): 10419-10430 (2000). For tuning transcription levels and altering the transcription start site nucleotides to fit alternative 5' UTRs, the teachings of Davidson et al. *Pac Symp Biocomput* 433-443 (2010) describe T7 promoter variants, and the methods of discovery thereof, that fulfill both of these traits.

In some embodiments, RNA segments may be connected to each other by covalent coupling. In some embodiments, an RNA ligase, e.g., T4 RNA ligase, may be used to connect two or more RNA segments to each other. When a reagent such as an RNA ligase is used, a 5' terminus is typically linked to a 3' terminus. In some embodiments, if two segments are connected, then there are two possible linear constructs that can be formed (i.e., (1) 5'-Segment 1-Segment 2-3' and (2) 5'-Segment 2-Segment 1-3'). In some embodiments, intramolecular circularization can also occur. Both of these issues can be addressed, for example, by blocking one 5' terminus or one 3' terminus so that RNA ligase cannot ligate the terminus to another terminus. In embodiments, if a construct of 5'-Segment 1-Segment 2-3' is desired, then placing a blocking group on either the 5' end of Segment 1 or the 3' end of Segment 2 may result in the formation of only the correct linear ligation product and/or prevent intramolecular circularization. Compositions and methods for the covalent connection of two nucleic acid (e.g., RNA) segments are disclosed, for example, in US20160102322A1 (incorporated herein by reference in its entirety), along with methods including the use of an RNA ligase to directionally ligate two single-stranded RNA segments to each other.

One example of an end blocker that may be used in conjunction with, for example, T4 RNA ligase, is a dideoxy terminator. T4 RNA ligase typically catalyzes the ATP-dependent ligation of phosphodiester bonds between 5'-phosphate and 3'-hydroxyl termini. In some embodiments, when T4 RNA ligase is used, suitable termini must be present on the termini being ligated. One means for blocking T4 RNA ligase on a terminus comprises failing to have the correct terminus format. Generally, termini of RNA segments with a 5-hydroxyl or a 3'-phosphate will not act as substrates for T4 RNA ligase.

Additional exemplary methods that may be used to connect RNA segments is by click chemistry (e.g., as described in U.S. Pat. Nos. 7,375,234 and 7,070,941, and US Patent Publication No. 2013/0046084, the entire disclosures of which are incorporated herein by reference). For example, one exemplary click chemistry reaction is between an alkyne group and an azide group (see FIG. 11 of US20160102322A1, which is incorporated herein by reference in its entirety). Any click reaction may potentially be used to link RNA segments (e.g., Cu-azide-alkyne, strain-promoted-azide-alkyne, staudinger ligation, tetrazine ligation, photo-induced tetrazole-alkene, thiol-ene, NHS esters, epoxides, isocyanates, and aldehyde-aminooxy). In some embodiments, ligation of RNA molecules using a click chemistry reaction is advantageous because click chemistry reactions are fast, modular, efficient, often do not produce toxic waste products, can be done with water as a solvent, and/or can be set up to be stereospecific.

In some embodiments, RNA segments may be connected using an Azide-Alkyne Huisgen Cycloaddition. reaction, which is typically a 1,3-dipolar cycloaddition between an azide and a terminal or internal alkyne to give a 1,2,3-triazole for the ligation of RNA segments. Without wishing to be bound by theory, one advantage of this ligation method may be that this reaction can initiated by the addition of required Cu(I) ions. Other exemplary mechanisms by which RNA segments may be connected include, without limitatoin, the use of halogens (F—, Br—, I—)/alkynes addition reactions, carbonyls/sulfhydryls/maleimide, and carboxyl/amine linkages. For example, one RNA molecule may be modified with thiol at 3' (using disulfide amidite and universal support or disulfide modified support), and the other RNA molecule may be modified with acrydite at 5' (using acrylic phosphoramidite), then the two RNA molecules can be connected by a Michael addition reaction. This strategy can also be applied to connecting multiple RNA molecules stepwise. Also provided are methods for linking more than two (e.g., three, four, five, six, etc.) RNA molecules to each other. Without wishing to be bound by theory, this may be useful when a desired RNA molecule is longer than about 40 nucleotides, e.g., such that chemical synthesis efficiency degrades, e.g., as noted in US20160102322A1 (incorporated herein by reference in its entirety).

By way of illustratoin, a tracrRNA is typically around 80 nucleotides in length. Such RNA molecules may be produced, for example, by processes such as in vitro transcription or chemical synthesis. In some embodiments, when chemical synthesis is used to produce such RNA molecules, they may be produced as a single synthesis product or by linking two or more synthesized RNA segments to each other. In embodiments, when three or more RNA segments are connected to each other, different methods may be used to link the individual segments together. Also, the RNA segments may be connected to each other in one pot (e.g., a container, vessel, well, tube, plate, or other receptacle), all at the same time, or in one pot at different times or in different pots at different times. In a non-limiting example, to assemble RNA Segments 1, 2 and 3 in numerical order, RNA Segments 1 and 2 may first be connected, 5' to 3', to each other. The reaction product may then be purified for reaction mixture components (e.g., by chromatography), then placed in a second pot, for connection of the 3' terminus with the 5' terminus of RNA Segment 3. The final reaction product may then be connected to the 5' terminus of RNA Segment 3.

In another non-limiting example, RNA Segment 1 (about 30 nucleotides) is the target locus recognition sequence of a crRNA and a portion of Hairpin Region 1. RNA Segment 2 (about 35 nucleotides) contains the remainder of Hairpin Region 1 and some of the linear tracrRNA between Hairpin Region 1 and Hairpin Region 2. RNA Segment 3 (about 35 nucleotides) contains the remainder of the linear tracrRNA between Hairpin Region 1 and Hairpin Region 2 and all of Hairpin Region 2. In this example, RNA Segments 2 and 3 are linked, 5' to 3', using click chemistry. Further, the 5' and 3' end termini of the reaction product are both phosphorylated. The reaction product is then contacted with RNA Segment 1, having a 3' terminal hydroxyl group, and T4 RNA ligase to produce a guide RNA molecule.

A number of additional linking chemistries may be used to connect RNA segments according to method of the invention. Some of these chemistries are set out in Table 6 of US20160102322A1, which is incorporated herein by reference in its entirety.

DNA Binding Domain:

In certain aspects, the DNA-binding domain of a Gene Writer polypeptide described herein is selected, designed, or constructed for binding to a desired host DNA target sequence. In certain embodiments, the DNA-binding domain of the engineered retrotransposon is a heterologous DNA-binding protein or domain relative to a native retrotransposon sequence. In some embodiments, the heterologous DNA binding element is a zinc-finger element or a TAL effector element, e.g., a zinc-finger or TAL polypeptide or functional fragment thereof. In some embodiments, the heterologous DNA binding element is a sequence-guided DNA binding element, such as Cas9, Cpf1, or other CRISPR-related protein that has been altered to have no endonuclease activity. In some embodiments the heterologous DNA binding element retains endonuclease activity. In some embodiments the heterologous DNA binding element replaces the endonuclease element of the polypeptide. In specific embodiments, the heterologous DNA-binding domain can be any one or more of Cas9 (e.g., Cas9, Cas9 nickase, dCas9), TAL domain, zinc finger (ZF) domain, Myb domain, combinations thereof, or multiples thereof. In certain embodiments, the heterologous DNA-binding domain is a DNA binding domain of a retrotransposon described in Table X, Table Z1, Table Z2, or Table 3A or 3B. In some embodiments, DNA binding domains can be identified based upon homology to other known DNA binding domains using tools as Basic Local Alignment Search Tool (BLAST). In still other embodiments, DNA-binding domains are modified, for example by site-specific mutation, increasing or decreasing DNA-binding elements (for example, number and/or specificity of zinc fingers), etc., to alter DNA-binding specificity and affinity. In some embodiments the DNA binding domain is altered from its natural sequence to have altered codon usage, e.g. improved for human cells.

In some embodiments, the DNA binding domain comprises a meganuclease domain (e.g., as described herein, e.g., in the endonuclease domain section), or a functional fragment thereof. In some embodiments, the meganuclease domain possesses endonuclease activity, e.g., double-strand cleavage and/or nickase activity. In other embodiments, the meganuclease domain has reduced activity, e.g., lacks endonuclease activity, e.g., the meganuclease is catalytically inactive. In some embodiments, a catalytically inactive meganuclease is used as a DNA binding domain, e.g., as described in Fonfara et al. Nucleic Acids Res 40(2):847-860 (2012), incorporated herein by reference in its entirety. In embodiments, the DNA binding domain comprises one or more modifications relative to a wild-type DNA binding domain, e.g., a modification via directed evolution, e.g., phage-assisted continuous evolution (PACE).

In certain aspects of the present invention, the host DNA-binding site integrated into by the Gene Writer system can be in a gene, in an intron, in an exon, an ORF, outside of a coding region of any gene, in a regulatory region of a gene, or outside of a regulatory region of a gene. In other aspects, the engineered retrotransposon may bind to one or more than one host DNA sequence. In other aspects, the engineered retrotransposon may have low sequence specificity, e.g., bind to multiple sequences or lack sequence preference.

In some embodiments, a Gene Writing system is used to edit a target locus in multiple alleles. In some embodiments, a Gene Writing system is designed to edit a specific allele. For example, a Gene Writing polypeptide may be directed to a specific sequence that is only present on one allele, e.g., comprises a template RNA with homology to a target allele, e.g., a gRNA or annealing domain, but not to a second cognate allele. In some embodiments, a Gene Writing system can alter a haplotype-specific allele. In some embodiments, a Gene Writing system that targets a specific allele preferentially targets that allele, e.g., has at least a 2, 4, 6, 8, or 10-fold preference for a target allele.

In certain embodiments, a Gene Writer™ gene editor system RNA further comprises an intracellular localization sequence, e.g., a nuclear localization sequence. The nuclear localization sequence may be an RNA sequence that promotes the import of the RNA into the nucleus. In certain embodiments the nuclear localization signal is located on the template RNA. In certain embodiments, the retrotransposase polypeptide is encoded on a first RNA, and the template RNA is a second, separate, RNA, and the nuclear localization signal is located on the template RNA and not on an RNA encoding the retrotransposase polypeptide. While not wishing to be bound by theory, in some embodiments, the RNA encoding the retrotransposase is targeted primarily to the cytoplasm to promote its translation, while the template RNA is targeted primarily to the nucleus to promote its retrotransposition into the genome. In some embodiments the nuclear localization signal is at the 3' end, 5' end, or in an internal region of the template RNA. In some embodiments the nuclear localization signal is 3' of the heterologous sequence (e.g., is directly 3' of the heterologous sequence) or is 5' of the heterologous sequence (e.g., is directly 5' of the heterologous sequence). In some embodiments the nuclear localization signal is placed outside of the 5' UTR or outside of the 3' UTR of the template RNA. In some embodiments the nuclear localization signal is placed between the 5' UTR and the 3' UTR, wherein optionally the nuclear localization signal is not transcribed with the transgene (e.g., the nuclear localization signal is an anti-sense orientation or is downstream of a transcriptional termination signal or polyadenylation signal). In some embodiments the nuclear localization sequence is situated inside of an intron. In some embodiments a plurality of the same or different nuclear localization signals are in the RNA, e.g., in the template RNA. In some embodiments the nuclear localization signal is less than 5, 10, 25, 50, 75, 100, 150, 200, 250, 300, 350, 400, 450, 500, 600, 700, 800, 900 or 1000 bp in legnth. Various RNA nuclear localization sequences can be used. For example, Lubelsky and Ulitsky, Nature 555 (107-111), 2018 describe RNA sequences which drive RNA localization into the nucleus. In some embodiments, the nuclear localization signal is a SINE-derived nuclear RNA localization (SIRLOIN) signal. In some embodiments the nuclear localization signal binds a nuclear-enriched protein. In some embodiments the nuclear localization signal binds the HNRNPK protein. In some embodiments the nuclear localization signal is rich in pyrimidines, e.g., is a C/T rich, C/U rich, C rich, T rich, or U rich region. In some embodiments the nuclear localization signal is derived from a long non-coding RNA. In some embodiments the nuclear localization signal is derived from MALAT1 long non-coding RNA or is the 600 nucleotide M region of MALAT1 (described in Miyagawa et al., RNA 18, (738-751), 2012). In some embodiments the nuclear localization signal is derived from BORG long non-coding RNA or is a AGCCC motif (described in Zhang et al., Molecular and Cellular Biology 34, 2318-2329 (2014). In some embodiments the nuclear localization sequence is described in Shukla et al., The EMBO Journal e98452 (2018). In some embodiments the nuclear localization signal is derived from a non-LTR retrotransposon, an LTR retrotransposon, retrovirus, or an endogenous retrovirus.

In some embodiments, a polypeptide described herein comprises one or more (e.g., 2, 3, 4, 5) nuclear targeting sequences, for example, a nuclear localization sequence (NLS), e.g., as described above. In some embodiments, the NLS is a bipartite NLS. In some embodiments, an NLS facilitates the import of a protein comprising an NLS into the cell nucleus. In some embodiments, the NLS is fused to the N-terminus of a Gene Writer described herein. In some embodiments, the NLS is fused to the C-terminus of the Gene Writer. In some embodiments, the NLS is fused to the N-terminus or the C-terminus of a Cas domain. In some embodiments, a linker sequence is disposed between the NLS and theneighboring domain of the Gene Writer.

In some embodiments, an NLS comprises the amino acid sequence MDSLLMNRRKFLYQFKNVRWAKGRRETYLC (SEQ ID NO: 1581), PKKRKVEGADKRTADGSEFESPKKKRKV (SEQ ID NO: 1582), RKSGKIAAIWKRPRKPKKKRKV (SEQ ID NO: 1583), KRTADGSEFESPKKKRKV (SEQ ID NO: 1584), KKTELQTTNAENKTKKL (SEQ ID NO: 1585), or KRGINDRNFWRGENGRKTR (SEQ ID NO: 1586), KRPAATKKAGQAKKKK (SEQ ID NO: 1587), or a functional fragment or variant thereof. Exemplary NLS sequences are also described in PCT/EP2000/011690, the contents of which are incorporated herein by reference for their disclosure of exemplary nuclear localization sequences. In some embodiments, an NLS comprises an amino acid sequence as disclosed in Table 8. An NLS of this table may be utilized with one or more copies in a polypeptide in one or more locations in a polypeptide, e.g., 1, 2, 3 or more copies of an NLS in an N-terminal domain, between peptide domains, in a C-terminal domain, or in a combination of locations, in order to improve subcellular localization to the nucleus. Multiple unique sequences may be used within a single polypeptide. Sequences may be naturally monopartite or bipartite, e.g., having one or two stretches of basic amino acids, or may be used as chimeric bipartite sequences. Sequence references correspond to UniProt accession numbers, except where indicated as SeqNLS for sequences mined using a subcellular localization prediction algorithm (Lin et al BMC Bioinformat 13:157 (2012), incorporated herein by reference in its entirety).

TABLE 8

Exemplary nuclear localization signals for use in Gene Writing systems

| Sequence | Sequence References | SEQ ID NO: |
|---|---|---|
| AHFKISGEKRPSTDPGKKAK NPKKKKKDP | Q76IQ7 | 2287 |
| AHRAKKMSKTHA | P21827 | 2288 |
| ASPEYVNLPINGNG | SeqNLS | 2289 |
| CTKRPRW | O88622, Q86W56, Q9QYM2, O02776 | 2290 |
| DKAKRVSRNKSEKKRR | O15516, Q5RAK8, Q91YB2, Q91YB0, Q8QGQ6, O08785, Q9WVS9, Q6YGZ4 | 2291 |
| EELRLKEELLKGIYA | Q9QY16, Q9UHL0, Q2TBP1, Q9QY15 | 2292 |
| EEQLRRRKNSRLNNTG | G5EFF5 | 2293 |
| EVLKVIRTGKRKKKAWKR MVTKVC | SeqNLS | 2294 |

TABLE 8-continued

Exemplary nuclear localization signals for use in Gene Writing systems

| Sequence | Sequence References | SEQ ID NO: |
|---|---|---|
| HHHHHHHHHHHHQPH | Q63934, G3V7L5, Q12837 | 2295 |
| HKKKHPDASVNFSEFSK | P10103, Q4R844, P12682, B0CM99, A9RA84, Q6YKA4, P09429, P63159, Q08IE6, P63158, Q9YH06, B1MTB0 | 2296 |
| HKRTKK | Q2R2D5 | 2297 |
| IINGRKLKLKKSRRRSSQTSNNSFTSRRS | SeqNLS | 2298 |
| KAEQERRK | Q8LH59 | 2299 |
| KEKRKRREELFIEQKKRK | SeqNLS | 2300 |
| KKGKDEWFSRGKKP | P30999 | 2301 |
| KKGPSVQKRKKT | Q6ZN17 | 2302 |
| KKKTVINDLLHYKKEK | SeqNLS, P32354 | 2303 |
| KKNGGKGKNKPSAKIKK | SeqNLS | 2304 |
| KKPKWDDFKKKKK | Q15397, Q8BKS9, Q562C7 | 2305 |
| KKRKKD | SeqNLS, Q91Z62, Q1A730, Q969P5, Q2KHT6, Q9CPU7 | 2306 |
| KKRKRRRK | SeqNLS | 2307 |
| KKRRRRARK | Q9UMS6, D4A702, Q91YE8 | 2308 |
| KKSKRGR | Q9UBS0 | 2309 |
| KKSRKRGS | B4FG96 | 2310 |
| KKSTALSRELGKIMRRR | SeqNLS, P32354 | 2311 |
| KKSYQDPEIIAHSRPRK | Q9U7C9 | 2312 |
| KKTGKNRKLKSKRVKTR | Q9Z301, O54943, Q8K3T2 | 2313 |
| KKVSIAGQSGKLWRWKR | Q6YUL8 | 2314 |
| KKYENVVIKRSPRKRGRPRK | SeqNLS | 2315 |
| KNKKRK | SeqNLS | 2316 |
| KPKKKR | SeqNLS | 2317 |
| KRAMKDDSHGNSTSPKRRK | Q0E671 | 2318 |
| KRANSNLVAAYEKAKKK | P23508 | 2319 |
| KRASEDTTSGSPPKKSSAGPKR | Q9BZZ5, Q5R644 | 2320 |
| KRFKRRWMVRKMKTKK | SeqNLS | 2321 |
| KRGLNSSFETSPKKVK | Q8IV63 | 2322 |
| KRGNSSIGPNDLSKRKQRKK | SeqNLS | 2323 |
| KRIHSVSLSQSQIDPSKKVKRAK | SeqNLS | 2324 |
| KRKGKLKNKGSKRKK | O15381 | 2325 |
| KRRRRRRREKRKR | Q96GM8 | 2326 |
| KRSNDRTYSPEEEKQRRA | Q91ZF2 | 2327 |
| KRTVATNGDASGAHRAKKMSK | SeqNLS | 2328 |

TABLE 8-continued

Exemplary nuclear localization signals for use in Gene Writing systems

| Sequence | Sequence References | SEQ ID NO: |
|---|---|---|
| KRVYNKGEDEQEHLPKGKKR | SeqNLS | 2329 |
| KSGKAPRRRAVSMDNSNK | Q9WVH4, O43524 | 2330 |
| KVNFLDMSLDDIIIYKELE | Q9P127 | 2331 |
| KVQHRIAKKTTRRRR | Q9DXE6 | 2332 |
| LSPSLSPL | Q9Y261, P32182, P35583 | 2333 |
| MDSLLMNRRKFLYQFKNVRWAKGRRETYLC | Q9GZX7 | 2334 |
| MPQNEYIELHRKRYGYRLDYHEKKRKKESREAHERSKKAKKMIGLKAKLYHK | SeqNLS | 2335 |
| MVQLRPRASR | SeqNLS | 2336 |
| NNKLLAKRRKGGASPKDDPMDDIK | Q965G5 | 2337 |
| NYKRPMDGTYGPPAKRHEGE | O14497, A2BH40 | 2338 |
| PDTKRAKLDSSETTMVKKK | SeqNLS | 2339 |
| PEKRTKI | SeqNLS | 2340 |
| PGGRGKKK | Q719N1, Q9UBP0, A2VDN5 | 2341 |
| PGKMDKGEHRQERRDRPY | Q01844, Q61545 | 2342 |
| PKKGDKYDKTD | Q45FA5 | 2343 |
| PKKKSRK | O35914, Q01954 | 2344 |
| PKKNKPE | Q22663 | 2345 |
| PKKRAKV | P04295, P89438 | 2346 |
| PKPKKLKVE | P55263, P55262, P55264, Q64640 | 2347 |
| PKRGRGR | Q9FYS5, Q43386 | 2348 |
| PKRRLVDDA | P0C797 | 2349 |
| PKRRRTY | SeqNLS | 2350 |
| PLFKRR | A8X6H4, Q9TXJ0 | 2351 |
| PLRKAKR | Q86WB0, Q5R8V9 | 2352 |
| PPAKRKCIF | Q6AZ28, O75928, Q8C5D8 | 2353 |
| PPARRRL | Q8NAG6 | 2354 |
| PPKKKRKV | Q3L6L5, P03070, P14999, P03071 | 2355 |
| PPNKRMKVKH | Q8BN78 | 2356 |
| PPRIYPQLPSAPT | P0C799 | 2357 |
| PQRSPFPKSSVKR | SeqNLS | 2358 |
| PRPRKVPR | P0C799 | 2359 |
| PRRRVQRKR | SeqNLS, Q5R448, Q5TAQ9 | 2360 |
| PRRVRLK | Q58DJ0, P56477, Q13568 | 2361 |
| PSRKRPR | Q62315, Q5F363, Q92833 | 2362 |
| PSSKKRKV | SeqNLS | 2363 |

TABLE 8-continued

Exemplary nuclear localization signals for use in Gene Writing systems

| Sequence | Sequence References | SEQ ID NO: |
|---|---|---|
| PTKKRVK | P07664 | 2364 |
| QRPGPYDRP | SeqNLS | 2365 |
| RGKGGKGLGKGGAKRHRK | SeqNLS | 2366 |
| RKAGKGGGHKTTKKRSAKDEKVP | B4FG96 | 2367 |
| RKIKLKRAK | A1L3G9 | 2368 |
| RKIKRKRAK | B9X187 | 2369 |
| RKKEAPGPREELRSRGR | O35126, P54258, Q5IS70, P54259 | 2370 |
| RKKRKGK | SeqNLS, Q29243, Q62165, Q28685, O18738, Q9TSZ6, Q14118 | 2371 |
| RKKRRQRRR | P04326, P69697, P69698, P05907, P20879, P04613, P19553, P0C1J9, P20893, P12506, P04612, Q73370, P0C1K0, P05906, P35965, P04609, P04610, P04614, P04608, P05905 | 2372 |
| RKKSIPLSIKNLRKHKRKKNKITR | Q9C0C9 | 2373 |
| RKLVKPKNTKMKTKLRTNPY | Q14190 | 2374 |
| RKRLILSDKGQLDWKK | SeqNLS, Q91Z62, Q1A730, Q2KHT6, Q9CPU7 | 2375 |
| RKRLKSK | Q13309 | 2376 |
| RKRRVRDNM | Q8QPH4, Q809M7, A8C8X1, Q2VNC5, Q38SQ0, O89749, Q6DNQ9, Q809L9, Q0A429, Q20NV3, P16509, P16505, Q6DNQ5, P16506, Q6XT06, P26118, Q2ICQ2, Q2RCG8, Q0A2D0, Q0A2H9, Q9IQ46, Q809M3, Q6J847, Q6J856, B4URE4, A4GCM7, Q0A440, P26120, P16511, | 2377 |
| RKRSPKDKKEKDLDGAGKRRKT | Q7RTP6 | 2378 |
| RKRTPRVDGQTGENDMNKRRRK | O94851 | 2379 |
| RLPVRRRRR | P04499, P12541, P03269, P48313, P03270 | 2380 |
| RLRFRKPKSK | P69469 | 2381 |
| RQQRKR | Q14980 | 2382 |
| RRDLNSSFETSPKKVK | Q8K3G5 | 2383 |
| RRDRAKLR | Q9SLB8 | 2384 |
| RRGDGRRR | Q80WE1, Q5R9B4, Q06787, P35922 | 2385 |
| RRGRKRKAEKQ | Q812D1, Q5XXA9, Q99JF8, Q8MJG1, Q66T72, O75475 | 2386 |
| RRKKRR | Q0VD86, Q58DS6, Q5R6G2, Q9ERI5, Q6AYK2, Q6NYC1 | 2387 |
| RRKRSKSEDMDSVESKRRR | Q7TT18 | 2388 |
| RRKRSR | Q99PU7, D3ZHS6, Q92560, A2VDM8 | 2389 |
| RRPKGKTLQKRKPK | Q6ZN17 | 2390 |

TABLE 8-continued

Exemplary nuclear localization signals for use in Gene Writing systems

| Sequence | Sequence References | SEQ ID NO: |
|---|---|---|
| RRRGFERFGPDNMGRKRK | Q63014, Q9DBR0 | 2391 |
| RRRGKNKVAAQNCRK | SeqNLS | 2392 |
| RRRKRR | Q5FVH8, Q6MZT1, Q08DH5, Q8BQP9 | 2393 |
| RRRQKQKGGASRRR | SeqNLS | 2394 |
| RRRREGPRARRRR | P08313, P10231 | 2395 |
| RRTIRLKLVYDKCDRSCKIQ KKNRNKCQYCRFHKCLSVG MSHNAIRFGRMPRSEKAKL KAE | SeqNLS | 2396 |
| RRVPQRKEVSRCRKCRK | Q5RJN4, Q32L09, Q8CAK3, Q9NUL5 | 2397 |
| RVGGRRQAVECIEDLLNEP GQPLDLSCKRPRP | P03255 | 2398 |
| RVVKLRIAP | P52639, Q8JMN0 | 2399 |
| RVVRRR | P70278 | 2400 |
| SKRKTKISRKTR | Q5RAY1, O00443 | 2401 |
| SYVKTVPNRTRTYIKL | P21935 | 2402 |
| TGKNEAKKRKIA | P52739, Q8K3J5, Q5RAU9 | 2403 |
| TLSPASSPSSVSCPVIPASTD ESPGSALNI | SeqNLS | 2404 |
| VSKKQRTGKKIH | P52739, Q8K3J5, Q5RAU9 | 2405 |
| SPKKKRKVE | | 2406 |
| KRTAD GSEFE SPKKKRKVE | | 2407 |
| PAAKRVKLD | | 2408 |
| PKKKRKV | | 2409 |
| MDSLLMNRRKFLYQFKNVR WAKGRRETYLC | | 2334 |
| SPKKKRKVEAS | | 2411 |
| MAPKKKRKVGIHRGVP | | 2412 |

In some embodiments, the NLS is a bipartite NLS. A bipartite NLS typically comprises two basic amino acid clusters separated by a spacer sequence (which may be, e.g., about 10 amino acids in length). A monopartite NLS typically lacks a spacer. An example of a bipartite NLS is the nucleoplasmin NLS, having the sequence KR[PAATKK-AGQA]KKKK (SEQ ID NO: 1587), wherein the spacer is bracketed. Another exemplary bipartite NLS has the sequence PKKKRKVEGADKRTADGSEFESPKKKRKV (SEQ ID NO: 1588). Exemplary NLSs are described in International Application WO2020051561, which is herein incorporated by reference in its entirety, including for its disclosures regarding nuclear localization sequences.

In certain embodiments, a Gene Writer™ gene editor system polypeptide further comprises an intracellular localization sequence, e.g., a nuclear localization sequence and/or a nucleolar localization sequence. The nuclear localization sequence and/or nucleolar localization sequence may be amino acid sequences that promote the import of the protein into the nucleus and/or nucleolus, where it can promote integration of heterologous sequence into the genome. In certain embodiments, a Gene Writer gene editor system polypeptide (e.g., a retrotransposase, e.g., a polypeptide according to any of Tables 1, 2, 3A, or 3B herein) further comprises a nucleolar localization sequence. In certain embodiments, the retrotransposase polypeptide is encoded on a first RNA, and the template RNA is a second, separate, RNA, and the nucleolar localization signal is encoded on the RNA encoding the retrotransposase polypeptide and not on the template RNA. In some embodiments, the nucleolar localization signal is located at the N-terminus, C-terminus, or in an internal region of the polypeptide. In some embodiments, a plurality of the same or different nucleolar localization signals are used. In some embodiments, the nuclear localization signal is less than 5, 10, 25, 50, 75, or 100 amino acids in length. Various polypeptide nucleolar localization signals can be used. For example, Yang et al., *Journal of Biomedical Science* 22, 33 (2015), describe a nuclear localization signal that also functions as a nucleolar localization signal. In some embodiments, the nucleolar localization signal may also be a nuclear localization signal. In some embodiments, the nucleolar localization signal may overlap with a nuclear localization signal. In some embodiments, the nucleolar localization signal may comprise a stretch of basic residues. In some embodiments, the nucleolar localization signal may be rich in arginine and lysine residues. In some embodiments, the nucleolar localization signal may be derived from a protein that is enriched in the nucleolus. In some embodiments, the nucleolar localization signal may be derived from a protein enriched at ribosomal RNA loci. In some embodiments, the nucleolar localization signal may be derived from a protein that binds rRNA. In some embodiments, the nucleolar localization signal may be derived from MSP58. In some embodiments, the nucleolar localization signal may be a monopartite motif. In some embodiments, the nucleolar localization signal may be a bipartite motif. In some embodiments, the nucleolar localization signal may consist of a multiple monopartite or bipartite motifs. In some embodiments, the nucleolar localization signal may consist of a mix of monopartite and bipartite motifs. In some embodiments, the nucleolar localization signal may be a dual bipartite motif. In some embodiments, the nucleolar localization motif may be a KRASSQALGTIPKRRSSSRFIKRKK (SEQ ID NO: 1530). In some embodiments, the nucleolar localization signal may be derived from nuclear factor-κB-inducing kinase. In some embodiments, the nucleolar localization signal may be an RKKRKKK motif (SEQ ID NO: 1531) (described in Birbach et al., Journal of Cell Science, 117 (3615-3624), 2004).

In some embodiments, a nucleic acid described herein (e.g., an RNA encoding a GeneWriter polypeptide, or a DNA encoding the RNA) comprises a microRNA binding site. In some embodiments, the microRNA binding site is used to increase the target-cell specificity of a GeneWriter system. For instance, the microRNA binding site can be chosen on the basis that is is recognized by a miRNA that is present in a non-target cell type, but that is not present (or is present at a reduced level relative to the non-target cell) in a target cell type. Thus, when the RNA encoding the GeneWriter polypeptide is present in a non-target cell, it would be bound by the miRNA, and when the RNA encoding the Gene Writer polypeptide is present in a target cell, it would not be bound by the miRNA (or bound but at reduced levels relative to the non-target cell). While not wishing to be bound by theory, binding of the miRNA to the RNA encoding the Gene Writer polypeptide may reduce production of the GeneWriter polypeptide, e.g., by degrading the mRNA encoding the polypeptide or by interfering with translation. Accordingly, the heterologous object sequence would be inserted into the genome of target cells more efficiently than into the genome of non-target cells. A system having a microRNA binding site in the RNA encoding the GeneWriter polypeptide (or encoded in the DNA encoding the RNA) may also be used in combination with a template RNA that is regulated by a second microRNA binding site, e.g., as described herein in the section entitled "Template RNA component of Gene Writer™ gene editor system."

Based on the Accession numbers provided in Table X, Z1, Z2, 3A, or 3B, the nucleic acid and corresponding polypeptide sequences of each retrotransposon and domains thereof can be determined, e.g., by using routine sequence analysis tools as Basic Local Alignment Search Tool (BLAST) or CD-Search for conserved domain analysis. Other sequence analysis tools are known and can be found, e.g., at molbiol-tools.ca, for example, at molbiol-tools.ca/Motifs.htm. SEQ ID NOs 113-1015 align with the first 903 rows of Table 2.

Tables X, 3A, and 3B herein provide the sequences of exemplary transposons, including the amino acid sequence of the retrotransposase, and sequences of 5' and 3' untranslated regions to allow the retrotransposase to bind the template RNA. In some embodiments, a 5' UTR of any of Table X, Z1, Z2, 3A, or 3B allows the retrotransposase to bind the template RNA. In some embodiments, a 3' UTR of any of Tables X, 3A, and 3B allows the retrotransposase to bind the template RNA. Thus, in some embodiments, a polypeptide for use in any of the systems described herein can be a polypeptide of any of Tables X, 3A, and 3B herein, or a sequence having at least 70%, 75%, 80%, 85%, 90%, 95%, 96%, 97%, 98%, or 99% identity thereto. In some embodiments, the system further comprises one or both of a 5' or 3' untranslated region of any of Tables X, 3A, and 3B herein (or a sequence having at least 70%, 75%, 80%, 85%, 90%, 95%, 96%, 97%, 98%, or 99% identity thereto), e.g., from the same retrotransposon as the polypeptide referred to in the preceding sentence, as indicated in the same row of the same table. In some embodiments, the system comprises one or both of a 5' or 3' untranslated region of any of Tables X, 3A, and 3B herein, e.g., a segment of the full retrotransposon sequence that encodes an RNA that is capable of binding a retrotransposase, and/or the sub-sequence provided in the column entitled Predicted 5' UTR or Predicted 3' UTR.

In some embodiments, a polypeptide for use in any of the systems described herein can be a molecular reconstruction or ancestral reconstruction based upon the aligned polypeptide sequence of multiple retrotransposons. In some embodiments, a 5' or 3' untranslated region for use in any of the systems described herein can be a molecular reconstruction based upon the aligned 5' or 3' untranslated region of multiple retrotransposons. Based on the Accession numbers provided herein, polypeptides or nucleic acid sequences can be aligned, e.g., by using routine sequence analysis tools as Basic Local Alignment Search Tool (BLAST) or CD-Search for conserved domain analysis. Molecular reconstructions can be created based upon sequence consensus, e.g. using approaches described in *Ivics et al., Cell* 1997, 501-510; Wagstaff et al., *Molecular Biology and Evolution* 2013, 88-99. In some embodiments, the retrotransposon from which the 5' or 3' untranslated region or polypeptide is derived is a young or a recently active mobile element, as assessed via phylogenetic methods such as those described in Boissinot et al., Molecular Biology and Evolution 2000, 915-928.

TABLE Z1

Exemplary reverse transcriptase domains from different types of sources.
Sources include Group II intron, non-LTR retrotransposon, retrovirus, LTR retrotransposon,
diversity-generating retroelement, retron, telomerase, retroplasmid, and evolved DNA
polymerase. Also included are the associated RT signatures from the InterPro, pfam, and cd
databases. Although the evolved polymerase RTX can perform RNA-dependent DNA
polymerization, no RT signatures were identified by InterProScan, so polymerase signatures are
included instead.

| Protein | Type | Accession | UniProt | Sequence | RT signatures |
|---|---|---|---|---|---|
| MarathonRT | Group II intron | CBK92290.1 | D4JMT6 | MDTSNLMEQILSSDNLNRAYLQ VVRNKGAEGVDGMKYTELKEH LAKNGETIKGQLRTRKYKPQPAR RVEIPKPDGGVRNLGVPTVTDRF IQQAIAQVLTPIYEEQFHDHSYGF RPNRCAQQAILTALNIMNDGND WIVDIDLEKFFDTVNHDKLMTLI GRTIKDGDVISIVRKYLVSGIMID DEYEDSIVGTPQGGNLSPLLANI MLNELDKEMEKRGLNFVRYAD DCIIMVGSEMSANRVMRNISRFIE EKLGLKVNMTKSKVDRPSGLKY LGFGFYFDPRAHQFKAKPHAKS VAKFKKRMKELTCRSWGVSNSY KVEKLNQLIRGWINYFKIGSMKT LCKELDSRIRYRLRMCIWKQWK TPQNQEKNLVKLGIDRNTARRV AYTGKRIAYVCNKGAVNVAISN KRLASFGLISMLDYYIEKCVTC (SEQ ID NO: 1589) | IPR000477, PF00078, cd01651 |
| TGIRT, trt | Group II intron | AAT72329.1 | Q6DKY2 | MALLERILADRNLITALKRVEAN QGAPGIGDVSTDQLRDIYRAHWS TIRAQLLAGTYRPAPVRRVGIPK GPGGTRQLGITPVVDRLIQQIALQ ELTPIFDPDFSPSSFGFRPGRNAH DAVRQAQGYIQEYGRYVVDMD LKEFFDRVNHDLIMSRVARKVD KKRVLKLIRYALQAGVMIEGVK VQTEEGTQPGGPLSPLLANILLD DLDKELEKRGLKFCYRADDCNI YVSKLRAGQRVKQSIQRFLEKTL KLKVNEEKSVADRPWKRAFGLF SFTPERKARIRLAPRSIQRLKQRI RQLTNPNWSISMPREIHRVNQYV GMWIGYFRLVTEPSVLQTIEGWI RRRLRLCWQLQWKRVRTRIREL RALGLKETAVMEIANRTKGAWR TTKPQTLHQALGKYTWTAQGLK TSLQRYFELRQG (SEQ ID NO: 1590) | IPR000477, PF00078, cd01651 |
| LtrA | Group II intron | AAB06503.1 | P0A3U0 | MKPTMAILERISKNSQENIDEVFT RLYRYLLRPDIYYVAYQNLYSN KGASTKGILDDTADGFSEEKIKKI IQSLKDGTYYPQPVRRMYIAKKN SKKMRPLGIPTFTDKLIQEAVRIIL ESIYEPVFEDVSHGFRPQRSCHTA LKTIKREFGGARWFVEGDIKGCF DNIDHVTLIGLINLKIKDMKMSQ LIYKFLKAGYLENWQYHKTYSG TPQGGILSPLLANIYLHELDKFVL QLKMKFDRESPERITPEYRELHN EIKRISHRLKKLEGEEKAKVLLE YQEKRKRLPTLPCTSQTNKVLKY VRYADDFIISVKGSKEDCQWIKE QLKLFIHNKLKMELSEEKTLITHS SQPARFLGYDIRVRRSGTIKRSG KVKKRTLNGSVELLIPLQDKIRQ FIFDKKIAIQKKDSSWFPVHRKYL IRSTDLEIITIYNSELRGICNYYGL ASNFNQLNYFAYLMEYSCLKTIA SKHKGTLSKTISMFKDGSGSWGI PYEIKQGKQRRYFANFSECKSPY QFTDEISQAPVLYGYARNTLENR LKAKCCELCGTSDENTSYEIHHV NKVKNLKGKEKWEMAMIAKQR KTLVVCFHCHRHVIHKHK (SEQ ID NO: 1591) | IPR000477, PF00078, cd01651 |

TABLE Z1-continued

Exemplary reverse transcriptase domains from different types of sources.
Sources include Group II intron, non-LTR retrotransposon, retrovirus, LTR retrotransposon,
diversity-generating retroelement, retron, telomerase, retroplasmid, and evolved DNA
polymerase. Also included are the associated RT signatures from the InterPro, pfam, and cd
databases. Although the evolved polymerase RTX can perform RNA-dependent DNA
polymerization, no RT signatures were identified by InterProScan, so polymerase signatures are
included instead.

| Protein | Type | Accession | UniProt | Sequence | RT signatures |
|---------|------|-----------|---------|----------|---------------|
| R2Bm | non-LTR retrotransposon | AAB59214.1 | V9H0S2 | MMASTALSLMGRCNPDGCTRGK HVTAAPMDGPRGPSSLAGTFGW GLAIPAGEPCGRVCSPATVGFFP VAKKSNKENRPEASGLPLESERT GDNPTVRGSAGADPVGQDAPG WTCQFCERTFSTNRGLGVHKRR AHPVETNTDAAPMMVKRRWHG EEIDLLARTEARLLAERGQCSGG DLFGALPGFGRTLEAIKGQRRRE PYRALVQAHLARFGSQPGPSSGG CSAEPDFRRASGAEEAGEERCAE DAAAYDPSAVGQMSPDAARVLS ELLEGAGRRRACRAMRPKTAGR RNDLHDDRTASAHKTSRQKRRA EYARVQELYKKCRSRAAAEVID GACGGVGHSLEEMETYWRPILE RVSDAPGPTPEALHALGRAEWH GGNRDYTQLWKPISVEEIKASRF DWRTSPGPDGIRSGQWRAVPVH LKAEMFNAWMARGEIPEILRQC RTVFVPKVERPGGPGEYRPISIAS IPLRHFHSILARRLLACCPPDARQ RGFICADGTLENSAVLDAVLGDS RKKLRECHVAVLDFAKAFDTVS HEALVELLRLRGMPEQFCGYIAH LYDTASTTLAVNNEMSSPVKVG RGVRQGDPLSPILFNVVMDLILA SLPERVGYRLEMELVSALAYAD DLVLLAGSKVGMQESISAVDCV GRQMGLRLNCRKSAVLSMIPDG HRKKHHYLTERTFNIGGKPLRQV SCVERWRYLGVDFEASGCVTLE HSISSALNNISRAPLKPQQRLEILR AHLIPRFQHGFVLGNISDDRLRM LDVQIRKAVGQWLRLPADVPKA YYHAAVQDGGLAIPSVRATIPDL IVRRFGGLDSSPWSVARAAAKSD KIRKKLRWAWKQLRRFSRVDST TQRPSVRLFWREHLHASVDGRE LRESTRTPTSTKWIRERCAQITGR DFVQFVHTHINALPSRIRGSRGR RGGGESSLTCRAGCKVRETTAHI LQQCHRTHGGRILRHNKIVSFVA KAMEENKWTVELEPRLRTSVGL RKPDIIASRDGVGVIVDVQVVSG QRSLDELHREKRNKYGNHGELV ELVAGRLGLPKAECVRATSCTIS WRGVWSLTSYKELRSIIGLREPT LQIVPILALRGSHMNWTRFNQMT SVMGGGVG (SEQ ID NO: 1592) | IPR000477, PF00078, cd01650 |
| LINE-1 | non-LTR retrotransposon | AAC51271.1 | O00370 | MTGSNSHITILTLNVNGLNSPIKR HRLASWIKSQDPSVCCIQETHLT CRDTHRLKIKGWRKIYQANGKQ KKAGVAILVSDKTDFKPTKIKRD KEGHYIMVKGSIQQEELTILNIYA PNTGAPRFIKQVLSDLQRDLDSH TLIMGDFNTPLSILDRSTRQKVN KDTQELNSALHQTDLIDIYRTLH PKSTEYTFFSAPHHTYSKIDHIVG SKALLSKCKRTEIITNYLSDHSAI KLELRIKNLTQSRSTTWKLNNLL LNDYWVHNEMKAEIKMFFETNE NKDTTYQNLWDAFKAVCRGKFI ALNAYKRKQERSKIDTLTSQLKE LEKQEQTHSKASRRQEITKIRAEL KEIETQKTLQKINESRSWFFERIN KIDRPLARLIKKKREKNQIDTIKN | IPR000477 PF00078, cd01650 |

TABLE Z1-continued

Exemplary reverse transcriptase domains from different types of sources.
Sources include Group II intron, non-LTR retrotransposon, retrovirus, LTR retrotransposon, diversity-generating retroelement, retron, telomerase, retroplasmid, and evolved DNA polymerase. Also included are the associated RT signatures from the InterPro, pfam, and cd databases. Although the evolved polymerase RTX can perform RNA-dependent DNA polymerization, no RT signatures were identified by InterProScan, so polymerase signatures are included instead.

| Protein | Type | Accession | UniProt | Sequence | RT signatures |
|---|---|---|---|---|---|
| | | | | DKGDITTDPTEIQTTIREYYKHLY ANKLENLEEMDTFLDTYTLPRLN QEEVESLNRPITGSEIVAIINSLPT KKSPGPDGFTAEFYQRYKEELVP FLLKLFQSIEKEGILPNSFYEASIIL IPKPGRDTTKKENFRPISLMNIDA KILNKILANRIQQHIKKLIHHDQV GFIPGMQGWFNIRKSINVIQHINR AKDKNHVIISIDAEKAFDKIQQPF MLKTLNKLGIDGMYLKIIRAIYD KPTANIILNGQKLEAFPLKTGTRQ GCPLSPLLFNIVLEVLARAIRQEK EIKGIQLGKEEVKLSLFADDMIV YLENPIVSAQNLLKLISNFSKVSG YKINVQKSQAFLYNNNRQTESQI MGELPFTIASKRIKYLGIQLTRDV KDLFKENYKPLLKEIKEDTNKW KNIPCSWVGRINIVKMAILPKVIY RFNAIPIKLPMTFFTELEKTTLKFI WNQKRARIAKSILSQKNKAGGIT LPDFKLYYKATVTKTAWYWYQ NRDIDQWNRTEPSEIMPHIYNYLI FDKPEKNKQWGKDSLLNKWCW ENWLAICRKLKLDPFLTPYTKINS RWIKDLNVKPKTIKTLEENLGITI QDIGVGKDFMSKTPKAMATKDK IDKWDLIKLKSFCTAKETTIRVNR QPTTWEKIFATYSSDKGLISRIYN ELKQIYKKKTNNPIKKWAKDMN RHFSKEDIYAAKKHMKKCSSSLA IREMQIKTTMRYHLTPVRMAIIK KSGNNRCWRGCGEIGTLVHCW WDCKLVQPLWKSVWRFLRDLEL EIPFDPAIPLLGIYPKDYKSCCYK DTCTRMFIAALFTIAKTWNQPNC PTMIDWIKKMWHIYTMEYYAAI KNDEFISFVGTWMKLETIILSKLS QEQKTKHRIFSLIGGN (SEQ ID NO: 1593) | |
| Penelope | non-LTR retrotransposon | AAL14979.1 | Q95VB5 | MERSPEPSININGRHAVCTATNM SYAKIKTKYKDSKRTINKFQLTL VKLTKLKSSLKFLLKCRKSNLIPN FIKNLTQHLTILTTDNKTHPDITR TLTRHTHFYHTKILNLLIKHKHN LLQEQTKHMQKAKTNIEQLMTT DDAKAFFESERNIENKITTTLKKR QETKHDKLRDQRNLALADNNTQ REWFVNKTKIEFPPNVVALLAKG PKFALPISKRDFPLLKYIADGEEL VQTIKEKETQESARTKFSLLVKE HKTKNNQNSRDRAILDTVEQTR KLLKENINIKILSSDKGNKTVAM DEDEYKNKMTNILDDLCAYRTL RLDPTSRLQTKNNTFVAQLFKM GLISKDERNKMTTTTAVPPRIYG LPKIHKEGTPLRPICSSIGSPSYGL CKYIIQILKNLTMDSRYNIKNAV DFKDRVNNSQIREEETLVSFDVV SLFPSIPIELALDTIRQKWTKLEEH TNIPKQLFMDIVRFCIEENRYFKY EDKIYTQLKGMPMGSPASPVIAD ILMEELLDKITDKLKIKPRLLTKY VDDLFAITNKIDVENILKELNSFH KQIKFTMELEKDGKLPFLDSIVSR MDNTLKIKWYRKPIASGRILNFN SNHPKSMIINTALGCMNRMMKIS DTIYHKEIEHEIKELLTKNDFPPNI IKTLLKRRQIERKKPTEPAKIYKS | IPR000477, PF00078, cd00304 |

TABLE Z1-continued

Exemplary reverse transcriptase domains from different types of sources.
Sources include Group II intron, non-LTR retrotransposon, retrovirus, LTR retrotransposon,
diversity-generating retroelement, retron, telomerase, retroplasmid, and evolved DNA
polymerase. Also included are the associated RT signatures from the InterPro, pfam, and cd
databases. Although the evolved polymerase RTX can perform RNA-dependent DNA
polymerization, no RT signatures were identified by InterProScan, so polymerase signatures are
included instead.

| Protein | Type | Accession | UniProt | Sequence | RT signatures |
|---|---|---|---|---|---|
| | | | | LIYVPRLSERLTNSDCYNKQDIK VAHKPTNTLQKFFNKIKSKIPMIE KSNVVYQIPCGGDNNNKCNSVYI GTTKSKLKTRISQHKSDFKLRHQ NNIQKTALMTHCIRSNHTPNFDE TTILQQEQHYNKRHTLEMLHIIN TPTYKRLNYKTDTENCAHLYRH LLNSQTTSVTISTSKSADV (SEQ ID NO: 1594) | |
| M-MLVRT | Retrovirus | ADS42990.1 | P03355 [660-1330] | TLNIEDEHRLHETSKEPDVSLGST WLSDFPQAWAETGGMGLAVRQ APLIIPLKATSTPVSIKQYPMSQE ARLGIKPHIQRLLDQGILVPCQSP WNTPLLPVKKPGTNDYRPVQDL REVNKRVEDIHPTVPNPYNLLSG LPPSHQWYTVLDLKDAFFCLRLH PTSQPLFAFEWRDPEMGISGQLT WTRLPQGFKNSPTLFDEALHRDL ADFRIQHPDLILLQYVDDLLLAA TSELDCQQGTRALLQTLGNLGY RASAKKAQICQKQVKYLGYLLK EGQRWLTEARKETVMGQPTPKT PRQLREFLGTAGFCRLWIPGFAE MAAPLYPLTKTGTLFNWGPDQQ KAYQEIKQALLTAPALGLPDLTK PFELFVDEKQGYAKGVLTQKLG PWRRPVAYLSKKLDPVAAGWPP CLRMVAAIAVLTKDAGKLTMGQ PLVILAPHAVEALVKQPPDRWLS NARMTHYQALLLDTDRVQFGPV VALNPATLLPLPEEGLQHNCLDI LAEAHGTRPDLTDQPLPDADHT WYTDGSSLLQEGQRKAGAAVTT ETEVIWAKALPAGTSAQRAELIA LTQALKMAEGKKLNVYTDSRYA FATAHIHGEIYRRRGLLTSEGKEI KNKDEILALLKALFLPKRLSIIHC PGHQKGHSAEARGNRMADQAA RKAAITETPDTSTLL (SEQ ID NO: 1573) | IPR000477, PF00078, cd03715 |
| RSV RT | Retrovirus | AAC82561.1 | P03354 [709-1567] | TVALHLAIPLKWKPDHTPVWIDQ WPLPEGKLVALTQLVEKELQLG HIEPSLSCWNTPVFVIRKASGSYR LLHDLRAVNAKLVPFGAVQQGA PVLSALPRGWPLMVLDLKDCFFS IPLAEQDREAFAFTLPSVNNQAP ARRFQWKVLPQGMTCSPTICQL VVGQVLEPLRLKHPSLCMLHYM DDLLLAASSHDGLEAAGEEVIST LERAGFTISPDKVQREPGVQYLG YKLGSTYVAPVGLVAEPRIATLW DVQKLVGSLQWLRPALGIPPRL MGPFYEQLRGSDPNEAREWNLD MKMAWREIVRLSTTAALERWDP ALPLEGAVARCEQGAIGVLGQG LSTHPRPCLWLFSTQPTKAFTAW LEVLTLLITKLRASAVRTFGKEV DILLLPACFREDLPLPEGILLALK GFAGKIRSSDTPSIFDIARPLHVSL KVRVTDHPVPGPTVFTDASSSTH KGVVVWREGPRWEIKEIADLGA SVQQLEARAVAMALLLWPTTPT NVVTDSAFVAKMLLKMGQEGV PSTAAAFILEDALSQRSAMAAVL HVRSHSEVPGFFTEGNDVADSQA TFQAYPLREAKDLHTALHIGPRA LSKACNISMQQAREVVQTCPHC | IPR000477, PF00078, cd01645 |

TABLE Z1-continued

Exemplary reverse transcriptase domains from different types of sources.
Sources include Group II intron, non-LTR retrotransposon, retrovirus, LTR retrotransposon,
diversity-generating retroelement, retron, telomerase, retroplasmid, and evolved DNA
polymerase. Also included are the associated RT signatures from the InterPro, pfam, and cd
databases. Although the evolved polymerase RTX can perform RNA-dependent DNA
polymerization, no RT signatures were identified by InterProScan, so polymerase signatures are
included instead.

| Protein | Type | Accession | UniProt | Sequence | RT signatures |
|---|---|---|---|---|---|
| | | | | NSAPALEAGVNPRGLGPLQIWQT DFTLEPRMAPRSWLAVTVDTASS AIVVTQHGRVTSVAVQHHWATA IAVLGRPKAIKTDNGSCFTSKSTR EWLARWGIAHTTGIPGNSQGQA MVERANRLLKDRIRVLAEGDGF MKRIPTSKQGELLAKAMYALNH FERGENTKTPIQKHWRPTVLTEG PPVKIRIETGEWEKGWNVLVWG RGYAAVKNRDTDKVIWVPSRKV KPDITQKDEVTKKDEASPLFAG (SEQ ID NO: 1595) | |
| AMVRT | Retrovirus | HW606680.1 | — | TVALHLAIPLKWKPNHTPVWIDQ WPLPEGKLVALTQLVEKELQLG HIEPSLSCWNTPVFVIRKASGSYR LLHDLRAVNAKLVPFGAVQQGA PVLSALPRGWPLMVLDLKDCFFS IPLAEQDREAFAFTLPSVNNQAP ARRFQWKVLPQGMTCSPTICQLI VGQILEPLRLKHPSLRMLHYMD DLLLAASSHDGLEAAGEEVISTL ERAGFTISPDKVQREPGVQYLGY KLGSTYVAPVGLVAEPRIATLWD VQKLVGSLQWLRPALGIPPRLM GPFYEQLRGSDPNEAREWNLDM KMAWREIVQLSTTAALERWDPA LPLEGAVARCEQGAIGVLGQGLS THPRPCLWLFSTQPTKAFTAWLE VLTLLITKLRASAVRTFGKEVDIL LLPACFREDLPLPEGILLALRGFA GKIRSSDTPSIFDIARPLHVSLKV RVTDHPVPGPTVFTDASSSTHKG VVVWREGPRWEIKEIADLGASV QQLEARAVAMALLLWPTTPTNV VTDSAFVAKMLLKMGQEGVPST AAAFILEDALSQRSAMAAVLHV RSHSEVPGFFTEGNDVADSQATF QAY (SEQ ID NO: 1596) | IPR000477, PF00078, cd01645 |
| HIVRT | Retrovirus | AAB50259.1 | P04585 [588-1147] | PISPIETVPVKLKPGMDGPKVKQ WPLTEEKIKALVEICTEMEKEGKI SKIGPENPYNTPVFAIKKKDSTK WRKLVDFRELNKRTQDFWEVQL GIPHPAGLKKKKSVTVLDVGDA YFSVPLDEDFRKYTAFTIPSINNE TPGIRYQYNVLPQGWKGSPAIFQ SSMTKILEPFRKQNPDIVIYQYM DDLYVGSDLEIGQHRTKIEELRQ HLLRWGLTTPDKKHQKEPPFLW MGYELHPDKWTVQPIVLPEKDS WTVNDIQKLVGKLNWASQIYPGI KVRQLCKLLRGTKALTEVIPLTE EAELELAENREILKEPVHGVYYD PSKDLIAEIQKQGQGQWTYQIYQ EPFKNLKTGKYARMRGAHTNDV KQLTEAVQKITTESIVIWGKTPKF KLPIQKETWETWWTEYWQATWI PEWEFVNTPPLVKLWYQLEKEPI VGAETFYVDGAANRETKLGKAG YVTNRGRQKVVTLTDTTNQKTE LQAIYLALQDSGLEVNIVTDSQY ALGIIQAQPDQSESELVNQIIEQLI KKEKVYLAWVPAHKGIGGNEQV DKLVSAGIRKVL (SEQ ID NO: 1597) | IPR000477, PF00078, cd01645 |
| Ty1 | LTR retrotransposon | AAA66938.1 | Q07163-1[1218- | AVKAVKSIKPIRTTLRYDEAITYN KDIKEKEKYIEAYHKEVNQLLK | IPR013103, PF07727 |

TABLE Z1-continued

Exemplary reverse transcriptase domains from different types of sources.
Sources include Group II intron, non-LTR retrotransposon, retrovirus, LTR retrotransposon,
diversity-generating retroelement, retron, telomerase, retroplasmid, and evolved DNA
polymerase. Also included are the associated RT signatures from the InterPro, pfam, and cd
databases. Although the evolved polymerase RTX can perform RNA-dependent DNA
polymerization, no RT signatures were identified by InterProScan, so polymerase signatures are
included instead.

| Protein | Type | Accession | UniProt | Sequence | RT signatures |
|---|---|---|---|---|---|
| | | | 1755] | MKTWDTDEYYDRKEIDPKRVIN SMFIFNKKRDGTHKARFVARGDI QHPDTYDSGMQSNTVHHYALM TSLSLALDNNYYITQLDISSAYLY ADIKEELYIRPPPHLGMNDKLIRL KKSLYGLKQSGANWYETIKSYLI QQCGMEEVRGWSCVFKNSQVTI CLFVDDMVLFSKNLNSNKRIIEK LKMQYDTKIINLGESDEEIQYDIL GLEIKYQRGKYMKLGMENSLTE KIPKLNVPLNPKGRKLSAPGQPG LYIDQDELEIDEDEYKEKVHEMQ KLIGLASYVGYKFRFDLLYYINT LAQHILFPSRQVLDMTYELIQFM WDTRDKQLIWHKNKPTEPDNKL VAISDASYGNQPYYKSQIGNIYL LNGKVIGGKSTKASLTCTSTTEA EIHAISESVPLLNNLSYLIQELNK KPIIKGLLTDSRSTISIIKSTNEEKF RNRFFGTKAMRLRDEVSGNNLY VYYIETKKNIADVMTKPLPIKTF KLLTNKWIH (SEQ ID NO: 1598) | |
| Brt | Diversity-generating retroelement | NP_958675.1 | Q775D8 | MGKRHRNLIDQITTWENLLDAY RKTSHGKRRTWGYLEFKEYDLA NLLALQAELKAGNYERGPYREF LVYEPKPRLISALEFKDRLVQHA LCNIVAPIFEAGLLPYTYACRPDK GTHAGVCHVQAELRRTRATHFL KSDESKFFPSIDRAALYAMIDKKI HCAATRRLLRVVLPDEGVGIPIG SLTSQLFANVYGGAVDRLLHDE LKQRHWARYMDDIVVLGDDPEE LRAVFYRLRDFASERLGLKISHW QVAPVSRGINFLGYRIWPTHKLL RKSSVKRAKRKVANFIKHGEDES LQRFLASWSGHAQWADTHNLFT WMEEQYGIACH (SEQ ID NO: 1599) | IPR000477, PF00078, cd01646 |
| RT86 | Retron | AAA61471.1 | P23070 | MKSAEYLNTFRLRNLGLPVMNN LHDMSKATRISVETLRLLIYTADF RYRIYTVEKKGPEKRMRTIYQPS RELKALQGWVLRNILDKLSSSPF SIGFEKHQSILNNATPHIGANFILN IDLEDFFPSLTANKVFGVFHSLGY NRLISSVLTKICCYKNLLPQGAPS SPKLANLICSKLDYRIQGYAGSR GLIYTRYADDLTLSAQSMKKVV KARDFLFSIIPSEGLVINSKKTCIS GPRSQRKVTGLVISQEKVGIGRE KYKEIRAKIHHIFCGKSSEIEHVR GWLSFILSVDSKSHRRLITYISKL EKKYGKNPLNKAKT (SEQ ID NO: 1600) | IPR000477, PF00078, cd03487 |
| TERT | Telomerase | AAG23289.1 | O14746 | MPRAPRCRAVRSLLRSHYREVLP LATFVRRLGPQGWRLVQRGDPA AFRALVAQCLVCVPWDARPPPA APSFRQVSCLKELVARVLQRLCE RGAKNVLAFGFALLDGARGGPP EAFTTSVRSYLPNTVTDALRGSG AWGLLLRRVGDDVLVHLLARCA LFVLVAPSCAYQVCGPPLYQLGA ATQARPPPHASGPRRRLGCERA WNHSVREAGVPLGLPAPGARRR GGSASRSLPLPKRPRRGAAPEPE RTPVGQGSWAHPGRTRGPSDRG FCVVSPARPAEEATSLEGALSGT | IPR000477, PF00078, cd01648 |

TABLE Z1-continued

Exemplary reverse transcriptase domains from different types of sources.
Sources include Group II intron, non-LTR retrotransposon, retrovirus, LTR retrotransposon, diversity-generating retroelement, retron, telomerase, retroplasmid, and evolved DNA polymerase. Also included are the associated RT signatures from the InterPro, pfam, and cd databases. Although the evolved polymerase RTX can perform RNA-dependent DNA polymerization, no RT signatures were identified by InterProScan, so polymerase signatures are included instead.

| Protein | Type | Accession | UniProt | Sequence | RT signatures |
|---|---|---|---|---|---|
| | | | | RHSHPSVGRQHHAGPPSTSRPPR PWDTPCPPVYAETKHFLYSSGDK EQLRPSFLLSSLRPSLTGARRLVE TIFLGSRPWMPGTPRRLPRLPQR YWQMRPLFLELLGNHAQCPYGV LLKTHCPLRAAVTPAAGVCARE KPQGSVAAPEEEDTDPRRLVQLL RQHSSPWQVYGFVRACLRRLVP PGLWGSRHNERRFLRNTKKFISL GKHAKLSLQELTWKMSVRDCA WLRRSPGVGCVPAAEHRLREEIL AKFLHWLMSVYVVELLRSFFYV TETTFQKNRLFFYRKSVWSKLQS IGIRQHLKRVQLRELSEAEVRQH REARPALLTSRLRFIPKPDGLRPI VNMDYVVGARTFRREKRAERLT SRVKALFSVLNYERARRPGLLGA SVLGLDDIHRAWRTFVLRVRAQ DPPPELYFVKVDVTGAYDTIPQD RLTEVIASIIKPQNTYCVRRYAVV QKAAHGHVRKAFKSHVSTLTDL QPYMRQFVAHLQETSPLRDAVVI EQSSSLNEASSGLFDVFLRFMCH HAVRIRGKSYVQCQGIPQGSILST LLCSLCYGDMENKLFAGIRRDGL LLRLVDDFLLVTPHLTHAKTFLR TLVRGVPEYGCVVNLRKTVVNF PVEDEALGGTAFVQMPAHGLFP WCGLLLDTRTLEVQSDYSSYAR TSIRASLTFNRGFKAGRNMRRKL FGVLRLKCHSLFLDLQVNSLQTV CTNIYKILLLQAYRFHACVLQLPF HQQVWKNPTFFLRVISDTASLCY SILKAKNAGMSLGAKGAAGPLPS EAVQWLCHQAFLLKLTRHRVTY VPLLGSLRTAQTQLSRKLPGTTL TALEAAANPALPSDFKTILD (SEQ ID NO: 1601) | |
| Mauriceville RT | Retroplasmid | NC_001570.1 | Q36578 | MPNHRLPNCVSYLGENHELSWL HGMFGLLKRSNPQTGGILGWLN TGPNGFVKYMMNLMGHARDKG DAKEYWRLGRSLMKNEAFQVQ AFNHVCKHWYLDYKPHKIAKLL KEVREMVEIQPVCIDYKRVYIPK ANGKQRPLGVPTVPWRVYLHM WNVLLVWYRIPEQDNQHAYFPK RGVFTAWRALWPKLDSQNIYEF DLKNFFPSVDLAYLKDKLMESGI PQDISEYLTVLNRSLVVLTSEDKI PEPHRDVIFNSDGTPNPNLPKDV QGRILKDPDFVEILRRRGFTDIAT NGVPQGASTSCGLATYNVKELF KRYDELIMYADDGILCRQDPSTP DFSVEEAGVVQEPAKSGWIKQN GEFKKSVKFLGLEFIPANIPPLGE GEVKDYPRLRGATRNGSKMELS TELQFLCYLSYKLRIKVLRDLYIQ VLGYLPSVPLLRYRSLAEAINELS PKRITIGQFITSSFEEFTAWSPLKR MGFFFSSPAGPTILSSIFNNSTNLQ EPSDSRLLYRKGSWVNIRFAAYL YSKLSEEKHGLVPKFLEKLREINF ALDKVDVTEIDSKLSRLMKFSVS AAYDEVGTLALKSLFKFRNSERE SIKASFKQLRENGKIAEFSEARRL WFEILKLIRLDLFNASSLACDDLL SHLQDRRSIKKWGSSDVLYLKSQ RLMRTNKKQLQLDFEKKKNSLK | cd00304 |

TABLE Z1-continued

Exemplary reverse transcriptase domains from different types of sources.
Sources include Group II intron, non-LTR retrotransposon, retrovirus, LTR retrotransposon, diversity-generating retroelement, retron, telomerase, retroplasmid, and evolved DNA polymerase. Also included are the associated RT signatures from the InterPro, pfam, and cd databases. Although the evolved polymerase RTX can perform RNA-dependent DNA polymerization, no RT signatures were identified by InterProScan, so polymerase signatures are included instead.

| Protein | Type | Accession | UniProt | Sequence | RT signatures |
|---|---|---|---|---|---|
| | | | | KKLIKRRAKELRDTFKGKENKEA (SEQ ID NO: 1602) | |
| RTX | Engineered polymerase | QFN49000.1 | — | MILDTDYITEDGKPVIRIFKKENG EFKIEYDRTFEPYLYALLKDDSAI EEVKKITAERHGTVVTVKRVEK VQKKFLGRPVEVWKLYFTHPQD VPAIMDKIREHPAVIDIYEYDIPF AIRYLIDKGLVPMEGDEELKLLA FDIETLYHEGEEFAEGPILMISYA DEEGARVITWKNVDLPYVDVVS TEREMIKRFLRVVKEKDPDVLIT YNGDNFDFAYLKKRCEKLGINF ALGRDGSEPKIQRMGDRFAVEV KGRIHFDLYPVIRRTINLPTYTLE AVYEAVFGQPKEKVYAEEITTA WETGENLERVARYSMEDAKVTY ELGKEFLPMEAQLSRLIGQSLWD VSRSSTGNLVEWFLLRKAYERNE LAPNKPDEKELARRHQSHEGGYI KEPERGLWENIVYLDERSLYPSIII THNVSPDTLNREGCKEYDVAPQ VGHRFCKDFPGFIPSLLGDLLEER QKIKKRMKATIDPIERKLLDYRQ RAIKILANSLYGYYGYARARWY CKECAESVIAWGREYLTMTIKEI EEKYGFKVIYSDTDGFFATIPGA DAETVKKKAMEFLKYINAKLPG ALELEYEGFYKRGLFVTKKKYA VIDEEGKITTRGLEIVRRDWSEIA KETQARVLEALLKDGDVEKAVR IVKEVTEKLSKYEVPPEKLVIHK QITRDLKDYKATGPHVAVAKRL AARGVKIRPGTVISYIVLKGSGRI VDRAIPFDEFDPTKHKYDAEYYI EKQVLPAVERILRAFGYRKEDLR YQKTRQVGLSARLKPKGTLEGSS HHHHHH (SEQ ID NO: 1603) | IPR006134, PF00136, cd05536 |

TABLE Z2

InterPro descriptions of signatures present in reverse transcriptases in Table Z1, as of Mar. 4, 2020.

| Signature | Database | Short Name | Description |
|---|---|---|---|
| cd00304 | CDD | RT like | RT like: Reverse transcriptase (RT, RNA-dependent DNA polymerase)_like family. An RT gene is usually indicative of a mobile element such as a retrotransposon or retrovirus. RTs occur in a variety of mobile elements, including retrotransposons, retroviruses, group II introns, bacterial msDNAs, hepadnaviruses, and cauliviruses. These elements can be divided into two major groups. One group contains retroviruses and DNA viruses whose propagation involves an RNA intermediate. They are grouped together with transposable elements containing long terminal repeats (LTRs). The other group, also called poly(A)-type retrotransposons, contain fungal mitochondrial introns and transposable elements that lack LTRs. [PMID: 1698615, PMID: 8828137, PMID: 10669612, PMID: 9878607, PMID: 7540934, PMID: 7523679, PMID: 8648598] |
| cd01645 | CDD | RT Rtv | RT_Rtv: Reverse transcriptases (RTs) from retroviruses (Rtvs). RTs catalyze the conversion of single-stranded RNA into double-stranded viral DNA for integration into host chromosomes. Proteins in this subfamily contain long terminal repeats (LTRs) and |

TABLE Z2-continued

InterPro descriptions of signatures present in reverse transcriptases in Table Z1, as of Mar. 4, 2020.

| Signature | Database | Short Name | Description |
|---|---|---|---|
| | | | are multifunctional enzymes with RNA-directed DNA polymerase, DNA directed DNA polymerase, and ribonuclease hybrid (RNase H) activities. The viral RNA genome enters the cytoplasm as part of a nucleoprotein complex, and the process of reverse transcription generates in the cytoplasm forming a linear DNA duplex via an intricate series of steps. This duplex DNA is colinear with its RNA template, but contains terminal duplications known as LTRs that are not present in viral RNA. It has been proposed that two specialized template switches, known as strand-transfer reactions or "jumps", are required to generate the LTRs. [PMID: 9831551, PMID: 15107837, PMID: 11080630, PMID: 10799511, PMID: 7523679, PMID: 7540934, PMID: 8648598, PMID: 1698615] |
| cd01646 | CDD | RT_Bac_retron_I | RT_Bac_retron_I: Reverse transcriptases (RTs) in bacterial retrotransposons or retrons. The polymerase reaction of this enzyme leads to the production of a unique RNA-DNA complex called msDNA (multicopy single-stranded (ss)DNA) in which a small ssDNA branches out from a small ssRNA molecule via a 2'-5'phosphodiester linkage. Bacterial retron RTs produce cDNA corresponding to only a small portion of the retron genome. [PMID: 1698615, PMID: 16093702, PMID: 8828137] |
| cd01648 | CDD | TERT | TERT: Telomerase reverse transcriptase (TERT). Telomerase is a ribonucleoprotein (RNP) that synthesizes telomeric DNA repeats. The telomerase RNA subunit provides the template for synthesis of these repeats. The catalytic subunit of RNP is known as telomerase reverse transcriptase (TERT). The reverse transcriptase (RT) domain is located in the C-terminal region of the TERT polypeptide. Single amino acid substitutions in this region lead to telomere shortening and senescence. Telomerase is an enzyme that, in certain cells, maintains the physical ends of chromosomes (telomeres) during replication. In somatic cells, replication of the lagging strand requires the continual presence of an RNA primer approximately 200 nucleotides upstream, which is complementary to the template strand. Since there is a region of DNA less than 200 base pairs from the end of the chromosome where this is not possible, the chromosome is continually shortened. However, a surplus of repetitive DNA at the chromosome ends protects against the erosion of gene-encoding DNA. Telomerase is not normally expressed in somatic cells. It has been suggested that exogenous TERT may extend the lifespan of, or even immortalize, the cell. However, recent studies have shown that telomerase activity can be induced by a number of oncogenes. Conversely, the oncogene c-myc can be activated in human TERT immortalized cells. Sequence comparisons place the telomerase proteins in the RT family but reveal hallmarks that distinguish them from retroviral and retrotransposon relatives. [PMID: 9110970, PMID: 9288757, PMID: 9389643, PMID: 9671703, PMID: 9671704, PMID: 10333526, PMID: 11250070, PMID: 15363846, PMID: 16416120, PMID: 16649103, PMID: 16793225, PMID: 10860859, PMID: 9252327, PMID: 11602347, PMID: 1698615, PMID: 8828137, PMID: 10866187] |
| cd01650 | CDD | RT_nLTR_like | RT_nLTR: Non-LTR (long terminal repeat) retrotransposon and non-LTR retrovirus reverse transcriptase (RT). This subfamily contains both non-LTR retrotransposons and non-LTR retrovirus RTs. RTs catalyze the conversion of single-stranded RNA into double-stranded DNA for integration into host chromosomes. RT is a multifunctional enzyme with RNA-directed DNA polymerase, DNA directed DNA polymerase and ribonuclease hybrid (RNase H) activities. [PMID: 1698615, PMID: 10605110, PMID: 10628860, PMID: 11734649, PMID: 12117499, PMID: 12777502, PMID: 14871946, PMID: 15939396, PMID: 16271150, PMID: 16356661, PMID: 2463954, PMID: 3040362, PMID: 3656436, PMID: 7512193, PMID: 7534829, PMID: 7659515, PMID: 8524653, PMID: 9190061, PMID: 9218812, PMID: 9332379, PMID: 9364772, PMID: 8828137] |

TABLE Z2-continued

InterPro descriptions of signatures present in reverse transcriptases in Table Z1, as of Mar. 4, 2020.

| Signature | Database | Short Name | Description |
|---|---|---|---|
| cd01651 | CDD | RT_G2 intron | RT_G2 intron: Reverse transcriptases (RTs) with group II intron origin. RT transcribes DNA using RNA as template. Proteins in this subfamily are found in bacterial and mitochondrial group II introns. Their most probable ancestor was a retrotransposable element with both gag-like and pol-like genes. This subfamily of proteins appears to have captured the RT sequences from transposable elements, which lack long terminal repeats (LTRs). [PMID: 1698615, PMID: 8828137, PMID: 12403467, PMID: 11058141, PMID: 11054545, PMID: 10760141, PMID: 10488235, PMID: 9680217, PMID: 9491607, PMID: 7994604, PMID: 7823908, PMID: 3129199, PMID: 2531370, PMID: 2476655] |
| cd03487 | CDD | RT_Bac_retron_II | RT_Bac_retron_II: Reverse transcriptases (RTs) in bacterial retrotransposons or retrons. The polymerase reaction of this enzyme leads to the production of a unique RNA-DNA complex called msDNA (multicopy single-stranded (ss)DNA) in which a small ssDNA branches out from a small ssRNA molecule via a 2'-5'phosphodiester linkage. Bacterial retron RTs produce cDNA corresponding to only a small portion of the retron genome. [PMID: 1698615, PMID: 8828137, PMID: 11292805, PMID: 9281493, PMID: 2465092, PMID: 1722556, PMID: 1701261, PMID: 1689062] |
| cd03715 | CDD | RT_ZFREV_like | RT_ZFREV_like: A subfamily of reverse transcriptases (RTs) found in sequences similar to the intact endogenous retrovirus ZFERV from zebrafish and to Moloney murine leukemia virus RT. An RT gene is usually indicative of a mobile element such as a retrotransposon or retrovirus. RTs occur in a variety of mobile elements, including retrotransposons, retroviruses, group II introns, bacterial msDNAs, hepadnaviruses, and caulimoviruses. These elements can be divided into two major groups. One group contains retroviruses and DNA viruses whose propagation involves an RNA intermediate. They are grouped together with transposable elements containing long terminal repeats (LTRs). The other group, also called poly(A)-type retrotransposons, contain fungal mitochondrial introns and transposable elements that lack LTRs. Phylogenetic analysis suggests that ZFER V belongs to a distinct group of retroviruses. [PMID: 14694121, PMID: 2410413, PMID: 9684890, PMID: 10669612, PMID: 1698615, PMID: 8828137] |
| cd05536 | CDD | POLBc B3 | DNA polymerase type-B B3 subfamily catalytic domain. Archaeal proteins that are involved in DNA replication are similar to those from eukaryotes. Some members of the archaea also possess multiple family B DNA polymerases (B1, B2 and B3). So far there is no specific function(s) has been assigned for different members of the archaea type B DNA polymerases. Phylogenetic analyses of eubacterial, archaeal, and eukaryotic family B DNA polymerases are support independent gene duplications during the evolution of archaeal and eukaryotic family B DNA polymerases. Structural comparison of the thermostable DNA polymerase type B to its mesostable homolog suggests several adaptations to high temperature such as shorter loops, disulfide bridges, and increasing electrostatic interaction at subdomain interfaces. [PMID: 10997874, PMID: 11178906, PMID: 10860752, PMID: 10097083, PMID: 10545321] |
| cd05780 | CDD | DNA_polB_Kod1_like exo | The 3'-5' exonuclease domain of archaeal family-B DNA polymerases with similarity to *Pyrococcus kodakaraensis* Kod1, including polymerases from *Desulfurococcus* (D. Tok Pol) and *Thermococcus gorgonarius* (Tgo Pol). Kod1, D. Tok Pol, and Tgo Pol are thermostable enzymes that exhibit both polymerase and 3'-5' exonuclease activities. They are family-B DNA polymerases. Their amino termini harbor a DEDDy-type DnaQ-like 3'-5' exonuclease domain that contains three sequence motifs termed ExoI, ExoII and ExoIII, with a specific YX(3)D pattern at ExoIII. These motifs are clustered around the active site and are involved in metal binding and catalysis. The exonuclease domain of family B polymerases contains a beta hairpin structure that plays an important role in active site switching in the event of nucleotide |

TABLE Z2-continued

InterPro descriptions of signatures present in reverse transcriptases in Table Z1, as of Mar. 4, 2020.

| Signature | Database | Short Name | Description |
|---|---|---|---|
| | | | misincorporation. Members of this subfamily show similarity to eukaryotic DNA polymerases involved in DNA replication. Some archaea possess multiple family-B DNA polymerases. Phylogenetic analyses of eubacterial, archaeal, and eukaryotic family-B DNA polymerases support independent gene duplications during the evolution of archaeal and eukaryotic family-B DNA polymerases. [PMID: 18355915, PMID: 16019029, PMID: 11178906, PMID: 10860752, PMID: 10097083, PMID: 10545321, PMID: 9098062, PMID: 12459442, PMID: 16230118, PMID: 11988770, PMID: 11222749, PMID: 17098747, PMID: 8594362, PMID: 9729885] |
| PF00078 | Pfam | RVT 1 | A reverse transcriptase gene is usually indicative of a mobile element such as a retrotransposon or retrovirus. Reverse transcriptases occur in a variety of mobile elements, including retrotransposons, retroviruses, group II introns, bacterial msDNAs, hepadnaviruses, and caulimoviruses. [PMID: 1698615] |
| PF00136 | Pfam | DNA_pol B | This region of DNA polymerase B appears to consist of more than one structural domain, possibly including elongation, DNA-binding and dNTP binding activities. [PMID: 9757117, PMID: 8679562] |
| PF07727 | Pfam | RVT 2 | A reverse transcriptase gene is usually indicative of a mobile element such as a retrotransposon or retrovirus. Reverse transcriptases occur in a variety of mobile elements, including retrotransposons, retroviruses, group II introns, bacterial msDNAs, hepadnaviruses, and caulimoviruses. This Pfam entry includes reverse transcriptases not recognised by the Pfam:PF00078 model. [PMID: 1698615] |
| IPR000477 | InterPro | RT_dom | The use of an RNA template to produce DNA, for integration into the host genome and exploitation of a host cell, is a strategy employed in the replication of retroid elements, such as the retroviruses and bacterial retrons. The enzyme catalysing polymerisation is an RNA-directed DNA-polymerase, or reverse trancriptase (RT) (2.7.7.49). Reverse transcriptase occurs in a variety of mobile elements, including retrotransposons, retroviruses, group II introns [PMID: 12758069], bacterial msDNAs, hepadnaviruses, and caulimoviruses. Retroviral reverse transcriptase is synthesised as part of the POL polyprotein that contains; an aspartyl protease, a reverse transcriptase, RNase H and integrase. POL polyprotein undergoes specific enzymatic cleavage to yield the mature proteins. The discovery of retroelements in the prokaryotes raises intriguing questions concerning their roles in bacteria and the origin and evolution of reverse transcriptases and whether the bacterial reverse transcriptases are older than eukaryotic reverse transcriptases [PMID: 8828137]. Several crystal structures of the reverse transcriptase (RT) domain have been determined [PMID: 1377403]. |
| IPR006134 | InterPro | DNA-dir_DNA_pol_B_multi_dom | DNA is the biological information that instructs cells how to exist in an ordered fashion: accurate replication is thus one of the most important events in the life cycle of a cell. This function is performed by DNA- directed DNA-polymerases 2.7.7.7) by adding nucleotide triphosphate (dNTP) residues to the 5' end of the growing chain of DNA, using a complementary DNA chain as a template. Small RNA molecules are generally used as primers for chain elongation, although terminal proteins may also be used for the de novo synthesis of a DNA chain. Even though there are 2 different methods of priming, these are mediated by 2 very similar polymerases classes, A and B, with similar methods of chain elongation. A number of DNA polymerases have been grouped under the designation of DNA polymerase family B. Six regions of similarity (numbered from I to VI) are found in all or a subset of the B family polymerases. The most conserved region (I) includes a conserved tetrapeptide with two aspartate residues. It has been suggested that it may be involved in binding a |

TABLE Z2-continued

InterPro descriptions of signatures present in reverse transcriptases in Table Z1, as of Mar. 4, 2020.

| Signature | Database | Short Name | Description |
|---|---|---|---|
| IPR013103 | InterPro | RVT 2 | magnesium ion. All sequences in the B family contain a characteristic DTDS motif (SEQ ID NO: 1604), and possess many functional domains, including a 5'-3' elongation domain, a 3'-5' exonuclease domain [PMID: 8679562], a DNA binding domain, and binding domains for both dNTP's and pyrophosphate [PMID: 9757117]. This domain of DNA polymerase B appears to consist of more than one activities, possibly including elongation, DNA-binding and dNTP binding [PMID: 9757117]. A reverse transcriptase gene is usually indicative of a mobile element such as a retrotransposon or retrovirus. Reverse transcriptases occur in a variety of mobile elements, including retrotransposons, retroviruses, group II introns, bacterial msDNAs, hepadnaviruses, and caulimoviruses. This entry includes reverse transcriptases not recognised by IPR000477 [PMID: 1698615]. |

Tables 3A and 3B (below) show exemplary Gene Writer proteins and associated sequences from a variety of retrotransposases, identified using data mining. Column 1 indicates the family to which the retrotransposon belongs. Column 2 lists the element name. Column 3 indicates an accession number, if any. Column 4 lists an organism in which the retrotransposase is found. Column 5 lists the predicted 5' untranslated region, and column 6 lists the predicted 3' untranslated region; both are segments that are predicted to allow the template RNA to bind the retrotransposase of column 7. (It is understood that columns 5-6 show the DNA sequence, and that an RNA sequence according to any of columns 5-6 would typically include uracil rather than thymidine.) Column 7 lists the predicted retrotransposase amino acid sequence. For Table 3B, column 8 lists the predicted RT domain present based on sequence analysis, column 9 lists the start codon position, and column 10 lists the stop codon position.

Lengthy table referenced here

US12037602-20240716-T00001

Please refer to the end of the specification for access instructions.

Lengthy table referenced here

US12037602-20240716-T00002

Please refer to the end of the specification for access instructions.

Table 10. provides a listing of non-LTR retrotransposase systems with annotation of reverse transcriptase domain signatures.

A database of retrotransposase proteins and the associated retrotransposon 5'UTRs and 3'UTRs for use in novel Gene Writing systems. Reverse transcriptase domains in the proteins described here were identified using conserved RT signatures, and annotated to indicate the presence and location of RT domains within the polypeptide sequences. In some embodiments, a system or method described herein involves a polypeptide having an amino acid sequence according to Table 10, or a sequence having at least 70%, 75%, 80%, 85%, 90%, 95%, 96%, 97%, 98%, or 99% identity thereto, or a functional fragment thereof. In some embodiments, a system or method described herein involves a domain (e.g., a reverse transcriptase domain) having an amino acid sequence according to a domain (e.g., a reverse transcriptase domain) of Table 10, or a sequence having at least 70%, 75%, 80%, 85%, 90%, 95%, 96%, 97%, 98%, or 99% identity thereto, or functional fragment thereof. In some embodiments, a system or method described herein involves a template RNA comprising a sequence according to one or both of a predicted 5' UTR and a predicted 3' UTR of Table 10, or a sequence having at least 70%, 75%, 80%, 85%, 90%, 95%, 96%, 97%, 98%, or 99% identity thereto, or functional fragment thereof.

Lengthy table referenced here

US12037602-20240716-T00003

Please refer to the end of the specification for access instructions.

Table 11 provides Gene Writers comprising novel retrotransposon elements from Table 10 above, altered for improved efficiency of integration into the human genome. Retrotransposase polypeptides were improved through consensus mapping to rederive the optimal amino acid sequence, listed here as the "Consensus Optimized Protein Sequence", as described in Example 5. As described in Example 6, Template molecules for use with cognate retrotransposase enzymes were mapped back to their host genomes and flanking genomic DNA used to elucidate target site motifs. When detectable, conserved sequence motifs from the flanking genomic DNA of endogenous occurrences of an element were aligned to the human genome, and new sequences were derived from the human genome as 5' or 3' "Human Homology Arms." In some embodiments, a template RNA described herein comprises one or both of a first homology domain comprising a sequence of a 5' Human Homology Arm of Table 11 (or a sequence having at least 80%, 85%, 90%, 95%, 96%, 97%, 98%, or 99% identity thereto) and a second homology domain comprising a sequence of a 3' Human Homology Arm of Table 11 (or a sequence having at least 80%, 85%, 90%, 95%, 96%, 97%, 98%, or 99% identity thereto).

Table 11. Retrotransposase systems with improved integration activity.

TABLE 11

Retrotransposase systems with improved integration activity

| Element | Predicted Target motif | Consensus Optimized Protein Sequence | 5' Human Homology Arm | 3' Human Homology Arm |
|---|---|---|---|---|
| L2-18_ACar | CCACAAGGCCCTGGC AGGGCTtaaa (SEQ ID NO: 3350) | | AGTAGACTGCAGCCC CAGGCCCTTTCCATC TGGGTGTGACTCAGC ACTTCCTAGGAAGGA CCATCTATAAAGCCT GAGTCCACAAGGCCC TGGCAGGGCT (SEQ ID NO: 3365) | taaa |
| CR1_AC_1 | GTGTGAGTTTCTGCC AGAGCCattctatga (SEQ ID NO: 3351) | | ccacggcacctggcc cagtgttttttaata caaattatagcctat ggatcccactgagga cctctgtttgtgaga ctgggtgtgagttgc tgtcagagcc (SEQ ID NO: 3366) | attctgcaaacctcc agtgaggggaaggtt gagggcagtggttgg tgctcacggtggtgc tgctcaaaactgaca ggcagacacccggcc tccagcttgc (SEQ ID NO: 3373) |
| RTE-1_Aip | Tacaaggctttgttg ttgttgttgttgttt ttttt (SEQ ID NO: 3352) | | TA | caaggctttgttgtt gttgttgttgttttt ttt (SEQ ID NO: 3374) |
| Dong-1_MMa | GGTTCAACGGGCCGG GCCCGGtaataataa taataaaa (SEQ ID NO: 3353) | MKANPAMETRSMRNR RMRSPEEGAPTGAGP GTGDRASGQRLEEDN VQERPSSQRAQPVPR TRNRNGSSRNHQGHA APTDVAVADRRQSLT LAGGRRQRIMWTREM NMYVIRCYYVCTRME TDMSGRSGMLEMFNE RFPRFARQLDLNKLY TRQRAIMSHNMLTAA EVEYIKLEVQREIGE EGTRSSDTSRRSSVG LDAPITSESRDSPAP TAPGPTADMQRQQLR DELALHMGTAVTQFR GTDPMSRHRIPKLRY SYRLTSAVSILNQDI LPQYLEAVENLEDLQ FIVYSAAIAVVKTLG LRTRPQGEDGTRPNA QKPVWMRRLESRIAT LRSKVGRLTQYKQGN RSTRLVRHVAEIVRP AELRDLREVDITEIL DTHVORLSALAKRLR RYGECSKRKEQNRMF NINEREFYNRIRNDK VDFGEGLPEIGDVTQ FWANLWENPTEHDGD GMWLAEEERQCDGIG DMTAVVVTAQDIREA TRYTRNWAAPGPDFV HNFWYKKLTTIHGRM AECFNTVLGDPTQLP EFITRGVTFLLPKDQ HTADPAKYRPITCLS SLYKVLSSVIARRVQ AHCDANNVMTEEQKG CRRNTQGCKDQVIVD AVIVGQATQKORNLS MAYIDYKKAYDSVPH SYLLKVLQLYKVDGN VIRLMQHAMGMWSTS LHITDGTAVLRSRTL SIRRGIFQGDTFSPL WFCLAMNPLSKALNQ | AAGGATGGGGTTCAA CGGGCCGGGCCCGG (SEQ ID NO: 3367) | taataataataataa aa (SEQ ID NO: 3375) |

TABLE 11-continued

Retrotransposase systems with improved integration activity

| Element | Predicted Target motif | Consensus Optimized Protein Sequence | 5' Human Homology Arm | 3' Human Homology Arm |
|---|---|---|---|---|
| | | CNYGYQLKSGERSTR VTHTFYMDDLKLFAE SVQRLHQLLQLVTTF SNDIRMEFGIDKCRS IHLRRGQVMDASCFR VNEQEEIRNMVEGET YKYLGFLQLRGIRHT MIKKELQEKFLSRVN CILKSFLSAGNKVKA INTFAVPLLTYSFGV VKWTKTDLEAIERAV RVAFTKHRMRHPKSS IERVTLPRAAGGRGV TDIQALCVSQIQQLR AYFVESQNRHEIYRT VCEADHGFSALHLAQ EDYQLNCDIKTVDEM IAMWKQKELHGTHPH QLELEHIDKVASNTW LVRGDLFSETEGFMV AIQDRVIATKNYRHY ILHEDVEDRCRKCNS VGETIEHVVAGCSVL AGSAYLDRHNEVAKI VHQQLALKHNLVDRF VPYYKYLPDPVLENS CIKLYWDREIITDVL IRANRPDIVVYDKRM KRVTLIDIAVPLDHN VQSTFSNKIAKYHDL AEELKQMWHLEDVRI VPVVLSATGIVPKSL LRSLDELELKKDLHS IQKAVILGTCSIVRR FLNHHN (SEQ ID NO: 3360) | | |
| L2-2_DRe | TGAGCACGGTAGCAT TAGT CGa (SEQ ID NO: 3354) | MCFLIPVVTNTRKTR EVRCRRNPHNLRSIH VSTISQLSLSVGLWN CQSAVNKADFITSIA TYSDYNLMALTETWL RPEDTATHATLSANF SFSHTPRQTGRGGGT GLLISKEWKFTLIPS LPTISSFEFHAVTII HPFYINVVVIYRPPG KLGHFLDELDVLLSS FSNFATPLLVLGDFN IYVDKPQAADFQTLL ASFDLKRAPTSATHK SGNQLDLIYTRHCFT DQTIVTPLQISDHFL LSLNIHITPEPPHTP TLVTFRRNLRSLSPN RLSTIVSDSLPPSRK LTALDSNSATNTLCS TLASCLDRLCPLASR PARASPPAPWLSDAL REHRSKLRAAERIWR KTKNPAHLLTYQTLL SSFSAEVTSAKQTYY RLKINNATNPRLLFK TFSSLLYPPPPPASS TLTTDDFATFFCTKTA KISAQFAAPTTNTQD TTPTPHTLTSFSQLS ESEVSKLVLSSHATT CPLDPIPSHLLQAIS PAVIPTLTHIINTSL DSGLFPTTFKQARVT PLLKKPNLDHTLLEN YRPVSLLPFMAKILE | GTTTCGCGTCGTCCG CCTCAGTTTCGGCCC TTGTTTTGACTCGGG AGGCGTGTCCAAACG CCAGGTAACCACTAT ATAGTGAGCACGGTA GCATTAGTCG (SEQ ID NO: 3368) | a |

TABLE 11-continued

Retrotransposase systems with improved integration activity

| Element | Predicted Target motif | Consensus Optimized Protein Sequence | 5' Human Homology Arm | 3' Human Homology Arm |
|---|---|---|---|---|
| | | KVVFNQVLDFLTQNN LMDNKQSGFKKGHST ETALLSVVEDLRLAK ADSKSSVLILLDLSA AFDTVNHQILLSTLE SLGVAGTVIQWFRSY LSDRSFRVSWRGEVS NLQHLNTGVPQGSVL GPLLFSIYTSSLGPV IQRHGFSYHCYADDT QLYLSFHPDDPSVPA RISACLLDISHWMKD HHLQLNLAKTEMLVV SANPTLHHNFSIQMD GATITASKMVKSLGV TIDDQLNFSDHISRT ARSCRFALYNIRKIR PFLSEHAAQLLVQAL VLSKLDYCNSLLAGL PANSIKPLQLLQNAA ARVVFNEPKRAHVTP LLVRLHWLPVAARIK FKALMFAYKVTSGLA PSYLLSLLQIYVPSR NLRSVNERRLVVPSQ RGKKSLSRTLTLNLP SWWNELPNCIRTAES LAIFKKRLKTQLFSL HFTS (SEQ ID NO: 3361) | | |
| R4-1_AC | AAATAATAATAATAA TAATAATAATAATAA TAATAATAATAATAA Tcaataaaaataata ataatattattatta taa (SEQ ID NO: 3355) | MENQTQTKSILARSS PRIKRTAVDAADSGH PSTSGLRNHQNPNEQ SQKRQKYTMPENRTI MKCYYKSEPQRRGYQ KRMHQLWKQEYPDSQ ITEPRLADQRRFIIR NKVFSEVELEEIQKI CKVDYHQTTAQTAAE TPATLGMVEQIEPEE SVALLQEFEEPALET SVEPPGTLTARQQEL KDKIMAHAAANAIRQ RLPTLKTVPKRHLAP LMKDVNAALSTVQIT SIEQTNQFAYSAAVI VTEELGLLQPRQPQR KSTGKPKWKVRLELK IKKLRSDASNLKNMK ERKLKNDKIKQYLIR KYWLNTRKIEEALEI VKEQITATARKIERY EARIIQYRQNQLFQS DQRRFYQSLNQTTDT VTIKPEKTATTKFWK ELWENNKNYNKNAGW IKEFEGKFSQNKMEL MEITTEMISKRVQKV KNWTSPGSDQLHGFW LKHLISLHGKMAQQF NEMLQKGSISEWLTT GRTYLIQKDPAKGAA PGNYRPITCLPTMFK LLTGIIADRIQDYLE EKNILPDEQKGNKRK SRGTKDQLLIDKMIL ENCKSRKANLHMTWI DYKKAFDSLPHSWII KCLDAIGICKTVGTF IENMMEHWKTELFVG NESYGLVNIRRGIFQ | caataaaaataataa taatattattattat aa (SEQ ID NO: 3369) | 'AATAATAATAATAA TAATAATcaataaaa ataataataata' (SEQ ID NO: 2086) |

TABLE 11-continued

Retrotransposase systems with improved integration activity

| Element | Predicted Target motif | Consensus Optimized Protein Sequence | 5' Human Homology Arm | 3' Human Homology Arm |
|---------|------------------------|--------------------------------------|-----------------------|-----------------------|
| | | GDSLSPLLFIIAMIP LSTILQKTNLGYQIS KNSHKISHLMYMDDL KLYGKTETEIQSLTN TVRIFSTDINMEFGL DKCSTVALKKGKIIE SEGINMPNGQTIKCHQP EAYKYLGILQLDNIKHE HVKTVVSKEYTQRVR KILKSKLNGGNTIKA INTWAIPVIRYTAGI INWTQVELDNLDRKT RKLMTIHHSLHPRSD VDRLYLPRRSGGRGL LQVKQAVKEEEHALA EYVKQSEEPALIEVK NQKLLKTQQTKNQYK KTALQTRADSWHNKT LHGKFLDKIEGKADK EKTWLWLTNGTLKKE TEGLILAAQEQAIRT NAIKAKIEKSADDPK CRLCKETDETIDHIL SCCKKIAQTDYKQRH NYVAQMIHWNLCLKY HLPAAKNWWDHKPAK VLENEHAKILWDFRI QTDKVLEHNTPDITV VEKNKVWIIDVAIPG DSRIDEKQQEKLSRY QDLKIELQRLWQKPV QVVPVVMGTLGAVPK DLSRHLETIDIDKIT ICQLQKATLLGSAHI IRKYITQS (SEQ ID NO: 3362) | | |
| R4-1_PH | TAATAATAATAATAA TAtaataataat (SEQ ID NO: 3356) | MKMSHNRDTPSNGVK GTSVRLGTSLVRSPV GEAGAVRERGTHPSE SVSQDSDASVNATGE GSVREQAPLSPPGAE EATVPTQRRTRHKWS REDRVVLWECFVASK REGPGYLKRLKQLWD ERGIPGNFPQASLSG QIRQICSKNLLSEEE RLQIAARMEAQVASP SADEPARQVPTRPVT PPRSPPVEPARRPSI PSEETPDLGAVPSEI DSADPNRSPSRGPRH LPAHNMSQSESEDDV TDPDVSDQQRSDSLE PRDLLRNSSVESTPG HPNQELSDTLLSNYV PSEIDSDDPNQSPRR GPRHLPAHDMSLSDS MDEETEPDLSDQQRS DLLELRDLLRNSSVE TTPKGHPSLRHLPEP KIRAAAFRVNSVIGK IHTNNITETNALIKA GADLAVRILEVQPRP QRTQRKKDPPWKHRL EKNIAEIRKHLSWIS EWRRGNLHDEEKKTL LESRYRCLEVGLTNL EDTLKQRLSAKRSKV RRFEARVAGFHQNQL FNTNQKRLYQTLRGE ETSSDSPNAEESIRF WSDIWSKEVRHNNTA | TAATAATAATAATAA TA (SEQ ID NO: 3370) | taataataat (SEQ ID NO: 2251) |

TABLE 11-continued

Retrotransposase systems with improved integration activity

| Element | Predicted Target motif | Consensus Optimized Protein Sequence | 5' Human Homology Arm | 3' Human Homology Arm |
|---|---|---|---|---|
| | | EWLHDVKEKNVAADP DLTITSQQLKKQLSK TKNWKAPGPDMVQGY WIKTFTSLHSRIAAQ LNHCLQRGTVPTWMT TGKTVLIQKDKAKGT EVSNYRPITCLPLMW KVLTGIIYERVYQHL DSKKLLPDEQKGCRR NTRGTKDHLLVDKLL TKDARSKKKNLSMAW VDYKKAFDMVPHSWI LECLDIYGIAGNIRN LIATTMPNWKTQLTS ANKHLGEVSIKRGIF QGDSLSPLLFVLTMI PLSETLNKAGQGYNY SRTMKLNHLLYMDDL KLYAKSKDQVEQLLN IVHQYSQDIKMQFGV SKCGVLNIERGEVTA SEGITIEEGTIKDIE EAGYKYLGVMEYNTI LHRTMKDSIRKEYLT RLRLILKSHLNGGNT IKAINTWAVPVVRYS AGIINWTKKDCTDMD IKTRKLMTIYRALHP RSCVDRLYINRREGG RGLISVEDCVEAEKR ALSQHFRESDDPWAR CLVEAKLLKETETAD QFKERRRLDRTNKWK SMKMSGQYLEAVQDK IVPDSWNWLLRGELK RETEGTILAAQEQAL RTRYIQNKIDKRNVP STCRICRSSDETINH VISECGVLAQKEYKR RHDKVARHLHWTLLR IHNFPVSERWYEHEP APVVENEAVQIYWDK RMETDRVLHANRPDI VVKDKQEKSAKLIDI SIPFDSRIVDKEAEK KEKYRDLAIELQRLW QMKVDVVPVVIGALG AMSKNLKTALRELKC GHLHPGTLQKSALLG TAHIIRKVL (SEQ ID NO: 1499) | | |
| Tad1-65B_BG | ATGCGGAATCAGGGA TGACCATGGATTCTT TGGCTGTGGGTAGAG TCCTTTCTAACCCAG CGAAGGATAAGGGTG CGGTACCGTAATGGA ACGACGCGGGtcaaa tcaaatcaaatcaaa tcaaatcaaatcaaa tcaaatcaaatcaaa tcaaatcaaatcaaa tcaaatcaaatcaaa tcaaa (SEQ ID NO: 3357) | | ATGCGGAATCAGGGA TGACCATGGATTCTT TGGCTGTGGGTAGAG TCCTTTCTAACCCAG CGAAGGATAAGGGTG CGGTACCGTAATGGA ACGACGCGGG (SEQ ID NO: 3371) | tcaaatcaaatcaaa tcaaatcaaatcaaa tcaaatcaaatcaaa tcaaatcaaatcaaa tcaaatcaaatcaaa tcaaatcaaatcaaa tcaaatcaaa (SEQ ID NO: 2611) |
| L2-24_Acar | CTAACCTCCGCAGGG GTGGTGGAataaa (SEQ ID NO: 3358) | MPIKMVRPRRLMDPN GFLMALGDVPASSVG DSVDALVTLYNGEMA RAIDTIAPERPLAMR | CTAACCTCCGCAGGG GTGGTGGA (SEQ ID NO: 3372) | ataaa |

TABLE 11-continued

Retrotransposase systems with improved integration activity

| Element | Predicted Target motif | Consensus Optimized Protein Sequence | 5' Human Homology Arm | 3' Human Homology Arm |
|---|---|---|---|---|
| | | RAKLAPWFSGELAAM KRETRRLERVWRKRR SESNLERVKAQRKTY CKAMAAVKKTYYSSR IEAAKNRPAELFRTV RGLLNNTPQTAPTDD VAEKCEAFSQFFSKK IALIRSELDATVDAI SEDVARAPACPILMD SFQSVQPEDVDKVLG EARATTCILDPCPSW LVKEARGGLVEWVRV VVNASLREGRLPAGL KQAVIKPLLKKPSLD PTNWNNFRPVSNLPF LGKVVERVVASQLQG FLEATDYLDPAQSGFR PGHGTETALVSLVDD LRRELDRGSVSLLVL LDLSAAFDTVDHGIL LGRLVGMGLGGTALQ WLQSFLEDRTQKVLI GDSCSAPQPLSCGVP QGSVLSPLLFNIYMK PLGEIIRSFGVRCHL YADDVQLYHSFSPAS KEAVQILNRCLAAVS DWMRANKLKLNPDKT EVLLVSRKAEQGIGL QPVLDGVALPLKAQV RSLGVLLDSSLSLEP QVSAVARGAFAQLKL VRQLRPYLGKPDMAT VVHALVTSRLDYCNA LYVGLPSKTVRKLEL VQRSAARLLTGAPYR EHTTPLLKQLHWLPV SFRAQFKVLALAYKT LNGSGPTYLSERISP YEPPRRLRSSSEALL SVPPPSQVHLAGTRD RAFSVVAPRLWNSLP REIREAPSLMSFRKQ LKTWMWDQAFGPS (SEQ ID NO: 3363) | | |
| LINE1-2_ZM | CTGAGGCCTTATTAT TGTCTCCTCCGGTTG AGGCTGTCATGTCTA CTACTGCTATGTTGG GGGCCATGGCTCCGG GCCCTGAGCATATCC AGGGTCCCTTaagtg (SEQ ID NO: 3359) | MNLSNILVWNARGLN NKARRDYVRDTILSS KADIICLQETKVASF SSHLLLSVCGSDFDK FLTLPAVGTRGGILI AWKGAVCQVISSRID NFSVSVQFAGMDGMN WWFTGVYGPQEDDRK IQFLQELLDFRTLCS GPWLLSGDFNMIYQA ADKNNANLNRALMGR FRRFLDDCLLKEIPL HGRKFTWSNERSSPT LVRLDRVFCCNDWED FFPNSLLQSASSGVS DHCPLILSLNVQTHK KRRFHFESYWPKLPG FLEAVSHSWNAPVSI ACPVEGIFLKLQRLS KGLQKWSHHKVGNVK LQLATAKEILHRLEI ARDNRVLSPGEEWLR KKLKLHCLGLASLER TIARLRSRILYLQEG DANTSFFHQQARYRK KKNFIAKFQVEERIV TSQEEKQQAALDFYD | | |

TABLE 11-continued

Retrotransposase systems with improved integration activity

| Element | Predicted Target motif | Consensus Optimized Protein Sequence | 5' Human Homology Arm | 3' Human Homology Arm |
|---|---|---|---|---|
| | | NLLGTAEHRDYTLDL HSLGIQQHDLGDLEL VFSMEEVWSVVKDLP LDKAPGPDGFTGRFY KVCWDIIKEDMMGAL LAVQCGHVSKLKLLN TTFITLLPKKVDALL VKDYRPISLVHSFAK LVTKVLAARLAPHLP SMVSINQSAFIKGRS IQDNFLLVQQLTRSL HHSKEPHILLKLDIS KAFDSISWPFLLDML QHLGFGRSWCNLISL LLCTSSTRILVNGEP GEYILHHRGLRQGDP LSPMLFILVMEALNA MVSYAFREHMLQPIA NQHAKHCISFYADDV VLFMRPSHQDISAII SILDIFGHATGLKTN ISKSSVTPIQCGANE LTTISALLPCATKNF PCTYLGIPLSIRRLA NSDLLPLVDKVADKL PGWKANLLSRAGRLV MVKTVLSSVPIYLML ALELPKWVFKAIDKR RRGFLWKGQGDANGG NCLVSWEAVQRPLKY GGLGILNLEMFGWAL RARWLWLQKTDASRP WAGLPIRVHRNAKAL VDVAITSVVGSGESV KFWSDRWLLGKTVAE HCPTLIQVISRRALK RRTVAEGLTNRQWVS DIRGGLSVTVLVEYL QLWNLVDGVVLQPDI ADQHIWRLSAHGTYC SKSAYDALFVGSIPF GPWRRVWKTWAPLRC KFFVWLAIKNRVWTA DRLAKRGLPHPVACP LCDQAEETIQHILVS CVFARQIWTSMLHNL GLLAIVPQHGCTRFS NWWCQSIKKVEKSLR KGLNSLIILVAWEIW KHRNACVFEGVVPCT QRVQSAVIEEGNVWC LAGASALQDLLLRQL PRGP (SEQ ID NO: 3364) | | |

Gene Writers, e.g. Thermostable Gene Writers

While not wishing to be bound by theory, in some embodiments, retrotransposases that evolved in cold environments may not function as well at human body temperature. This application provides a number of thermostable Gene Writers, including proteins derived from avian retrotransposases.

Thermostability may be measured, e.g., by testing the ability of a Gene Writer to polymerize DNA in vitro at a high temperature (e.g., 37° C.) and a low temperature (e.g., 25° C.). Suitable conditions for assaying in vitro DNA polymerization activity (e.g., processivity) are described, e.g., in Bibillo and Eickbush, "High Processivity of the Reverse Transcriptase from a Non-long Terminal Repeat Retrotransposon" (2002) JBC 277, 34836-34845. In some embodiments, the thermostable Gene Writer polypeptide has an activity, e.g., a DNA polymerization activity, at 37° C. that is no less than 70%, 75%, 80%, 85%, 90%, or 95% of its activity at 25° C. under otherwise similar conditions.

In some embodiments, a GeneWriter polypeptide (e.g., a sequence of Table 1, 2, 3A, or 3B or a sequence having at least 70%, 75%, 80%, 85%, 90%, 95%, 96%, 97%, 98%, or 99% identity thereto) is stable in a subject chosen from a mammal (e.g., human) or a bird. In some embodiments, a GeneWriter polypeptide described herein is functional at 37° C. In some embodiments, a GeneWriter polypeptide described herein has greater activity at 37° C. than it does at a lower temperature, e.g., at 30° C., 25° C., or 20° C. In some embodiments, a GeneWriter polypeptide described herein has greater activity in a human cell than in a zebrafish cell.

In some embodiments, a GeneWriter polypeptide is active in a human cell cultured at 37° C., e.g., using an assay of Example 6 or Example 7 of PCT Application No. PCT/US2019/048607, incorporated herein by reference in its entirety.

In some embodiments, the assay comprises steps of: (1) introducing HEK293T cells into one or more wells of 6.4 mm diameter, at 10,000 cells/well, (2) incubating the cells at 37° C. for 24 hr, (3) providing a transfection mixture comprising 0.5 µl if FuGENE® HD transfection reagent and 80 ng DNA (wherein the DNA is a plasmid comprising, in order, (a) CMV promoter, (b) 100 bp of sequence homologous to the 100 bp upstream of the target site, (c) sequence encoding a 5' untranslated region that binds the Gene Writer protein, (d) sequence encoding the Gene Writer protein, (e) sequence encoding a 3' untranslated region that binds the Gene Writer protein (f) 100 bp of sequence homologous to the 100 bp downstream of the target site, and (g) BGH polyadenylation sequence) and 10 µl Opti-MEM and incubating for 15 min at room temperature, (4) adding the transfection mixture to the cells, (5) incubating the cells for 3 days, and (6) assaying integration of the exogenous sequence into a target locus (e.g., rDNA) in the cell genome, e.g., wherein one or more of the preceding steps are performed as described in Example 6 of PCT Application No. PCT/US2019/048607, incorporated herein by reference in its entirety.

In some embodiments, a Gene Writer system is capable of producing a substitution into the target site of at least 1, 2, 3, 4, 5, 6, 7, 8, 9, 10, 15, 20, 25, 30, 35, 40, 45, 50, 60, 70, 80, 90, or 100 or more nucleotides. In some embodiments, the substitution is a transition mutation. In some embodiments, the substitution is a transversion mutation. In some embodiments, the substitution converts an adenine to a thymine, an adenine to a guanine, an adenine to a cytosine, a guanine to a thymine, a guanine to a cytosine, a guanine to an adenine, a thymine to a cytosine, a thymine to an adenine, a thymine to a guanine, a cytosine to an adenine, a cytosine to a guanine, or a cytosine to a thymine.

In some embodiments, a Gene Writer system is capable of producing an insertion into the target site of at least 45, 50, 55, 60, 65, 70, 75, 80, 85, 90, 95, or 100 nucleotides (and optionally no more than 500, 400, 300, 200, or 100 nucleotides). In some embodiments, a Gene Writer system is capable of producing an insertion into the target site of at least 1, 2, 3, 4, 5, 6, 7, 8, 9, 10, 15, 20, 25, 30, 35, 40, 45, 50, 55, 60, 65, 70, 75, 80, 85, 90, 95, or 100 nucleotides (and optionally no more than 500, 400, 300, 200, or 100 nucleotides). In some embodiments, a Gene Writer system is capable of producing an insertion into the target site of at least 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases (and optionally no more than 1, 5, 10, or 20 kilobases). In some embodiments, a Gene Writer system is capable of producing a deletion of at least 81, 85, 90, 95, 100, 110, 120, 130, 140, 150, 160, 170, 180, 190, or 200 nucleotides (and optionally no more than 500, 400, 300, or 200 nucleotides). In some embodiments, a Gene Writer system is capable of producing a deletion of at least 81, 85, 90, 95, 100, 110, 120, 130, 140, 150, 160, 170, 180, 190, or 200 nucleotides (and optionally no more than 500, 400, 300, or 200 nucleotides). In some embodiments, a Gene Writer system is capable of producing a deletion of at least 1, 2, 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, or 200 nucleotides (and optionally no more than 500, 400, 300, or 200 nucleotides). In some embodiments, a Gene Writer system is capable of producing a deletion of at least 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases (and optionally no more than 1, 5, 10, or 20 kilobases).

In some embodiments, an insertion, deletion, substitution, or combination thereof, increases or decreases expression (e.g. transcription or translation) of a gene. In some embodiments, an insertion, deletion, substitution, or combination thereof, increases or decreases expression (e.g. transcription or translation) of a gene by altering, adding, or deleting sequences in a promoter or enhancer, e.g. sequences that bind transcription factors. In some embodiments, an insertion, deletion, substitution, or combination thereof alters translation of a gene (e.g. alters an amino acid sequence), inserts or deletes a start or stop codon, alters or fixes the translation frame of a gene. In some embodiments, an insertion, deletion, substitution, or combination thereof alters splicing of a gene, e.g. by inserting, deleting, or altering a splice acceptor or donor site. In some embodiments, an insertion, deletion, substitution, or combination thereof alters transcript or protein half-life. In some embodiments, an insertion, deletion, substitution, or combination thereof alters protein localization in the cell (e.g. from the cytoplasm to a mitochondria, from the cytoplasm into the extracellular space (e.g. adds a secretion tag)). In some embodiments, an insertion, deletion, substitution, or combination thereof alters (e.g. improves) protein folding (e.g. to prevent accumulation of misfolded proteins). In some embodiments, an insertion, deletion, substitution, or combination thereof, alters, increases, decreases the activity of a gene, e.g. a protein encoded by the gene.

In some embodiments, the GeneWriter polypeptide results in insertion of the heterologous object sequence (e.g., the GFP gene) into the target locus (e.g., rDNA) at an average copy number of at least 0.01, 0.025, 0.05, 0.075, 0.1, 0.15, 0.2, 0.25, 0.3, 0.4, 0.5, 0.75, 1, 1.25, 1.5, 1.75, 2, 2.5, 3, 4, or 5 copies per genome. In some embodiments, a cell described herein (e.g., a cell comprising a heterologous sequence at a target insertion site) comprises the heterologous object sequence at an average copy number of at least 0.01, 0.025, 0.05, 0.075, 0.1, 0.15, 0.2, 0.25, 0.3, 0.4, 0.5, 0.75, 1, 1.25, 1.5, 1.75, 2, 2.5, 3, 4, or 5 copies per genome.

In some embodiments, a GeneWriter causes integration of a sequence in a target RNA with relatively few truncation events at the terminus. For instance, in some embodiments, a Gene Writer protein (e.g., of SEQ ID NO: 1016) results in about 25-100%, 50-100%, 60-100%, 70-100%, 75-95%, 80%-90%, or 86.17% of integrants into the target site being non-truncated, as measured by an assay described herein, e.g., an assay of Example 6 and FIG. 8 of PCT Application No. PCT/US2019/048607, incorporated herein by reference in its entirety. In some embodiments, a Gene Writer protein (e.g., of SEQ ID NO: 1016) results in at least about 30%, 40%, 50%, 60%, 70%, 80%, or 90% of integrants into the target site being non-truncated, as measured by an assay described herein. In some embodiments, an integrant is classified as truncated versus non-truncated using an assay comprising amplification with a forward primer situated 565 bp from the end of the element (e.g., a wild-type retrotransposon sequence) and a reverse primer situated in the genomic DNA of the target insertion site, e.g., rDNA. In some embodiments, the number of full-length integrants in the target insertion site is greater than the number of integrants truncated by 300-565 nucleotides in the target insertion site, e.g., the number of full-length integrants is at least 1.1×, 1.2×, 1.5×, 2×, 3×, 4×, 5×, 6×, 7×, 8×, 9×, or 10× the number of the truncated integrants, or the number of full-length integrants is at least 1.1×-10×, 2×-10×, 3×-10×, or 5×-10× the number of the truncated integrants.

In some embodiments, a system or method described herein results in insertion of the heterologous object sequence only at one target site in the genome of the target cell. Insertion can be measured, e.g., using a threshold of above 1%, 1.5%, 2%, 2.5%, 3%, 3.5%, 4%, 4.5%, 5%, e.g., as described in Example 8 of PCT Application No. PCT/US2019/048607, incorporated herein by reference in its entirety. In some embodiments, a system or method described herein results in insertion of the heterologous object sequence wherein less than 1%, 1.5%, 2%, 2.5%, 3%, 3.5%, 4%, 4.5%, 5%, 10%, 20%, 30%, 40%, or 50% of insertions are at a site other than the target site, e.g., using an assay described herein, e.g., an assay of Example 8 of PCT Application No. PCT/US2019/048607, incorporated herein by reference in its entirety.

In some embodiments, a system or method described herein results in "scarless" insertion of the heterologous object sequence, while in some embodiments, the target site can show deletions or duplications of endogenous DNA as a result of insertion of the heterologous sequence. The mechanisms of different retrotransposons could result in different patterns of duplications or deletions in the host genome occurring during retrotransposition at the target site. In some embodiments, the system results in a scarless insertion, with no duplications or deletions in the surrounding genomic DNA. In some embodiments, the system results in a deletion of less than 1, 2, 3, 4, 5, 10, 50, or 100 bp of genomic DNA upstream of the insertion. In some embodiments, the system results in a deletion of less than 1, 2, 3, 4, 5, 10, 50, or 100 bp of genomic DNA downstream of the insertion. In some embodiments, the system results in a duplication of less than 1, 2, 3, 4, 5, 10, 50, or 100 bp of genomic DNA upstream of the insertion. In some embodiments, the system results in a duplication of less than 1, 2, 3, 4, 5, 10, 50, or 100 bp of genomic DNA downstream of the insertion.

In some embodiments, a GeneWriter described herein, or a DNA-binding domain thereof, binds to its target site specifically, e.g., as measured using an assay of Example 21 of PCT Application No. PCT/US2019/048607, incorporated herein by reference in its entirety. In some embodiments, the GeneWriter or DNA-binding domain thereof binds to its target site more strongly than to any other binding site in the human genome. For example, in some embodiments, in an assay of Example 21 of PCT Application No. PCT/US2019/048607, incorporated herein by reference in its entirety, the target site represents more than 50%, 60%, 70%, 80%, 90%, or 95% of binding events of the GeneWriter or DNA-binding domain thereof to human genomic DNA. In some embodiments, the DNA binding domain of the Gene Writer is heterologous to the remainder of the GeneWriter, e.g., such that the GeneWriter targets a different target site that the endogenous DNA binding domain associated with the remainder of the Gene Writer.

Genetically Engineered, e.g., Dimerized GeneWriters

Some non-LTR retrotransposons utilize two subunits to complete retrotransposition (Christensen et al PNAS 2006). In some embodiments, a retrotransposase described herein comprises two connected subunits as a single polypeptide. For instance, two wild-type retrotransposases could be joined with a linker to form a covalently "dimerized" protein. In some embodiments, the nucleic acid coding for the retrotransposase codes for two retrotransposase subunits to be expressed as a single polypeptide. In some embodiments, the subunits are connected by a peptide linker, such as has been described herein in the section entitled "Linker" and, e.g., in Chen et al Adv Drug Deliv Rev 2013. In some embodiments, the two subunits in the polypeptide are connected by a rigid linker. In some embodiments, the rigid linker consists of the motif (EAAAK)$_n$ (SEQ ID NO: 1534). In other embodiments, the two subunits in the polypeptide are connected by a flexible linker. In some embodiments, the flexible linker consists of the motif (Gly)$_n$. In some embodiments, the flexible linker consists of the motif (GGGGS)$_n$ (SEQ ID NO: 1535). In some embodiments, the rigid or flexible linker consists of 1, 2, 3, 4, 5, 10, 15, or more amino acids in length to enable retrotransposition. In some embodiments, the linker consists of a combination of rigid and flexible linker motifs.

Based on mechanism, not all functions are required from both retrotransposase subunits. In some embodiments, the fusion protein may consist of a fully functional subunit and a second subunit lacking one or more functional domains. In some embodiments, one subunit may lack reverse transcriptase functionality. In some embodiments, one subunit may lack the reverse transcriptase domain. In some embodiments, one subunit may possess only endonuclease activity. In some embodiments, one subunit may possess only an endonuclease domain. In some embodiments, the two subunits comprising the single polypeptide may provide complimentary functions.

In some embodiments, one subunit may lack endonuclease functionality. In some embodiments, one subunit may lack the endonuclease domain. In some embodiments, one subunit may possess only reverse transcriptase activity. In some embodiments, one subunit may possess only a reverse transcriptase domain. In some embodiments, one subunit may possess only DNA-dependent DNA synthesis functionality.

Linkers:

In some embodiments, domains of the compositions and systems described herein (e.g., the endonuclease and reverse transcriptase domains of a polypeptide or the DNA binding domain and reverse transcriptase domains of a polypeptide) may be joined by a linker. A composition described herein comprising a linker element has the general form S1-L-S2, wherein S1 and S2 may be the same or different and represent two domain moieties (e.g., each a polypeptide or nucleic acid domain) associated with one another by the linker. In some embodiments, a linker may connect two polypeptides. In some embodiments, a linker may connect two nucleic acid molecules. In some embodiments, a linker may connect a polypeptide and a nucleic acid molecule. A linker may be a chemical bond, e.g., one or more covalent bonds or non-covalent bonds. A linker may be flexible, rigid, and/or cleavable. In some embodiments, the linker is a peptide linker. Generally, a peptide linker is at least 2, 3, 4, 5, 6, 7, 8, 9, 10 or more amino acids in length, e.g., 2-50 amino acids in length, 2-30 amino acids in length.

The most commonly used flexible linkers have sequences consisting primarily of stretches of Gly and Ser residues ("GS" linker). Flexible linkers may be useful for joining domains that require a certain degree of movement or interaction and may include small, non-polar (e.g. Gly) or polar (e.g. Ser or Thr) amino acids. Incorporation of Ser or Thr can also maintain the stability of the linker in aqueous solutions by forming hydrogen bonds with the water molecules, and therefore reduce unfavorable interactions between the linker and the other moieties. Examples of such linkers include those having the structure $[GGS]_{\geq 1}$ or

[GGGS]≥1 (SEQ ID NO: 1536). Rigid linkers are useful to keep a fixed distance between domains and to maintain their independent functions. Rigid linkers may also be useful when a spatial separation of the domains is critical to preserve the stability or bioactivity of one or more components in the agent. Rigid linkers may have an alpha helix-structure or Pro-rich sequence, (XP)n, with X designating any amino acid, preferably Ala, Lys, or Glu. Cleavable linkers may release free functional domains in vivo. In some embodiments, linkers may be cleaved under specific conditions, such as the presence of reducing reagents or proteases. In vivo cleavable linkers may utilize the reversible nature of a disulfide bond. One example includes a thrombin-sensitive sequence (e.g., PRS) between the two Cys residues. In vitro thrombin treatment of CPRSC (SEQ ID NO: 1537) results in the cleavage of the thrombin-sensitive sequence, while the reversible disulfide linkage remains intact. Such linkers are known and described, e.g., in Chen et al. 2013. Fusion Protein Linkers: Property, Design and Functionality. Adv Drug Deliv Rev. 65(10): 1357-1369. In vivo cleavage of linkers in compositions described herein may also be carried out by proteases that are expressed in vivo under pathological conditions (e.g. cancer or inflammation), in specific cells or tissues, or constrained within certain cellular compartments. The specificity of many proteases offers slower cleavage of the linker in constrained compartments.

In some embodiments the amino acid linkers are (or are homologous to) the endogenous amino acids that exist between such domains in a native polypeptide. In some embodiments the endogenous amino acids that exist between such domains are substituted but the length is unchanged from the natural length. In some embodiments, additional amino acid residues are added to the naturally existing amino acid residues between domains.

In some embodiments, the amino acid linkers are designed computationally or screened to maximize protein function (Anad et al., FEBS Letters, 587:19, 2013).

In addition to being fully encoded on a single transcript, a polypeptide can be generated by separately expressing two or more polypeptide fragments that reconstitute the holoenzyme. In some embodiments, the Gene Writer polypeptide is generated by expressing as separate subunits that reassemble the holoenzyme through engineered protein-protein interactions. In some embodiments, reconstitution of the holoenzyme does not involve covalent binding between subunits. Peptides may also fuse together through trans-splicing of inteins (Tornabene et al. Sci Transl Med 11, eaav4523 (2019)). In some embodiments, the Gene Writer holoenzyme is expressed as separate subunits that are designed to create a fusion protein through the presence of split inteins (e.g., as described herein) in the subunits. In some embodiments, the Gene Writer holoenzyme is reconstituted through the formation of covalent linkages between subunits. In some embodiments, protein subunits reassemble through engineered protein-protein binding partners, e.g., SpyTag and SpyCatcher (Zakeri et al. PNAS 109, E690-E697 (2012)). In some embodiments, an additional domain described herein, e.g., a Cas9 nickase, is expressed as a separate polypeptide that associates with the Gene Writer polypeptide through covalent or non-covalent interactions as described above. In some embodiments, the breaking up of a Gene Writer polypeptide into subunits may aid in delivery of the protein by keeping the nucleic acid encoding each part within optimal packaging limits of a viral delivery vector, e.g., AAV (Tornabene et al. Sci Transl Med 11, eaav4523 (2019)). In some embodiments, the Gene Writer polypeptide is designed to be dimerized through the use of covalent or non-covalent interactions as described above.

Inteins

In some embodiments, the Gene Writer system comprises an intein. Generally, an intein comprises a polypeptide that has the capacity to join two polypeptides or polypepide fragments together via a peptide bond. In some embodiments, the intein is a trans-splicing intein that can join two polypeptide fragments, e.g., to form the polypeptide component of a system as described herein. In some embodiments, an intein may be encoded on the same nucleic acid molecule encoding the two polypeptide fragments. In certain embodiments, the intein may be translated as part of a larger polypeptide comprising, e.g., in order, the first polypeptide fragment, the intein, and the second polypeptide fragment. In embodiments, the translated intein may be capable of excising itself from the larger polypeptide, e.g., resulting in separation of the attached polypeptide fragments. In embodiments, the excised intein may be capable of joining the two polypeptide fragments to each other directly via a peptide bond. Exemplary inteins are described herein, e.g., in Table X.

Template RNA Component of Gene Writer™ Gene Editor System

The Gene Writer systems described herein can transcribe an RNA sequence template into host target DNA sites by target-primed reverse transcription. By writing DNA sequence(s) via reverse transcription of the RNA sequence template directly into the host genome, the Gene Writer system can insert an object sequence into a target genome without the need for exogenous DNA sequences to be introduced into the host cell (unlike, for example, CRISPR systems), as well as eliminate an exogenous DNA insertion step. Therefore, the Gene Writer system provides a platform for the use of customized RNA sequence templates containing object sequences, e.g., sequences comprising heterologous gene coding and/or function information.

Figure 3:
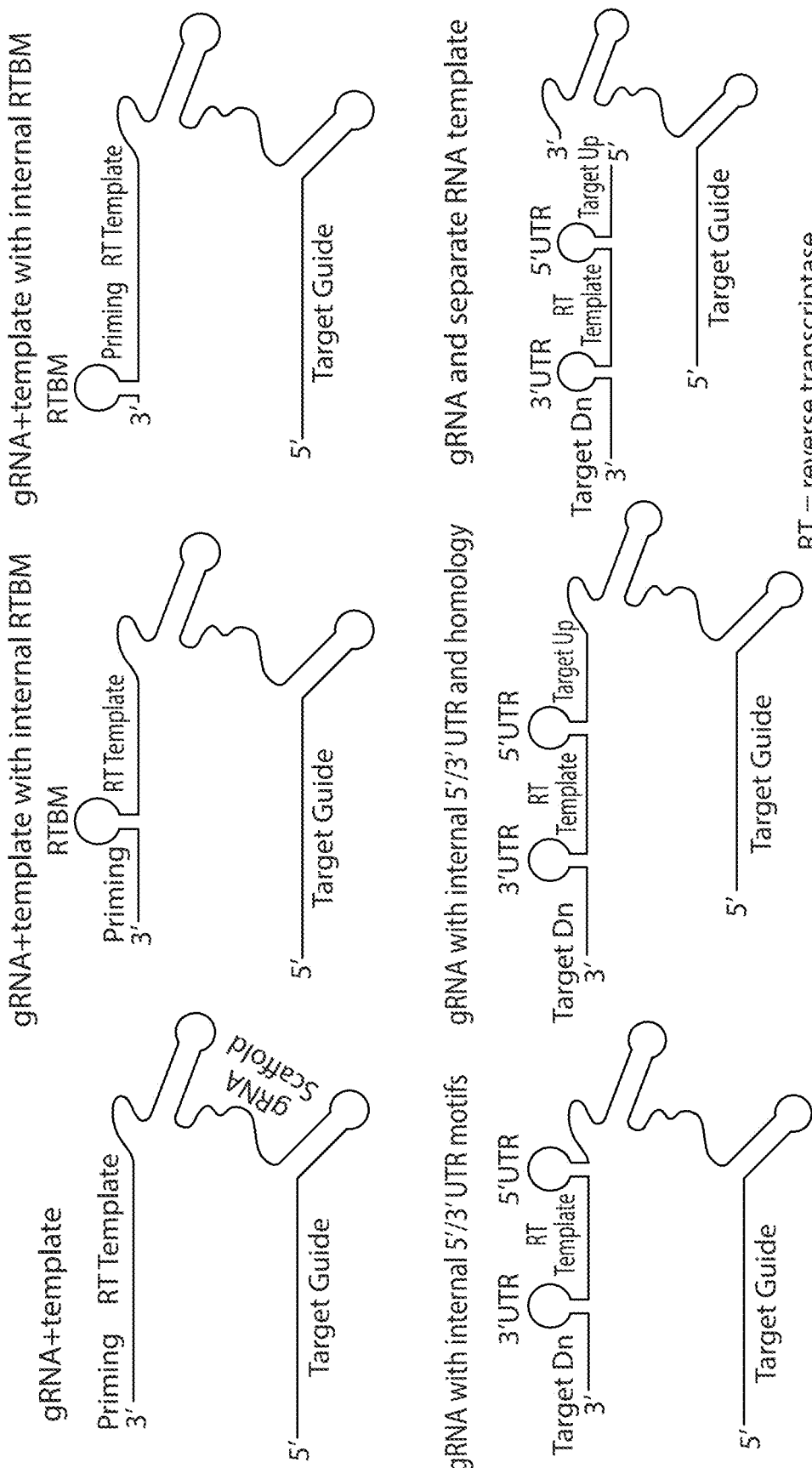
FIG. 3 is a schematic of the structure of exemplary Gene Writer™ template RNAs.
Figure 4A:
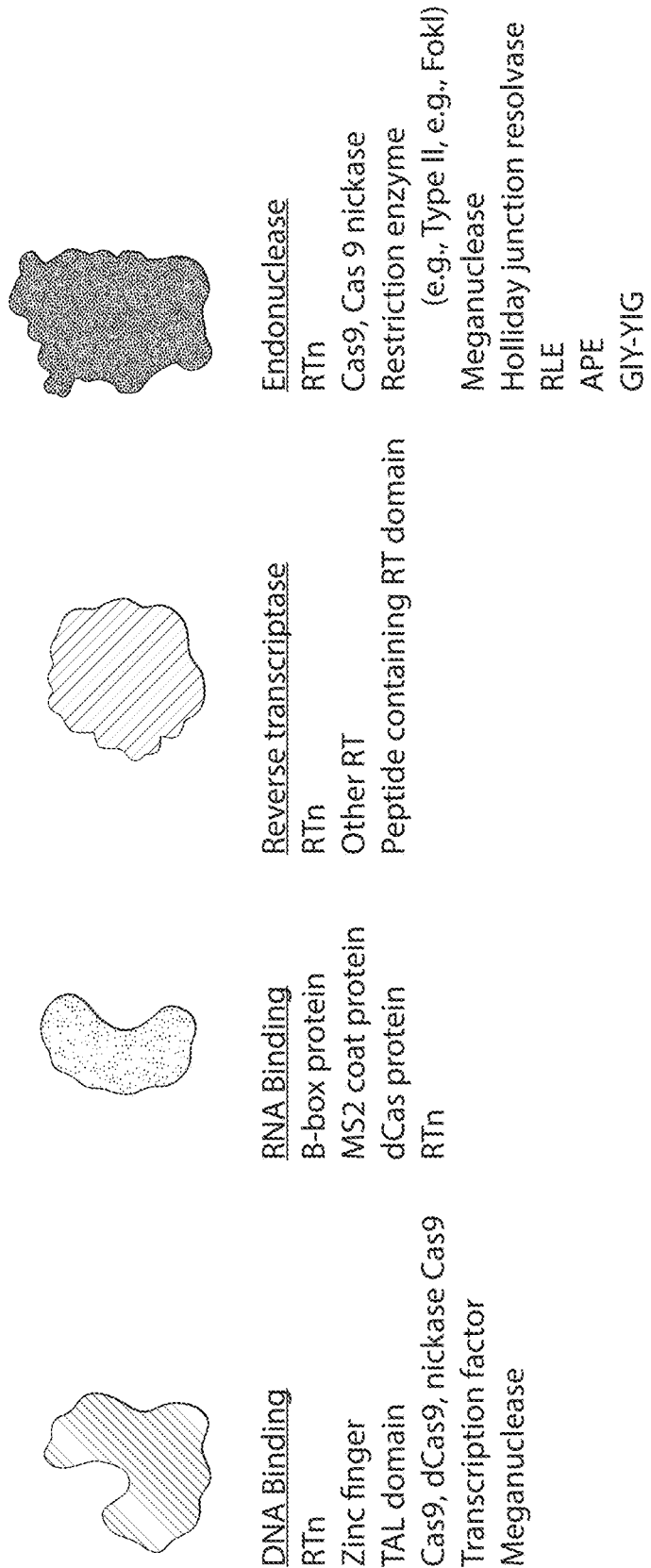
FIGS. 4A and 4B are a series of diagrams showing examples of configurations of Gene Writers using domains derived from a variety of sources. Gene Writers as described herein may or may not comprise all domains depicted. For example, a GeneWrite may, in some instances, lack an RNA-binding domain, or may have single domains that fulfill the functions of multiple domains, e.g., a Cas9 domain for DNA binding and endonuclease activity. Exemplary domains that can be included in a GeneWriter polypeptide include DNA binding domains (e.g., comprising a DNA binding domain of an element of a sequence listed in any of Tables X, Y, Z1, Z2, 3A, or 3B; a zinc finger; a TAL domain; Cas9; dCas9; nickase Cas9; a transcription factor, or a meganuclease), RNA binding domains (e.g., comprising an RNA binding domain of B-box protein, MS2 coat protein, dCas, or an element of a sequence listed in any of Tables X, Y, Z1, Z2, 3A, or 3B), reverse transcriptase domains (e.g., comprising a reverse transcriptase domain of an element of a sequence listed in any of Tables X, Y, 3A, or 3B; other retrotransposases (e.g., as listed in Table Z1); a peptide containing a reverse transciptase domain (e.g., as listed in Table Z2)), and/or an endonuclease domain (e.g., comprising an endonuclease domain of an element of a sequence listed in any of Tables X, Y, 3A, or 3B; Cas9; nickase Cas9; a restriction enzyme (e.g., a type II restriction enzyme, e.g., FokI); a meganuclease; a Holliday junction resolvase; an RLE retrotranspase; an APE retrotransposase; or a GIY-YIG retrotransposase). Exemplary GeneWriter polypeptides comprising exemplary combinations of such domains are shown in the bottom panel.
Figure 4B:
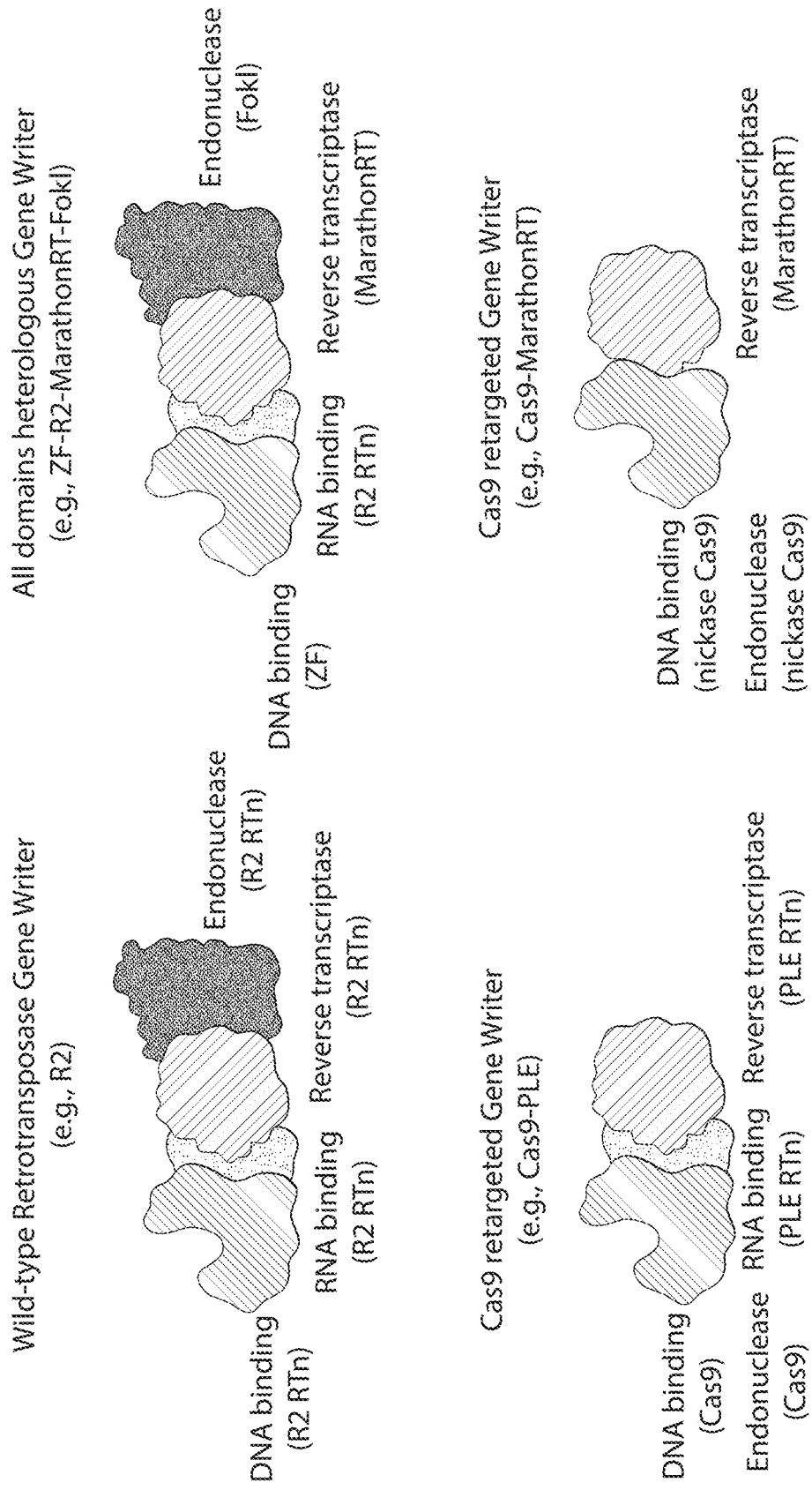
Figure 5:
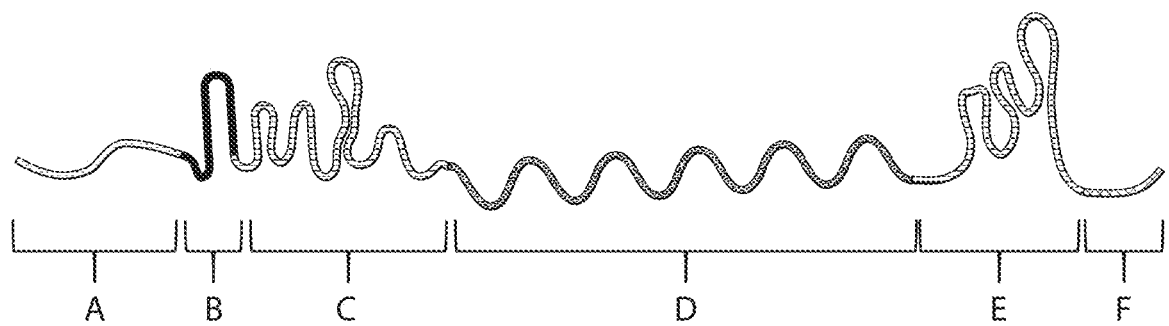
FIG. 5 is a diagram showing the modules of an exemplary Gene Writer RNA template. Individual modules of the exemplary template can be combined, re-arranged, and/or omitted, e.g., to produce a Gene Writer template. A=5' homology arm; B=Ribozyme; C=5' UTR; D=heterologous object sequence; E=3' UTR; F=3' homology arm.

In some embodiments the template RNA encodes a Gene Writer protein in cis with a heterologous object sequence. Various cis constructs were described, for example, in Kuroki-Kami et al (2019) *Mobile DNA* 10:23 (incorporated by reference herein in its entirety), and can be used in combination with any of the embodiments described herein. For instance, in some embodiments, the template RNA comprises a heterologous object sequence, a sequence encoding a Gene Writer protein (e.g., a protein comprising (i) a reverse transcriptase domain and (ii) an endonuclease domain, e.g., as described herein), a 5' untranslated region, and a 3' untranslated region. The components may be included in various orders. In some embodiments, the Gene Writer protein and heterologous object sequence are encoded in different directions (sense vs. anti-sense), e.g., using an arrangement shown in FIG. 3A of Kuroki-Kami et al, Id. In some embodiments the Gene Writer protein and heterologous object sequence are encoded in the same direction. In some embodiments, the nucleic acid encoding the polypeptide and the template RNA or the nucleic acid encoding the template RNA are covalently linked, e.g., are part of a fusion nucleic acid and/or are part of the same transcript. In some embodiments, the fusion nucleic acid comprises RNA or DNA.

The nucleic acid encoding the Gene Writer polypeptide may, in some instances, be 5' of the heterologous object sequence. For example, in some embodiments, the template RNA comprises, from 5' to 3', a 5' untranslated region, a sense-encoded Gene Writer polypeptide, a sense-encoded heterologous object sequence, and 3' untranslated region. In some embodiments, the template RNA comprises, from 5' to 3', a 5' untranslated region, a sense-encoded Gene Writer polypeptide, anti-sense-encoded heterologous object sequence, and 3' untranslated region.

In some embodiments, the RNA further comprises homology to the DNA target site.

It is understood that, when a template RNA is described as comprising an open reading frame or the reverse complement thereof, in some embodiments the template RNA must be converted into double stranded DNA (e.g., through reverse transcription) before the open reading frame can be transcribed and translated.

In certain embodiments, customized RNA sequence template can be identified, designed, engineered and constructed to contain sequences altering or specifying host genome function, for example by introducing a heterologous coding region into a genome; affecting or causing exon structure/alternative splicing; causing disruption of an endogenous gene; causing transcriptional activation of an endogenous gene; causing epigenetic regulation of an endogenous DNA; causing up- or down-regulation of operably liked genes, etc. In certain embodiments, a customized RNA sequence template can be engineered to contain sequences coding for exons and/or transgenes, provide for binding sites to transcription factor activators, repressors, enhancers, etc., and combinations of thereof. In other embodiments, the coding sequence can be further customized with splice acceptor sites, poly-A tails. In certain embodiments the RNA sequence can contain sequences coding for an RNA sequence template homologous to the retrotransposase, be engineered to contain heterologous coding sequences, or combinations thereof.

The template RNA may have some homology to the target DNA. In some embodiments the template RNA has at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150, 175, 200 or more bases of exact homology to the target DNA at the 3' end of the RNA. In some embodiments the template RNA has at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150, 160, 175, 180, or 200 or more bases of at least 50%, 60%, 70%, 80%, 85%, 90%, 95%, 97%, 98%, 99% or 100% homology to the target DNA, e.g., at the 5' end of the template RNA. In some embodiments the template RNA has a 3' untranslated region derived from a retrotransposon, e.g. a retrotransposons described herein. In some embodiments the template RNA has a 3' region of at least 10, 15, 20, 25, 30, 40, 50, 60, 80, 100, 120, 140, 160, 180, 200 or more bases of at least 50%, 60%, 70%, 80%, 85%, 90%, 95%, 97%, 98%, 99% or 100% homology to the 3' sequence of a retrotransposon, e.g., a retrotransposon described herein, e.g. a retrotransposon in Table X, Z1, 72, 3A, or 3B. In some embodiments the template RNA has a 5' untranslated region derived from a retrotransposon, e.g. a retrotransposons described herein. In some embodiments the template RNA has a 5' region of at least 10, 15, 20, 25, 30, 40, 50, 60, 80, 100, 120, 140, 160, 180, or 200 or more bases of at least 40%, 50%, 60%, 70%, 80%, 90%, 95% or greater homology to the 5' sequence of a retrotransposon, e.g., a retrotransposon described herein, e.g. a retrotransposon described in Table X, Z1, Z2, 3A, or 3B.

The template RNA component of a Gene Writer genome editing system described herein typically is able to bind the Gene Writer genome editing protein of the system. In some embodiments the template RNA has a 3' region that is capable of binding a Gene Writer genome editing protein. The binding region, e.g., 3' region, may be a structured RNA region, e.g., having at least 1, 2 or 3 hairpin loops, capable of binding the Gene Writer genome editing protein of the system.

The template RNA component of a Gene Writer genome editing system described herein typically is able to bind the Gene Writer genome editing protein of the system. In some embodiments the template RNA has a 5' region that is capable of binding a Gene Writer genome editing protein. The binding region, e.g., 5' region, may be a structured RNA region, e.g., having at least 1, 2 or 3 hairpin loops, capable of binding the Gene Writer genome editing protein of the system. In some embodiments, the 5' untranslated region comprises a pseudoknot, e.g., a pseudoknot that is capable of binding to the Gene Writer protein.

In some embodiments, the template RNA (e.g., an untranslated region of the hairpin RNA, e.g., a 5' untranslated region) comprises a stem-loop sequence. In some embodiments, the template RNA (e.g., an untranslated region of the hairpin RNA, e.g., a 5' untranslated region) comprises a hairpin. In some embodiments, the template RNA (e.g., an untranslated region of the hairpin RNA, e.g., a 5' untranslated region) comprises a helix. In some embodiments, the template RNA (e.g., an untranslated region of the hairpin RNA, e.g., a 5' untranslated region) comprises a psuedoknot. In some embodiments the template RNA comprises a ribozyme. In some embodiments the ribozyme is similar to an hepatitis delta virus (HDV) ribozyme, e.g., has a secondary structure like that of the HDV ribozyme and/or has one or more activities of the HDV ribozyme, e.g., a self-cleavage activity. See, e.g., Eickbush et al., Molecular and Cellular Biology, 2010, 3142-3150.

In some embodiments, the template RNA (e.g., an untranslated region of the hairpin RNA, e.g., a 3' untranslated region) comprises one or more stem-loops or helices. Exemplary structures of R2 3' UTRs are shown, for example, in Ruschak et al. "Secondary structure models of the 3' untranslated regions of diverse R2 RNAs" RNA. 2004 June; 10(6): 978-987, e.g., at FIG. 3, therein, and in Eikbush and Eikbush, "R2 and R2/R1 hybrid non-autonomous retrotransposons derived by internal deletions of full-length elements" Mobile DNA (2012) 3:10; e.g., at FIG. 3 therein, which articles are hereby incorporated by reference in their entirety.

In some embodiments, a template RNA described herein comprises a sequence that is capable of binding to a GeneWriter protein described herein. For instance, in some embodiments, the template RNA comprises an MS2 RNA sequence capable of binding to an MS2 coat protein sequence in the GeneWriter protein. In some embodiments, the template RNA comprises an RNA sequence capable of binding to a B-box sequence. In some embodiments, the template RNA comprises an RNA sequence (e.g., a crRNA sequence and/or tracrRNA sequence, a gRNA sequence) capable of binding to a Cas9 domain in the GeneWriter protein. In some embodiments, in addition to or in place of a UTR, the template RNA is linked (e.g., covalently) to a non-RNA UTR, e.g., a protein or small molecule.

In some embodiments the template RNA has a poly-A tail at the 3' end. In some embodiments the template RNA does not have a poly-A tail at the 3' end.

In some embodiments the template RNA has a 5' region of at least 10, 15, 20, 25, 30, 40, 50, 60, 80, 100, 120, 140, 160, 180, 200 or more bases of at least 40%, 50%, 60%, 70%, 80%, 90%, 95% or greater homology to the 5' sequence of a retrotransposon, e.g., a retrotransposon described herein.

The template RNA of the system typically comprises an object sequence for insertion into a target DNA. The object sequence may be coding or non-coding.

In some embodiments a system or method described herein comprises a single template RNA. In some embodiments a system or method described herein comprises a plurality of template RNAs.

In some embodiments, the object sequence may contain an open reading frame. In some embodiments, the template RNA has a Kozak sequence. In some embodiments, the template RNA has an internal ribosome entry site. In some embodiments, the template RNA has a self-cleaving peptide such as a T2A or P2A site. In some embodiments, the template RNA has a start codon. In some embodiments, the template RNA has a splice acceptor site. In some embodiments, the template RNA has a splice donor site. Exemplary splice acceptor and splice donor sites are described in WO2016044416, incorporated herein by reference in its entirety. Exemplary splice acceptor site sequences are known to those of skill in the art and include, by way of example only, CTGACCCTTCTCTCTCTCCCCCAGAG (SEQ ID NO: 1605) (from human HBB gene) and TTTCTCTCCCACAAG (SEQ ID NO: 1606) (from human immunoglobulin-gamma gene). In some embodiments the template RNA, has a microRNA binding site downstream of the stop codon. In some embodiments, the template RNA has a polyA tail downstream of the stop codon of an open reading frame. In some embodiments, the template RNA comprises one or more exons. In some embodiments, the template RNA comprises one or more introns. In some embodiments, the template RNA comprises a eukaryotic transcriptional terminator. In some embodiments, the template RNA comprises an enhanced translation element or a translation enhancing element. In some embodiments, the RNA comprises the human T-cell leukemia virus (HTLV-1) R region. In some embodiments, the RNA comprises a posttranscriptional regulatory element that enhances nuclear export, such as that of Hepatitis B Virus (HPRE) or Woodchuck Hepatitis Virus (WPRE). In some embodiments, in the template RNA, the heterologous object sequence encodes a polypeptide and is coded in an antisense direction with respect to the 5' and 3' UTR. In some embodiments, in the template RNA, the heterologous object sequence encodes a polypeptide and is coded in a sense direction with respect to the 5' and 3' UTR.

In some embodiments, a nucleic acid described herein (e.g., a template RNA or a DNA encoding a template RNA) comprises a microRNA binding site. In some embodiments, the microRNA binding site is used to increase the target-cell specificity of a GeneWriter system. For instance, the microRNA binding site can be chosen on the basis that is is recognized by a miRNA that is present in a non-target cell type, but that is not present (or is present at a reduced level relative to the non-target cell) in a target cell type. Thus, when the template RNA is present in a non-target cell, it would be bound by the miRNA, and when the template RNA is present in a target cell, it would not be bound by the miRNA (or bound but at reduced levels relative to the non-target cell). While not wishing to be bound by theory, binding of the miRNA to the template RNA may interfere with insertion of the heterologous object sequence into the genome. Accordingly, the heterologous object sequence would be inserted into the genome of target cells more efficiently than into the genome of non-target cells. A system having a microRNA binding site in the template RNA (or DNA encoding it) may also be used in combination with a nucleic acid encoding a Gene Writer polypeptide, wherein expression of the GeneWriter polypeptide is regulated by a second microRNA binding site, e.g., as described herein, e.g., in the section entitled "Polypeptide component of Gene Writer gene editor system".

In some embodiments, the object sequence may contain a non-coding sequence. For example, the template RNA may comprise a promoter or enhancer sequence. In some embodiments, the template RNA comprises a tissue specific promoter or enhancer, each of which may be unidirectional or bidirectional. In some embodiments, the promoter is an RNA polymerase I promoter, RNA polymerase II promoter, or RNA polymerase III promoter. In some embodiments, the promoter comprises a TATA element. In some embodiments, the promoter comprises a B recognition element. In some embodiments, the promoter has one or more binding sites for transcription factors. In some embodiments, the non-coding sequence is transcribed in an antisense-direction with respect to the 5' and 3' UTR. In some embodiments, the non-coding sequence is transcribed in a sense direction with respect to the 5' and 3' UTR.

In some embodiments, a nucleic acid described herein (e.g., a template RNA or a DNA encoding a template RNA) comprises a promoter sequence, e.g., a tissue specific promoter sequence. In some embodiments, the tissue-specific promoter is used to increase the target-cell specificity of a GeneWriter system. For instance, the promoter can be chosen on the basis that it is active in a target cell type but not active in (or active at a lower level in) a non-target cell type. Thus, even if the promoter integrated into the genome of a non-target cell, it would not drive expression (or only drive low level expression) of an integrated gene. A system having a tissue-specific promoter sequence in the template RNA may also be used in combination with a microRNA binding site, e.g., in the template RNA or a nucleic acid encoding a Gene Writer protein, e.g., as described herein. A system having a tissue-specific promoter sequence in the template RNA may also be used in combination with a DNA encoding a GeneWriter polypeptide, driven by a tissue-specific promoter, e.g., to achieve higher levels of Gene Writer protein in target cells than in non-target cells.

In some embodiments, a heterologous object sequence comprised by a template RNA (or DNA encoding the template RNA) is operably linked to at least one regulatory sequence. In some embodiments, the heterologous object sequence is operably linked to a tissue-specific promoter, such that expression of the heterologous object sequence, e.g., a therapeutic protein, is upregulated in target cells, as above. In some embodiments, the heterologous object sequence is operably linked to a miRNA binding site, such that expression of the heterologous object sequence, e.g., a therapeutic protein, is downregulated in cells with higher levels of the corresponding miRNA, e.g., non-target cells, as above.

In some embodiments, the template RNA comprises a microRNA sequence, a siRNA sequence, a guide RNA sequence, a piwi RNA sequence.

In some embodiments, the template RNA comprises a non-coding heterologous object sequence, e.g., a regulatory sequence. In some embodiments, integration of the heterologous object sequence thus alters the expression of an endogenous gene. In some embodiments, integration of the heterologous object sequence upregulates expression of an endogenous gene. In some embodiments, integration of the heterologous object sequence downregulated expression of an endogenous gene.

In some embodiments, the template RNA comprises a site that coordinates epigenetic modification. In some embodiments, the template RNA comprises an element that inhibits, e.g., prevents, epigenetic silencing. In some embodiments, the template RNA comprises a chromatin insulator. For example, the template RNA comprises a CTCF site or a site targeted for DNA methylation.

In order to promote higher level or more stable gene expression, the template RNA may include features that prevent or inhibit gene silencing. In some embodiments, these features prevent or inhibit DNA methylation. In some embodiments, these features promote DNA demethylation. In some embodiments, these features prevent or inhibit histone deacetylation. In some embodiments, these features prevent or inhibit histone methylation. In some embodiments, these features promote histone acetylation. In some embodiments, these features promote histone demethylation. In some embodiments, multiple features may be incorporated into the template RNA to promote one or more of these modifications. CpG dinculeotides are subject to methylation by host methyl transferases. In some embodiments, the template RNA is depleted of CpG dinucleotides, e.g., does not comprise CpG nucleotides or comprises a reduced number of CpG dinucleotides compared to a corresponding unaltered sequence. In some embodiments, the promoter driving transgene expression from integrated DNA is depleted of CpG dinucleotides.

In some embodiments, the template RNA comprises a gene expression unit composed of at least one regulatory region operably linked to an effector sequence. The effector sequence may be a sequence that is transcribed into RNA (e.g., a coding sequence or a non-coding sequence such as a sequence encoding a micro RNA).

In some embodiments, the object sequence of the template RNA is inserted into a target genome in an endogenous intron. In some embodiments, the object sequence of the template RNA is inserted into a target genome and thereby acts as a new exon. In some embodiments, the insertion of the object sequence into the target genome results in replacement of a natural exon or the skipping of a natural exon.

In some embodiments, the object sequence of the template RNA is inserted into the target genome in a genomic safe harbor site, such as AAVS1, CCR5, or ROSA26. In some embodiments, the object sequence of the template RNA is inserted into the albumin locus. In some embodiments, the object sequence of the template RNA is inserted into the TRAC locus. In some embodiments, the object sequence of the template RNA is added to the genome in an intergenic or intragenic region. In some embodiments, the object sequence of the template RNA is added to the genome 5' or 3' within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb of an endogenous active genc. In some embodiments, the object sequence of the template RNA is added to the genome 5' or 3' within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb of an endogenous promoter or enhancer. In some embodiments, the object sequence of the template RNA can be, e.g., 50-50,000 base pairs (e.g., between 50-40,000 bp, between 500-30,000 bp between 500-20,000 bp, between 100-15,000 bp, between 500-10,000 bp, between 50-10,000 bp, between 50-5,000 bp. In some embodiments, the heterologous object sequence is less than 1,000, 1,300, 1500, 2,000, 3,000, 4,000, 5,000, or 7,500 nucleotides in length.

In some embodiments, the genomic safe harbor site is a Natural Harbor™ site. In some embodiments, the Natural Harbor™ site is ribosomal DNA (rDNA). In some embodiments, the Natural Harbor™ site is 5S rDNA, 18S rDNA, 5.8S rDNA, or 28S rDNA. In some embodiments, the Natural Harbor™ site is the Mutsu site in 5S rDNA. In some embodiments, the Natural Harbor™ site is the R2 site, the R5 site, the R6 site, the R4 site, the R1 site, the R9 site, or the RT site in 28S rDNA. In some embodiments, the Natural Harbor™ site is the R8 site or the R7 site in 18S rDNA. In some embodiments, the Natural Harbor™ site is DNA encoding transfer RNA (tRNA). In some embodiments, the Natural Harbor™ site is DNA encoding tRNA-Asp or tRNA-Glu. In some embodiments, the Natural Harbor™ site is DNA encoding spliceosomal RNA. In some embodiments, the Natural Harbor™ site is DNA encoding small nuclear RNA (snRNA) such as U2 snRNA.

Thus, in some aspects, the present disclosure provides a method of inserting a heterologous object sequence into a Natural Harbor™ site. In some embodimetns, the method comprises using a GeneWriter system described herein, e.g., using a polypeptide of any of Table X, Z1, Z2, 3A, or 3B or a polypeptide having sequence similarity thereto, e.g., at least 80%, 85%, 90%, or 95% identity thereto. In some embodiments, the method comprises using an enzyme, e.g., a retrotransposase, to insert the heterologous object sequence into the Natural Harbor™ site. In some aspects, the present disclosure provides a host human cell comprising a heterologous object sequence (e.g., a sequence encoding a therapeutic polypeptide) situated at a Natural Harbor™ site in the genome of the cell. In some embodiments, the Natural Harbor™ site is a site described in Table 4 below. In some embodiments, the heterologous object sequence is inserted within 20, 50, 100, 150, 200, 250, 500, or 1000 base pairs of a sequence shown in Table 4. In some embodiments, the heterologous object sequence is inserted within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb of a sequence shown in Table 4. In some embodiments, the heterologous object sequence is inserted into a site having at least 70%, 75%, 80%, 85%, 90%, 95%, 96%, 97%, 98%, or 99% identity to a sequence shown in Table 4. In some embodiments, the heterologous object sequence is inserted within 20, 50, 100, 150, 200, 250, 500, or 1000 base pairs, or within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb, of a site having at least 70%, 75%, 80%, 85%, 90%, 95%, 96%, 97%, 98%, or 99% identity to a sequence shown in Table 4. In some embodiments, the heterologous object sequence is inserted within a gene indicated in Column 5 of Table 4, or within 20, 50, 100, 150, 200, 250, 500, or 1000 base pairs, or within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb, of the gene.

TABLE 4

Natural Harbor ™ sites. Column 1 indicates a retrotransposon that inserts into the Natural Harbor ™ site. Column 2 indicates the gene at the Natural Harbor ™ site. Columns 3 and 4 show exemplary human genome sequence 5' and 3' of the insertion site (for example, 250 bp). Columns 5 and 6 list the example gene symbol and corresponding Gene ID.

| Target Site | Target Gene | 5' flanking sequence | 3' flanking sequence | Example Gene Symbol | Example Gene ID |
|---|---|---|---|---|---|
| R2 | 28S rDNA | CCGGTCCCCCCGCCGGGTCCGCCCCCGGGGCCGCGGTTCCGCGCGGCGCCTCGCCTCGGCCGGCGCCTAGCAGCCGACTTAGAACTGGTGCGGACCAGGGGAATCCGACTGTTTAATTAAAACAAAGCATCGCGAAGGCCCGCGGCGGGTGTTGACGCGATGTGATTTCTGCCCAGTGCTCTGAATGTCAAAGTGAAGAAATTCAATGAAGCGCGGGTAAACGGCGGGAGTAACTATGACTCTCTTAAG (SEQ ID NO: 1508) | GTAGCCAAATGCCTCGTCATCTAATTAGTGACGCGCATGAATGGATGAACGAGATTCCCACTGTCCCTACCTACTATCCAGCGAAACCACAGCCAAGGGAACGGGCTTGGCGGAATCAGCGGGGAAAGAAGACCCTGTTGAGCTTGACTCTAGTCTGGCACGGTGAAGAGACATGAGAGGTGTAGAATAAGTGGGAGGCCCCCGGCGCCCCCCCGGTGTCCCCGCGAGGGGCCCGGGGGGGTCCGCCG (SEQ ID NO: 1513) | RNA28SN1 | 106632264 |
| R4 | 28S rDNA | GCGGTTCCGCGCGGCGCCTCGCCTCGGCCGGCGCCTAGCAGCCGACTTAGAACTGGTGCGGACCAGGGGAATCCGACTGTTTAATTAAAACAAAGCATCGCGAAGGCCCGCGGCGGGTGTTGACGCGATGTGATTTCTGCCCAGTGCTCTGAATGTCAAAGTGAAGAAATTCAATGAAGCGCGGGTAAACGGCGGGAGTAACTATGACTCTCTTAAGGTAGCCAAATGCCTCGTCATCTAATTAGTGACG (SEQ ID NO: 1509) | CGCATGAATGGATGAACGAGATTCCCACTGTCCCTACCTACTATCCAGCGAAACCACAGCCAAGGGAACGGGCTTGGCGGAATCAGCGGGGAAAGAAGACCCTGTTGAGCTTGACTCTAGTCTGGCACGGTGAAGAGACATGAGAGGTGTAGAATAAGTGGGAGGCCCCCGGCGCCCCCCCGGTGTCCCCGCGAGGGGCCCGGGGCGGGTCCGCCGGCCCTGCGGGCCGCCGGTGAAATACCACTACTC (SEQ ID NO: 1514) | RNA28SN1 | 106632264 |
| R5 | 28S rDNA | TCCCCCCCGCCGGGTCCGCCCCGGGGCCGCGGTTCCGCGCGGCGCCTCGCCTCGGCCGGCGCCTAGCAGCCGACTTAGAACTGGTGCGGACCAGGGGAATCCGACTGTTTAATTAAAACAAAGCATCGCGAAGGCCCGCGGCGGGTGTTGACGCGATGTGATTTCTGCCCAGTGCTCTGAATGTCAAAGTGAAGAAATTCAATGAAGCGCGGGTAAACGGCGGGAGTAACTATGACTCTCTTAAGGTAG (SEQ ID NO: 1510) | CCAAATGCCTCGTCATCTAATTAGTGACGCGCATGAATGGATGAACGAGATTCCCACTGTCCCTACCTACTATCCAGCGAAACCACAGCCAAGGGAACGGGCTTGGCGGAATCAGCGGGGAAAGAAGACCCTGTTGAGCTTGACTCTAGTCTGGCACGGTGAAGAGACATGAGAGGTGTAGAATAAGTGGGAGGCCCCCGGCGCCCCCCCGGTGTCCCCGCGAGGGGCCCGGGGCGGGTCCGCCGGCCC (SEQ ID NO: 1515) | RNA28SN1 | 106632264 |
| R9 | 28S rDNA | CGGCGCGCTCGCCGGCCGAGGTGGGATCCCGAGGCCTCTCCAGTCCGCCGAGGGCGCACCACCGGCCCGTCTCGCCCGCCGCGCCGGGGAGGTGGAGCACGAGCGCACGTGTTAGGACCCGAAAGATGGTGAACTATGCCTGGGCAGGGCGAAGCCAGAGGAAACTCTGGTGAGGTCCGTAGCGGTCCTGACGTGCAAATCGGTCGTCCGACCTGGGTATAGGGGCGAAAGACTAATCGAACCATCTAG (SEQ ID NO: 1511) | TAGCTGGTTCCCTCCGAAGTTTCCCTCAGGATAGCTGGCGCTCTCGCAGACCCGACGCACCCCCGCCACGCAGTTTTATCCGGTAAAGCGAATGATTAGAGGTCTTGGGGCCGAAACGATCTCAACCTATTCTCAAACTTTAAATGGGTAAGAAGCCCGGCTCGCTGGCGTGGAGCCGGGCGTGGAATGCGAGTGCCTAGTGGGCCACTTTTGGTAAGCAGAACTGGCGCTGCGGGATGAACCGAACGCC (SEQ ID NO: 1516) | RNA28SN1 | 106632264 |
| R8 | 18S rDNA | GCATTCGTATTGCGCCGCTAGAGGTGAAATTCTTGGACCGGCGCAAGACGGACCAGAGCGAAAGCATTTGCCAAGAATGTTTTCATTAATCAAGAACGAAAGTCGGAGGTTCGAAGACGATCAGATACCGTCGTAGTTCCGACCATAAACGATGCCGACCGGCGATGCGGCGGCGTTATTCCCATGACCCGCCGGGCAGCTTCCGGGAAACCAAAGTCTTTGGGTTCCGGGGGGAGTATGGTTGCAAAGC (SEQ ID NO: 1512) | TGAAACTTAAAGGAATTGACGGAAGGGCACCACCAGGAGTGGAGCCTGCGGCTTAATTTGACTCAACACGGGAAACCTCACCCGGCCCGGACACGGACAGGATTGACAGATTGATAGCTCTTTCTCGATTCCGTGGGTGGTGGTGCATGCCGGTTCTTAGTTGGTGGAGCGATTTGTCTGGTTAATTCCGATAACGAACGAGACTCTGGCATGCTAACTAGTTACGCGACCCCCGAGCGGTCGGCGTCCC (SEQ ID NO: 1517) | RNA18SN1 | 106631781 |

TABLE 4-continued

Natural Harbor ™ sites. Column 1 indicates a retrotransposon that inserts into
the Natural Harbor ™ site. Column 2 indicates the gene at the Natural Harbor ™ site.
Columns 3 and 4 show exemplary human genome sequence 5' and 3' of the insertion site
(for example, 250 bp). Columns 5 and 6 list the example gene symbol and corresponding Gene ID.

| Target Site | Target Gene | 5' flanking sequence | 3' flanking sequence | Example Gene Symbol | Example Gene ID |
|---|---|---|---|---|---|
| R4-2_SRa | tRNA-Asp | | | TRD-GTC1-1 | 100189207 |
| LIN25_SM | tRNA-Glu | | | TRE-CTC1-1 | 100189384 |
| R1 | 28S rDNA | TAGCAGCCGACTTAGAACTG GTGCGGACCAGGGGAATCCG ACTGTTTAATTAAAACAAAG ATCGCGAAGGCCCGCGGCGG GTGTTGACGCGATGTGATTTC TGCCCAGTGCTCTGAATGTCA AAGTGAAGAAATTCAATGAA GCGCGGGTAAACGGCGGGA GTAACTATGACTCTCTTAAGG TAGCCAAATGCCTCGTCATCT AATTAGTGACGCGCATGAAT GGATGAACGAGATTCCCACT GTCCCT (SEQ ID NO: 1518) | ACCTACTATCCAGCGAAACCA CAGCCAAGGGAACGGGCTTG GCGGAATCAGCGGGGAAAG AAGACCCTGTTGAGCTTGACT CTAGTCTGGCACGGTGAAGA GACATGAGAGGTGTAGAATA AGTGGGAGGCCCCCGGCGCC CCCCCGGTGTCCCCGCGAGG GGCCCGGGGCGGGGTCCGCC GGCCCTGCGGGCCGCCGGTG AAATACCACTACTCTGATCGT TTTTTCACTGACCCGGTGAGG CGGGGGG (SEQ ID NO: 1524) | RNA28SN1 | 106632264 |
| R6 | 28S rDNA | CCCCCCGCCGGGTCCGCCCCC GGGGCCGCGGTTCCGCGCGG CGCCTCGCCTCGGCCGGCGC CTAGCAGCCGACTTAGAACT GGTGCGGACCAGGGGAATCC GACTGTTTAATTAAAACAAAG CATCGCGAAGGCCCGCGGCG GGTGTTGACGCGATGTGATT TCTGCCCAGTGCTCTGAATGT CAAAGTGAAGAAATTCAATG AAGCGCGGGTAAACGGCGG GAGTAACTATGACTCTCTTAA GGTAGCC (SEQ ID NO: 1519) | AAATGCCTCGTCATCTAATTA GTGACGCGCATGAATGGATG AACGAGATTCCCACTGTCCCT ACCTACTATCCAGCGAAACCA CAGCCAAGGGAACGGGCTTG GCGGAATCAGCGGGGAAAG AAGACCCTGTTGAGCTTGACT CTAGTCTGGCACGGTGAAGA GACATGAGAGGTGTAGAATA AGTGGGAGGCCCCCGGCGCC CCCCCGGTGTCCCCGCGAGG GGCCCGGGGCGGGGTCCGCC GGCCCTG (SEQ ID NO: 1525) | RNA28SN1 | 106632264 |
| R7 | 18S rDNA | GCGCAAGACGGACCAGAGCG AAAGCATTTGCCAAGAATGTT TTCATTAATCAAGAACGAAAG TCGGAGGTTCGAAGACGATC AGATACCGTCGTAGTTCCGAC CATAAACGATGCCGACCGGC GATGCGGCGGCGTTATTCCC ATGACCCGCCGGGCAGCTTC CGGGAAACCAAAGTCTTTGG GTTCCGGGGGGAGTATGGTT GCAAAGCTGAAACTTAAAGG AATTGACGGAAGGGCACCAC CAGGAGT (SEQ ID NO: 1520) | GGAGCCTGCGGCTTAATTTG ACTCAACACGGGAAACCTCA CCCGGCCCGGACACGGACAG GATTGACAGATTGATAGCTCT TTCTCGATTCCGTGGGTGGTG GTGCATGGCCGTTCTTAGTTG GTGGAGCGATTTGTCTGGTT AATTCCGATAACGAACGAGA CTCTGGCATGCTAACTAGTTA CGCGACCCCCGAGCGGTCGG CGTCCCCCAACTTCTTAGAGG GACAAGTGGCGTTCAGCCAC CCGAG (SEQ ID NO: 1526) | RNA18SN1 | 106631781 |
| RT | 28S rDNA | GGCCGGGCGCGACCCGCTCC GGGGACAGTGCCAGGTGGG GAGTTTGACTGGGGCGGTAC ACCTGTCAAACGGTAACGCA GGTGTCCTAAGGCGAGCTCA GGGAGGACAGAAACCTCCCG TGGAGCAGAAGGGCAAAAG CTCGCTTGATCTTGATTTTCA GTACGAATACAGACCGTGAA AGCGGGGCCTCACGATCCTTC TGACCTTTTGGGTTTTAAGCA GGAGGTGTCAGAAAAGTTAC CACAGGGAT (SEQ ID NO: 1521) | AACTGGCTTGTGGCGGCCAA GCGTTCATAGCGACGTCGCTT TTTGATCCTTCGATGTCGGCT CTTCCTATCATTGTGAAGCAG AATTCACCAAGCGTTGGATTG TTCACCCACTAATAGGGAACG TGAGCTGGGTTTAGACCGTC GTGAGACAGGTTAGTTTTACC CTACTGATGATGTGTTGTTGC CATGGTAATCCTGCTCAGTAC GAGAGGAACCGCAGGTTCAG ACATTTGGTGTATGTGCTTGG C (SEQ ID NO: 1527) | RNA28SN1 | 106632264 |
| Mutsu | 5S rDNA | GTCTACGGCCATACCACCC (SEQ ID NO: 1522) | TGAACGCGCCCGATCTCGTCT GATCTCGGAAGCTAAGCAGG GTCGGGCCTGGTTAGTACTT GGATGGGAGACCGCCTGGGA ATACCGGGTGCTGTAGGCTTT (SEQ ID NO: 1528) | RNA5S1 | 100169751 |

TABLE 4-continued

Natural Harbor ™ sites. Column 1 indicates a retrotransposon that inserts into the Natural Harbor ™ site. Column 2 indicates the gene at the Natural Harbor ™ site. Columns 3 and 4 show exemplary human genome sequence 5' and 3' of the insertion site (for example, 250 bp). Columns 5 and 6 list the example gene symbol and corresponding Gene ID.

| Target Site | Target Gene | 5' flanking sequence | 3' flanking sequence | Example Gene Symbol | Example Gene ID |
|---|---|---|---|---|---|
| Utopia/ Keno | U2 snRNA | ATCGCTTCTCGGCCTTTTGGC TAAGATCAAGTGTAGTA (SEQ ID NO: 1523) | TCTGTTCTTATCAGTTTAATAT CTGATACGTCCTCTATCCGAG GACAATATATTAAATGGATTT TTGGAGCAGGGAGATGGAAT AGGAGCTTGCTCCGTCCACTC CACGCATCGACCTGGTATTGC AGTACCTCCAGGAACGGTGC ACCC (SEQ ID NO: 1529) | RNU2-1 | 6066 |

In some embodiments, a system or method described herein results in insertion of a heterologous sequence into a target site in the human genome. In some embodiments, the target site in the human genome has sequence similarity to the corresponding target site of the corresponding wild-type retrotransposase (e.g., the retrotransposase from which the GeneWriter was derived) in the genome of the organism to which it is native. For instance, in some embodiments, the identity between the 40 nucleotides of human genome sequence centered at the insertion site and the 40 nucleotides of native organism genome sequence centered at the insertion site is less than 99.5%, 99%, 98%, 97%, 96%, 95%, 90%, 85%, 80%, 75%, 70%, 60%, or 50%, or is between 50-60%, 60-70%, 70-80%, 80-90%, or 90-100%. In some embodiments, the identity between the 100 nucleotides of human genome sequence centered at the insertion site and the 100 nucleotides of native organism genome sequence centered at the insertion site is less than 99.5%, 99%, 98%, 97%, 96%, 95%, 90%, 85%, 80%, 75%, 70%, 60%, or 50%, or is between 50-60%, 60-70%, 70-80%, 80-90%, or 90-100%. In some embodiments, the identity between the 500 nucleotides of human genome sequence centered at the insertion site and the 500 nucleotides of native organism genome sequence centered at the insertion site is less than 99.5%, 99%, 98%, 97%, 96%, 95%, 90%, 85%, 80%, 75%, 70%, 60%, or 50%, or is between 50-60%, 60-70%, 70-80%, 80-90%, or 90-100%.

The template nucleic acid (e.g., template RNA) component of a Gene Writer genome editing system described herein typically is able to bind the Gene Writer genome editing protein of the system. In some embodiments, the template nucleic acid (e.g., template RNA) has a 3' region that is capable of binding a Gene Writer genome editing protein. The binding region, e.g., 3' region, may be a structured RNA region, e.g., having at least 1, 2 or 3 hairpin loops, capable of binding the Gene Writer genome editing protein of the system. The binding region may associate the template nucleic acid (e.g., template RNA) with any of the polypeptide modules. In some embodiments, the binding region of the template nucleic acid (e.g., template RNA) may associate with an RNA-binding domain in the polypeptide. In some embodiments, the binding region of the template nucleic acid (e.g., template RNA) may associate with the reverse transcription domain of the polypeptide (e.g., specifically bind to the RT domain). For example, where the reverse transcription domain is derived from a non-LTR retrotransposon, the template nucleic acid (e.g., template RNA) may contain a binding region derived from a non-LTR retrotransposon, e.g., a 3' UTR from a non-LTR retrotransposon. In some embodiments, the template nucleic acid (e.g., template RNA) may associate with the DNA binding domain of the polypeptide, e.g., a gRNA associating with a Cas9-derived DNA binding domain. In some embodiments, the binding region may also provide DNA target recognition, e.g., a gRNA hybridizing to the target DNA sequence and binding the polypeptide, e.g., a Cas9 domain. In some embodiments, the template nucleic acid (e.g., template RNA) may associate with multiple components of the polypeptide, e.g., DNA binding domain and reverse transcription domain. For example, the template nucleic acid (e.g., template RNA) may comprise a gRNA region that associates with a Cas9-derived DNA binding domain and a 3' UTR from a non-LTR retrotransposon that associated with a non-LTR retrotransposon-derived reverse transcription domain.

In some embodiments a system or method described herein comprises a single template nucleic acid (e.g., template RNA). In some embodiments a system or method described herein comprises a plurality of template nucleic acids (e.g., template RNAs). For example, a system described herein comprises a first RNA comprising (e.g., from 5' to 3') a sequence that binds the Gene Writer polypeptide (e.g., the DNA-binding domain and/or the endonuclease domain, e.g., a gRNA) and a sequence that binds a target site (e.g., a non-edited strand of a site in a target genome), and a second RNA (e.g., a template RNA) comprising (e.g., from 5' to 3') optionally a sequence that binds the Gene Writer polypeptide (e.g., that specifically binds the RT domain), a heterologous object sequence, and a 3' homology domain. In some embodiments, when the system comprises a plurality of nucleic acids, each nucleic acid comprises a conjugating domain. In some embodiments, a conjugating domain enables association of nucleic acid molecules, e.g., by hybridization of complementary sequences.

In some embodiments, the template nucleic acid may further comprise a gRNA. In some embodiments, the template nucleic acid may bind to the Gene Writer polypeptide by interaction of a gRNA portion of the template nucleic acid with a heterologous RNA binding domain. In some embodiments, the heterologous RNA binding domain is Cas9.

In some embodiments, the template nucleic acid may comprise one or more UTRs (e.g., a 5' UTR or a 3' UTR, e.g., from an R2-type retrotransposon) and a gRNA. In some embodiments, the UTR facilitates interaction of the template with the reverse transcriptase domain of the polypeptide. In some embodiments, the gRNA facilitates interaction with the binding domain of the polypeptide. In some embodiments, the gRNA directs the polypeptide to the matching target sequence. In some embodiments, the template may contain only the reverse transcriptase binding motif (e.g., a 3' UTR from R2) and the gRNA may be provided as a second RNA molecule for target site recognition. In some embodiments, the template containing the RT-binding motif may exist on the same molecule as the gRNA, but be processed into two RNA molecules by cleavage activity (e.g., a ribozyme).

In some embodiments, the template possesses one or more sequences aiding in association of the template with the Gene Writer polypeptide. In some embodiments, these sequences may be derived from retrotransposon UTRs. In some embodiments, the UTRs may be located flanking the desired insertion sequence. In some embodiments, a sequence with target site homology may be located outside of one or both UTRs. In some embodiments, the sequence with target site homology can anneal to the target sequence to prime reverse transcription. In some embodiments, the 5' and/or 3' UTR may be located terminal to the target site homology sequence, e.g., such that target primed reverse transcription excludes reverse transcription of the 5' and/or 3' UTR. In some embodiments, the Gene Writer system may result in the insertion of a desired payload without any additional sequence (e.g., a gene expression unit without UTRs used to bind the Gene Writer protein).

The template nucleic acid (e.g., template RNA) can be designed to result in insertions, mutations, or deletions at the target DNA locus. In some embodiments, the template nucleic acid (e.g., template RNA) may be designed to cause an insertion in the target DNA. For example, the template nucleic acid (e.g., template RNA) may contain a heterologous sequence, wherein the reverse transcription will result in insertion of the heterologous sequence into the target DNA. In other embodiments, the RNA template may be designed to write a deletion into the target DNA. For example, the template nucleic acid (e.g., template RNA) may match the target DNA upstream and downstream of the desired deletion, wherein the reverse transcription will result in the copying of the upstream and downstream sequences from the template nucleic acid (e.g., template RNA) without the intervening sequence, e.g., causing deletion of the intervening sequence. In other embodiments, the template nucleic acid (e.g., template RNA) may be designed to write an edit into the target DNA. For example, the template RNA may match the target DNA sequence with the exception of one or more nucleotides, wherein the reverse transcription will result in the copying of these edits into the target DNA, e.g., resulting in mutations, e.g., transition or transversion mutations.

In some embodiments, a Gene Writer system is capable of producing an insertion into the target site of at least 45, 50, 55, 60, 65, 70, 75, 80, 85, 90, 95, or 100 nucleotides (and optionally no more than 500, 400, 300, 200, or 100 nucleotides). In some embodiments, a Gene Writer system is capable of producing an insertion into the target site of at least 1, 2, 3, 4, 5, 6, 7, 8, 9, 10, 15, 20, 25, 30, 35, 40, 45, 50, 55, 60, 65, 70, 75, 80, 85, 90, 95, or 100 nucleotides (and optionally no more than 500, 400, 300, 200, or 100 nucleotides). In some embodiments, a Gene Writer system is capable of producing an insertion into the target site of at least 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases (and optionally no more than 1, 5, 10, or 20 kilobases). In some embodiments, a Gene Writer system is capable of producing a deletion of at least 81, 85, 90, 95, 100, 110, 120, 130, 140, 150, 160, 170, 180, 190, or 200 nucleotides (and optionally no more than 500, 400, 300, or 200 nucleotides). In some embodiments, a Gene Writer system is capable of producing a deletion of at least 81, 85, 90, 95, 100, 110, 120, 130, 140, 150, 160, 170, 180, 190, or 200 nucleotides (and optionally no more than 500, 400, 300, or 200 nucleotides). In some embodiments, a Gene Writer system is capable of producing a deletion of at least 1, 2, 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, or 200 nucleotides (and optionally no more than 500, 400, 300, or 200 nucleotides). In some embodiments, a Gene Writer system is capable of producing a deletion of at least 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases (and optionally no more than 1, 5, 10, or 20 kilobases).

Additional Template Features

In some embodiments, the template (e.g., template RNA) comprises certain structural features, e.g., determined in silico. In embodiments, the template RNA is predicted to have minimal energy structures between −280 and −480 kcal/mol (e.g., between −280 to −300, −300 to −350, −350 to −400, −400 to −450, or −450 to −480 kcal/mol), e.g., as measured by RNAstructure, e.g., as described in Turner and Mathews *Nucleic Acids Res* 38:D280-282 (2009) (incorporated herein by reference in its entirety).

In some embodiments, the template (e.g., template RNA) comprises certain structural features, e.g., determined in vitro. In embodiments, the template RNA is sequence optimized, e.g., to reduce secondary structure as determined in vitro, for example, by SHAPE-MaP (e.g., as described in Siegfried et al. Nat Methods 11:959-965 (2014); incorporated herein by reference in its entirety). In some embodiments, the template (e.g., template RNA) comprises certain structural features, e.g., determined in cells. In embodiments, the template RNA is sequence optimized, e.g., to reduce secondary structure as measured in cells, for example, by DMS-MaPseq (e.g., as described in Zubradt et al. Nat Methods 14:75-82 (2017); incorporated by reference herein in its entirety).

Additional Functional Characteristics for Gene Writers™

A Gene Writer as described herein may, in some instances, be characterized by one or more functional measurements or characteristics. In some embodiments, the DNA binding domain has one or more of the functional characteristics described below. In some embodiments, the RNA binding domain has one or more of the functional characteristics described below. In some embodiments, the endonuclease domain has one or more of the functional characteristics described below. In some embodiments, the reverse transcriptase domain has one or more of the functional characteristics described below. In some embodiments, the template (e.g., template RNA) has one or more of the functional characteristics described below. In some embodiments, the target site bound by the Gene Writer has one or more of the functional characteristics described below.

In embodiments, the disclosure provides a nucleic acid molecule or a system for retargeting, e.g., of a Gene Writer polypeptide or nucleic acid molecule, or of a system as described herein. Retargeting (e.g., of a Gene Writer polypeptide or nucleic acid molecule, or of a system as described herein) generally comprises: (i) directing the polypeptide to bind and cleave at the target site; and/or (ii) designing the template RNA to have complementarity to the target sequence. In some embodiments, the template RNA has complementarity to the target sequence 5' of the first-strand nick, e.g., such that the 3' end of the template RNA anneals and the 5' end of the target site serves as the primer, e.g., for target-primed reverse transcription (TPRT). In some embodiments, the endonuclease domain of the polypeptide and the 5' end of the RNA template are also modified as described.

Gene Writer Polypeptide
DNA Binding Domain

In some embodiments, the DNA binding domain is capable of binding to a target sequence (e.g., a dsDNA target sequence) with greater affinity than a reference DNA binding domain. In some embodiments, the reference DNA binding domain is a DNA binding domain from R2_BM of *B. mori*. In some embodiments, the DNA binding domain is capable of binding to a target sequence (e.g., a dsDNA target sequence) with an affinity between 100 pM-10 nM (e.g., between 100 pM-1 nM or 1 nM-10 nM).

In some embodiments, the affinity of a DNA binding domain for its target sequence (e.g., dsDNA target sequence) is measured in vitro, e.g., by thermophoresis, e.g., as described in Asmari et al. Methods 146:107-119 (2018) (incorporated by reference herein in its entirety).

In embodiments, the DNA binding domain is capable of binding to its target sequence (e.g., dsDNA target sequence), e.g, with an affinity between 100 pM-10 nM (e.g., between 100 pM-1 nM or 1 nM-10 nM) in the presence of a molar excess of scrambled sequence competitor dsDNA, e.g., of about 100-fold molar excess.

In some embodiments, the DNA binding domain is found associated with its target sequence (e.g., dsDNA target sequence) more frequently than any other sequence in the genome of a target cell, e.g., human target cell, e.g., as measured by ChIP-seq (e.g., in HEK293T cells), e.g., as described in He and Pu (2010) *Curr. Protoc Mol Biol* Chapter 21 (incorporated herein by reference in its entirety). In some embodiments, the DNA binding domain is found associated with its target sequence (e.g., dsDNA target sequence) at least about 5-fold or 10-fold, more frequently than any other sequence in the genome of a target cell, e.g., as measured by ChIP-seq (e.g., in HEK293T cells), e.g., as described in He and Pu (2010), supra.

In some embodiments, a Gene Writer polypeptide comprises a modification to a DNA-binding domain, e.g., relative to the wild-type polypeptide. In some embodiments, the DNA-binding domain comprises an addition, deletion, replacement, or modification to the amino acid sequence of the original DNA-binding domain. In some embodiments, the DNA-binding domain is modified to include a heterologous functional domain that binds specifically to a target nucleic acid (e.g., DNA) sequence of interest. In some embodiments, the functional domain replaces at least a portion (e.g., the entirety of) the prior DNA-binding domain of the polypeptide. In some embodiments, the functional domain comprises a zinc finger (e.g., a zinc finger that specifically binds to the target nucleic acid (e.g., DNA) sequence of interest. In some embodiments, the functional domain comprises a Cas domain (e.g., a Cas domain that specifically binds to the target nucleic acid (e.g., DNA) sequence of interest. In embodiments, the Cas domain comprises a Cas9 or a mutant or variant thereof (e.g., as described herein). In embodiments, the Cas domain is associated with a guide RNA (gRNA), e.g., as described herein. In embodiments, the Cas domain is directed to a target nucleic acid (e.g., DNA) sequence of interest by the gRNA. In embodiments, the Cas domain is encoded in the same nucleic acid (e.g., RNA) molecule as the gRNA. In embodiments, the Cas domain is encoded in a different nucleic acid (e.g., RNA) molecule from the gRNA.

In some embodiments, a Gene Writer polypeptide comprises a modification to an endonuclease domain, e.g., relative to the wild-type polypeptide. In some embodiments, the endonuclease domain comprises an addition, deletion, replacement, or modification to the amino acid sequence of the original endonuclease domain. In some embodiments, the endonuclease domain is modified to include a heterologous functional domain that binds specifically to and/or induces endonuclease cleavage of a target nucleic acid (e.g., DNA) sequence of interest. In some embodiments, the endonuclease domain comprises a zinc finger. In some embodiments, the endonuclease domain comprises a Cas domain (e.g., a Cas9 or a mutant or variant thereof). In embodiments, the endonuclease domain comprising the Cas domain is associated with a guide RNA (gRNA), e.g., as described herein. In some embodiments, the endonuclease domain is modified to include a functional domain that does not target a specific target nucleic acid (e.g., DNA) sequence. In embodiments, the endonuclease domain comprises a Fok1 domain.

In some embodiments, the reverse transcriptase (RT) domain exhibits enhanced stringency of target-primed reverse transcription (TPRT) initiation, e.g., relative to an endogenous RT domain. In some embodiments, the RT domain initiates TPRT when the 3 nt in the target site immediately upstream of the first strand nick, e.g., the genomic DNA priming the RNA template, have at least 66% or 100% complementarity to the 3 nt of homology in the RNA template. In some embodiments, the RT domain initiates TPRT when there are less than 5 nt mismatched (e.g., less than 1, 2, 3, 4, or 5 nt mismatched) between the template RNA homology and the target DNA priming reverse transcription. In some embodiments, the RT domain is modified such that the stringency for mismatches in priming the TPRT reaction is increased, e.g., wherein the RT domain does not tolerate any mismatches or tolerates fewer mismatches in the priming region relative to a wild-type (e.g., unmodified) RT domain. In some embodiments, the RT domain comprises a HIV-1 RT domain. In embodiments, the HIV-1 RT domain initiates lower levels of synthesis even with three nucleotide mismatches relative to an alternative RT domain (e.g., as described by Jamburuthugoda and Eickbush J Mol Biol 407(5):661-672 (2011); incorporated herein by reference in its entirety).

RNA Binding Domain

In some embodiments, the RNA binding domain is capable of binding to a template RNA with greater affinity than a reference RNA binding domain. In some embodiments, the reference RNA binding domain is an RNA binding domain from R2_BM of *B. mori*. In some embodiments, the RNA binding domain is capable of binding to a template RNA with an affinity between 100 pM-10 nM (e.g., between 100 pM-1 nM or 1 nM-10 nM). In some embodiments, the affinity of a RNA binding domain for its template RNA is measured in vitro, e.g., by thermophoresis, e.g., as described in Asmari et al. Methods 146:107-119 (2018) (incorporated by reference herein in its entirety). In some embodiments, the affinity of a RNA binding domain for its template RNA is measured in cells (e.g., by FRET or CLIP-Seq).

In some embodiments, the RNA binding domain is associated with the template RNA in vitro at a frequency at least about 5-fold or 10-fold higher than with a scrambled RNA. In some embodiments, the frequency of association between the RNA binding domain and the template RNA or scrambled RNA is measured by CLIP-seq, e.g., as described in Lin and Miles (2019) *Nucleic Acids Res* 47(11):5490-

5501 (incorporated by reference herein in its entirety). In some embodiments, the RNA binding domain is associated with the template RNA in cells (e.g., in HEK293T cells) at a frequency at least about 5-fold or 10-fold higher than with a scrambled RNA. In some embodiments, the frequency of association between the RNA binding domain and the template RNA or scrambled RNA is measured by CLIP-seq, e.g., as described in Lin and Miles (2019), supra.

Endonuclease Domain

In some embodiments, the endonuclease domain is associated with the target dsDNA in vitro at a frequency at least about 5-fold or 10-fold higher than with a scrambled dsDNA. In some embodiments, the endonuclease domain is associated with the target dsDNA in vitro at a frequency at least about 5-fold or 10-fold higher than with a scrambled dsDNA, e.g., in a cell (e.g., a HEK293T cell). In some embodiments, the frequency of association between the endonuclease domain and the target DNA or scrambled DNA is measured by ChIP-seq, e.g., as described in He and Pu (2010) *Curr. Protoc Mol Biol* Chapter 21 (incorporated by reference herein in its entirety).

In some embodiments, the endonuclease domain can catalyze the formation of a nick at a target sequence, e.g., to an increase of at least about 5-fold or 10-fold relative to a non-target sequence (e.g., relative to any other genomic sequence in the genome of the target cell). In some embodiments, the level of nick formation is determined using NickSeq, e.g., as described in Elacqua et al. (2019) bioRxiv doi.org/10.1101/867937 (incorporated herein by reference in its entirety).

In some embodiments, the endonuclease domain is capable of nicking DNA in vitro. In embodiments, the nick results in an exposed base. In embodiments, the exposed base can be detected using a nuclease sensitivity assay, e.g., as described in Chaudhry and Weinfeld (1995) *Nucleic Acids Res* 23(19):3805-3809 (incorporated by reference herein in its entirety). In embodiments, the level of exposed bases (e.g., detected by the nuclease sensitivity assay) is increased by at least 10%, 50%, or more relative to a reference endonuclease domain. In some embodiments, the reference endonuclease domain is an endonuclease domain from R2_BM of *B. mori*.

In some embodiments, the endonuclease domain is capable of nicking DNA in a cell. In embodiments, the endonuclease domain is capable of nicking DNA in a HEK293T cell. In embodiments, an unrepaired nick that undergoes replication in the absence of Rad51 results in increased NHEJ rates at the site of the nick, which can be detected, e.g., by using a Rad51 inhibition assay, e.g., as described in Bothmer et al. (2017) *Nat Commun* 8:13905 (incorporated by reference herein in its entirety). In embodiments, NHEJ rates are increased above 0-5%. In embodiments, NHEJ rates are increased to 20-70% (e.g., between 30%-60% or 40-50%), e.g., upon Rad51 inhibition.

Figure 2:
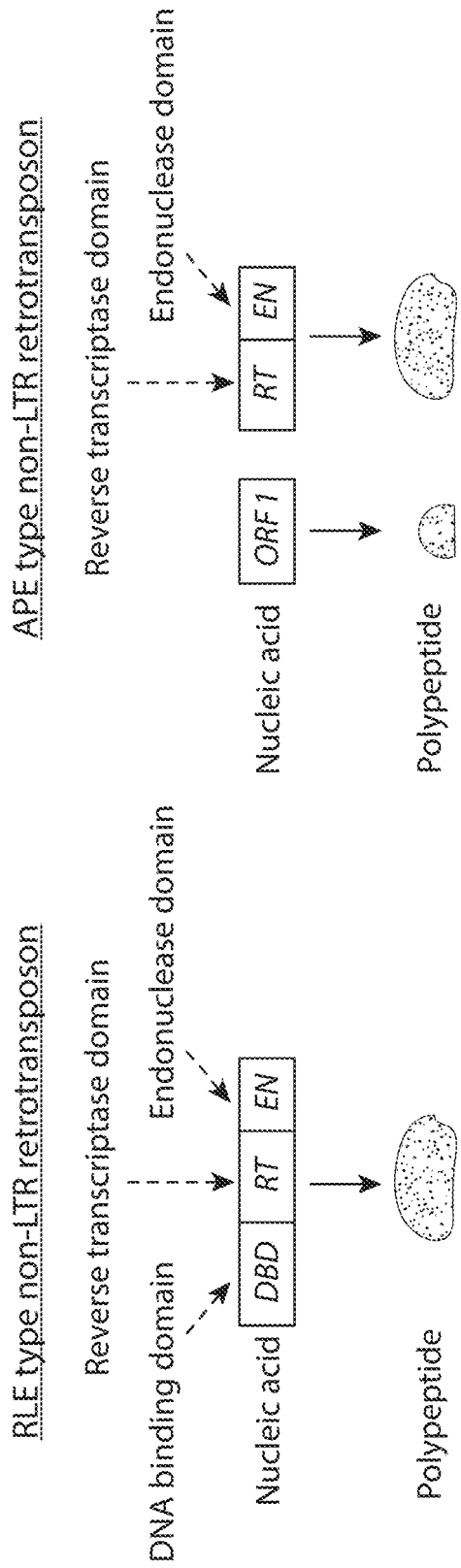
FIG. 2 is a schematic of the structure of the Gene Writer™ genome editor polypeptide.

In some embodiments, the endonuclease domain releases the target after cleavage. In some embodiments, release of the target is indicated indirectly by assessing for multiple turnovers by the enzyme, e.g., as described in Yourik at al. *RNA* 25(1):35-44 (2019) (incorporated herein by reference in its entirety) and shown in FIG. 2. In some embodiments, the $k_{exp}$ of an endonuclease domain is $1 \times 10^{-3}$-$1 \times 10^{-5}$ min-1 as measured by such methods.

In some embodiments, the endonuclease domain has a catalytic efficiency ($k_{cat}/K_m$) greater than about $1 \times 10^8$ s$^{-1}$ M$^{-1}$ in vitro. In embodiments, the endonuclease domain has a catalytic efficiency greater than about $1 \times 10^5$, $1 \times 10^6$, $1 \times 10^7$, or $1 \times 10^8$, s$^{-1}$ M$^{-1}$ in vitro. In embodiments, catalytic efficiency is determined as described in Chen et al. (2018) *Science* 360(6387):436-439 (incorporated herein by reference in its entirety). In some embodiments, the endonuclease domain has a catalytic efficiency ($k_{cat}/K_m$) greater than about $1 \times 10^8$ s$^{-1}$ M$^{-1}$ in cells. In embodiments, the endonuclease domain has a catalytic efficiency greater than about $1 \times 10^5$, $1 \times 10^6$, $1 \times 10^7$, or $1 \times 10^8$ s$^{-1}$ M$^{-1}$ in cells.

Reverse Transcriptase Domain

In some embodiments, the reverse transcriptase domain has a lower probability of premature termination rate ($P_{off}$) in vitro relative to a reference reverse transcriptase domain. In some embodiments, the reference reverse transcriptase domain is a reverse transcriptase domain from R2_BM of *B. mori* or a viral reverse transcriptase domain, e.g., the RT domain from M-MLV.

In some embodiments, the reverse transcriptase domain has a lower probability of premature termination rate ($P_{off}$) in vitro of less than about $5 \times 10^{-3}$/nt, $5 \times 10^{-4}$/nt, or $5 \times 10^{-6}$/nt, e.g., as measured on a 1094 nt RNA. In embodiments, the in vitro premature termination rate is determined as described in Bibillo and Eickbush (2002) *J Biol Chem* 277(38):34836-34845 (incorporated by reference herein its entirety).

In some embodiments, the reverse transcriptase domain is able to complete at least about 30% or 50% of integrations in cells. The percent of complete integrations can be measured by dividing the number of substantially full-length integration events (e.g., genomic sites that comprise at least 98% of the expected integrated sequence) by the number of total (including substantially full-length and partial) integration events in a population of cells. In embodiments, the integrations in cells is determined (e.g., across the integration site) using long-read amplicon sequencing, e.g., as described in Karst et al. (2020) *bioRxiv* doi.org/10.1101/645903 (incorporated by reference herein its in entirety).

In embodiments, quantifying integrations in cells comprises counting the fraction of integrations that contain at least about 75%, 80%, 85%, 90%, 95%, 96%, 97%, 98%, 99%, or 100% of the DNA sequence corresponding to the template RNA (e.g., a template RNA having a length of at least 0.05, 0.1, 0.5, 0.6, 0.7, 0.8, 0.9, 1, 1.5, 2, 3, 4, or 5 kb, e.g., a length between 0.5-0.6, 0.6-0.7, 0.7-0.8, 0.8-0.9, 1.0-1.2, 1.2-1.4, 1.4-1.6, 1.6-1.8, 1.8-2.0, 2-3, 3-4, or 4-5 kb).

In some embodiments, the reverse transcriptase domain is capable of polymerizing dNTPs in vitro. In embodiments, the reverse transcriptase domain is capable of polymerizing dNTPs in vitro at a rate between 0.1-50 nt/see (e.g., between 0.1-1, 1-10, or 10-50 nt/see). In embodiments, polymerization of dNTPs by the reverse transcriptase domain is measured by a single-molecule assay, e.g., as described in Schwartz and Quake (2009) *PNAS* 106(48):20294-20299 (incorporated by reference in its entirety).

In some embodiments, the reverse transcriptase domain has an in vitro error rate (e.g., misincorporation of nucleotides) of between $1 \times 10^{-3}$-$1 \times 10^{-4}$ or $1 \times 10^{-4}$-$1 \times 10^{-5}$ substitutions/nt, e.g., as described in Yasukawa et al. (2017) *Biochem Biophys Res Commun* 492(2): 147-153 (incorporated herein by reference in its entirety). In some embodiments, the reverse transcriptase domain has an error rate (e.g., misincorporation of nucleotides) in cells (e.g., HEK293T cells) of between $1 \times 10^{-3}$-$1 \times 10^{-4}$ or $1 \times 10^{-4}$-$1 \times 10^{-5}$ substitutions/nt, e.g., by long-read amplicon sequencing, e.g., as described in Karst et al. (2020) *bioRxiv* doi.org/10.1101/645903 (incorporated by reference herein in its entirety).

In some embodiments, the reverse transcriptase domain is capable of performing reverse transcription of a target RNA in vitro. In some embodiments, the reverse transcriptase requires a primer of at least 3 nt to initiate reverse transcription of a template. In some embodiments, reverse transcription of the target RNA is determined by detection of cDNA from the target RNA (e.g., when provided with a ssDNA primer, e.g., which anneals to the target with at least 3, 4, 5, 6, 7, 8, 9, or 10 nt at the 3' end), e.g., as described in Bibillo and Eickbush (2002) *J Biol Chem* 277(38):34836-34845 (incorporated herein by reference in its entirety).

In some embodiments, the reverse transcriptase domain performs reverse transcription at least 5 or 10 times more efficiently (e.g., by cDNA production), e.g., when converting its RNA template to cDNA, for example, as compared to an RNA template lacking the protein binding motif (e.g., a 3' UTR). In embodiments, efficiency of reverse transcription is measured as described in Yasukawa et al. (2017) *Biochem Biophys Res Commun* 492(2):147-153 (incorporated by reference herein in its entirety).

In some embodiments, the reverse transcriptase domain specifically binds a specific RNA template with higher frequency (e.g., about 5 or 10-fold higher frequency) than any endogenous cellular RNA, e.g., when expressed in cells (e.g., HEK293T cells). In embodiments, frequency of specific binding between the reverse transcriptase domain and the template RNA are measured by CLIP-seq, e.g., as described in Lin and Miles (2019) *Nucleic Acids Res* 47(11): 5490-5501 (incorporated herein by reference in its entirety).

Target Site

In some embodiments, after Gene Writing, the target site surrounding the integrated sequence contains a limited number of insertions or deletions, for example, in less than about 50% or 10% of integration events, e.g., as determined by long-read amplicon sequencing of the target site, e.g., as described in Karst et al. (2020) *bioRxiv* doi.org/10.1101/645903 (incorporated by reference herein in its entirety). In some embodiments, the target site does not show multiple insertion events, e.g., head-to-tail or head-to-head duplications, e.g., as determined by long-read amplicon sequencing of the target site, e.g., as described in Karst et al. *bioRxiv* doi.org/10.1101/645903 (2020) (incorporated herein by reference in its entirety). In some embodiments, the target site contains an integrated sequence corresponding to the template RNA. In some embodiments, the target site does not contain insertions resulting from endogenous RNA in more than about 1% or 10% of events, e.g., as determined by long-read amplicon sequencing of the target site, e.g., as described in Karst et al. *bioRxiv* doi.org/10.1101/645903 (2020) (incorporated herein by reference in its entirety). In some embodiments, the target site contains the integrated sequence corresponding to the template RNA.

In some embodiments, the target site contains an integrated sequence corresponding to the template RNA. In embodiments, the target site does not comprise sequence outside of the RT template (e.g., gRNA scaffold, vector backbone, and/or ITRs), e.g., as determined by long-read amplicon sequencing of the target site (for example, as described in Karst et al. *bioRxiv* doi.org/10.1101/645903 (2020); incorporated herein by reference in its entirety).

Evolved Variants of Gene Writers

In some embodiments, the invention provides evolved variants of Gene Writers. Evolved variants can, in some embodiments, be produced by mutagenizing a reference Gene Writer, or one of the fragments or domains comprised therein. In some embodiments, one or more of the domains (e.g., the reverse transcriptase, DNA binding (including, for example, sequence-guided DNA binding elements), RNA-binding, or endonuclease domain) is evolved. One or more of such evolved variant domains can, in some embodiments, be evolved alone or together with other domains. An evolved variant domain or domains may, in some embodiments, be combined with unevolved cognate component(s) or evolved variants of the cognate component(s), e.g., which may have been evolved in either a parallel or serial manner.

In some embodiments, the process of mutagenizing a reference Gene Writer, or fragment or domain thereof, comprises mutagenizing the reference Gene Writer or fragment or domain thereof. In embodiments, the mutagenesis comprises a continuous evolution method (e.g., PACE) or non-contious evolution method (e.g., PANCE), e.g., as described herein. In some embodiments, the evolved Gene Writer, or a fragment or domain thereof, comprises one or more amino acid variations introduced into its amino acid sequence relative to the amino acid sequence of the reference Gene Writer, or fragment or domain thereof. In embodiments, amino acid sequence variations may include one or more mutated residues (e.g., conservative substitutions, non-conservative substitutions, or a combination thereof) within the amino acid sequence of a reference Gene Writer, e.g., as a result of a change in the nucleotide sequence encoding the gene writer that results in, e.g., a change in the codon at any particular position in the coding sequence, the deletion of one or more amino acids (e.g., a truncated protein), the insertion of one or more amino acids, or any combination of the foregoing. The evolved variant Gene Writer may include variants in one or more components or domains of the Gene Writer (e.g., variants introduced into a reverse transcriptase domain, endonuclease domain, DNA binding domain, RNA binding domain, or combinations thereof).

In some aspects, the invention provides Gene Writers, systems, kits, and methods using or comprising an evolved variant of a Gene Writer, e.g., employs an evolved variant of a Gene Writer or a Gene Writer produced or produceable by PACE or PANCE. In embodiments, the unevolved reference Gene Writer is a Gene Writer as disclosed herein.

The term "phage-assisted continuous evolution (PACE)," as used herein, generally refers to continuous evolution that employs phage as viral vectors. Examples of PACE technology have been described, for example, in International PCT Application No. PCT/US 2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Pat. No. 9,023,594, issued May 5, 2015; U.S. Pat. No. 9,771,574, issued Sep. 26, 2017; U.S. Pat. No. 9,394, 537, issued Jul. 19, 2016; International PCT Application, PCT/US2015/012022, filed Jan. 20, 2015, published as WO 2015/134121 on Sep. 11, 2015; U.S. Pat. No. 10,179,911, issued Jan. 15, 2019; and International PCT Application, PCT/US2016/027795, filed Apr. 15, 2016, published as WO 2016/168631 on Oct. 20, 2016, the entire contents of each of which are incorporated herein by reference.

The term "phage-assisted non-continuous evolution (PANCE)," as used herein, generally refers to non-continuous evolution that employs phage as viral vectors. Examples of PANCE technology have been described, for example, in Suzuki T. et al, Crystal structures reveal an elusive functional domain of pyrrolysyl-tRNA synthetase, Nat Chem Biol. 13(12): 1261-1266 (2017), incorporated herein by reference in its entirety. Briefly, PANCE is a technique for rapid in vivo directed evolution using serial flask transfers of evolving selection phage (SP), which contain a gene of interest to be evolved, across fresh host cells (e.g., *E. coli* cells). Genes inside the host cell may be held constant while genes contained in the SP continuously evolve. Following phage growth, an aliquot of infected cells may be used to transfect a subsequent flask containing host *E. coli*. This process can be repeated and/or continued until the desired phenotype is evolved, e.g., for as many transfers as desired.

Methods of applying PACE and PANCE to Gene Writers may be readily appreciated by the skilled artisan by reference to, inter alia, the foregoing references. Additional exemplary methods for directing continuous evolution of genome-modifying proteins or systems, e.g., in a population of host cells, e.g., using phage particles, can be applied to generate evolved variants of Gene Writers, or fragments or subdomains thereof. Non-limiting examples of such methods are described in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Pat. No. 9,023,594, issued May 5, 2015; U.S. Pat. No. 9,771,574, issued Sep. 26, 2017; U.S. Pat. No. 9,394,537, issued Jul. 19, 2016; International PCT Application, PCT/US2015/012022, filed Jan. 20, 2015, published as WO 2015/134121 on Sep. 11, 2015; U.S. Pat. No. 10,179,911, issued Jan. 15, 2019; International Application No. PCT/US2019/37216, filed Jun. 14, 2019, International Patent Publication WO 2019/023680, published Jan. 31, 2019, International PCT Application, PCT/US2016/027795, filed Apr. 15, 2016, published as WO 2016/168631 on Oct. 20, 2016, and International Patent Publication No. PCT/US2019/47996, filed Aug. 23, 2019, each of which is incorporated herein by reference in its entirety.

In some non-limiting illustrative embodiments, a method of evolution of a evolved variant Gene Writer, of a fragment or domain thereof, comprises: (a) contacting a population of host cells with a population of viral vectors comprising the gene of interest (the starting Gene Writer or fragment or domain thereof), wherein: (1) the host cell is amenable to infection by the viral vector; (2) the host cell expresses viral genes required for the generation of viral particles; (3) the expression of at least one viral gene required for the production of an infectious viral particle is dependent on a function of the gene of interest; and/or (4) the viral vector allows for expression of the protein in the host cell, and can be replicated and packaged into a viral particle by the host cell. In some embodiments, the method comprises (b) contacting the host cells with a mutagen, using host cells with mutations that elevate mutation rate (e.g., either by carrying a mutation plasmid or some genome modification—e.g., proofing-impaired DNA polymerase, SOS genes, such as UmuC, UmuD', and/or RecA, which mutations, if plasmid-bound, may be under control of an inducible promoter), or a combination thereof. In some embodiments, the method comprises (c) incubating the population of host cells under conditions allowing for viral replication and the production of viral particles, wherein host cells are removed from the host cell population, and fresh, uninfected host cells are introduced into the population of host cells, thus replenishing the population of host cells and creating a flow of host cells. In some embodiments, the cells are incubated under conditions allowing for the gene of interest to acquire a mutation. In some embodiments, the method further comprises (d) isolating a mutated version of the viral vector, encoding an evolved gene product (e.g., an evolved variant Gene Writer, or fragment or domain thereof), from the population of host cells.

The skilled artisan will appreciate a variety of features employable within the above-described framework. For example, in some embodiments, the viral vector or the phage is a filamentous phage, for example, an M13 phage, e.g., an M13 selection phage. In certain embodiments, the gene required for the production of infectious viral particles is the M13 gene III (gIII). In embodiments, the phage may lack a functional gIII, but otherwise comprise gI, gII, gIV, gV, gVI, gVII, gVIII, gIX, and a gX. In some embodiments, the generation of infectious VSV particles involves the envelope protein VSV-G. Various embodiments can use different retroviral vectors, for example, Murine Leukemia Virus vectors, or Lentiviral vectors. In embodiments, the retroviral vectors can efficiently be packaged with VSV-G envelope protein, e.g., as a substitute for the native envelope protein of the virus.

In some embodiments, host cells are incubated according to a suitable number of viral life cycles, e.g., at least 10, at least 20, at least 30, at least 40, at least 50, at least 100, at least 200, at least 300, at least 400, at least, 500, at least 600, at least 700, at least 800, at least 900, at least 1000, at least 1250, at least 1500, at least 1750, at least 2000, at least 2500, at least 3000, at least 4000, at least 5000, at least 7500, at least 10000, or more consecutive viral life cycles, which in on illustrative and non-limiting examples of M13 phage is 10-20 minutes per virus life cycle. Similarly, conditions can be modulated to adjust the time a host cell remains in a population of host cells, e.g., about 10, about 11, about 12, about 13, about 14, about 15, about 16, about 17, about 18, about 19, about 20, about 21, about 22, about 23, about 24, about 25, about 30, about 35, about 40, about 45, about 50, about 55, about 60, about 70, about 80, about 90, about 100, about 120, about 150, or about 180 minutes. Host cell populations can be controlled in part by density of the host cells, or, in some embodiments, the host cell density in an inflow, e.g., $10^3$ cells/ml, about $10^4$ cells/ml, about $10^5$ cells/ml, about $5 \cdot 10^5$ cells/ml, about $10^6$ cells/ml, about $5 \cdot 10^6$ cells/ml, about $10^7$ cells/ml, about $5 \cdot 10^7$ cells/ml, about $10^8$ cells/ml, about $5 \cdot 10^8$ cells/ml, about $10^9$ cells/ml, about $5 \cdot 10^9$ cells/ml, about $10^{10}$ cells/ml, or about $5 \cdot 10^{10}$ cells/ml.

Promoters

In some embodiments, one or more promoter or enhancer elements are operably linked to a nucleic acid encoding a Gene Writer protein or a template nucleic acid, e.g., that controls expression of the heterologous object sequence. In certain embodiments, the one or more promoter or enhancer elements comprise cell-type or tissue specific elements. In some embodiments, the promoter or enhancer is the same or derived from the promoter or enhancer that naturally controls expression of the heterologous object sequence. For example, the ornithine transcarbomylase promoter and enhancer may be used to control expression of the ornithine transcarbomylase gene in a system or method provided by the invention for correcting ornithine transcarbomylase deficiencies. In some embodiments, a promoter for use in the invention is for a gene described in any one of Tables 9-22, e.g., which may be used with an allele of the reference gene, or, in other embodiments, with a heterologous gene. In some embodiments, the promoter is a promoter of Table 33 or a functional fragment or variant thereof.

Exemplary tissue specific promoters that are commercially available can be found, for example, at a uniform resource locator (e.g., invivogen.com/tissue-specific-promoters). In some embodiments, a promoter is a native promoter or a minimal promoter, e.g., which consists of a single fragment from the 5' region of a given gene. In some embodiments, a native promoter comprises a core promoter and its natural 5' UTR. In some embodiments, the 5' UTR comprises an intron. In other embodiments, these include composite promoters, which combine promoter elements of different origins or were generated by assembling a distal enhancer with a minimal promoter of the same origin.

Exemplary cell or tissue specific promoters are provided in the tables, below, and exemplary nucleic acid sequences encoding them are known in the art and can be readily accessed using a variety of resources, such as the NCBI database, including RefSeq, as well as the Eukaryotic Promoter Database (/epd.epfl.ch/index.php).

TABLE 33

Exemplary cell or tissue-specific promoters

| Promoter | Target cells |
|---|---|
| B29 Promoter | B cells |
| CD14 Promoter | Monocytic Cells |
| CD43 Promoter | Leukocytes and platelets |
| CD45 Promoter | Hematopoeitic cells |
| CD68 promoter | macrophages |
| Desmin promoter | muscle cells |
| Elastase-1 promoter | pancreatic acinar cells |
| Endoglin promoter | endothelial cells |

TABLE 33-continued

Exemplary cell or tissue-specific promoters

| Promoter | Target cells |
|---|---|
| fibronectin promoter | differentiating cells, healing tissue |
| Flt-1 promoter | endothelial cells |
| GFAP promoter | Astrocytes |
| GPIIB promoter | megakaryocytes |
| ICAM-2 Promoter | Endothelial cells |
| INF-Beta promoter | Hematopoeitic cells |
| Mb promoter | muscle cells |
| Nphs 1 promoter | podocytes |
| OG-2 promoter | Osteoblasts, Odonblasts |
| SP-B promoter | Lung |
| Syn1 promoter | Neurons |
| WASP promoter | Hematopoeitic cells |
| SV40/bAlb promoter | Liver |
| SV40/bAlb promoter | Liver |
| SV40/Cd3 promoter | Leukocytes and platelets |
| SV40/CD45 promoter | hematopoeitic cells |
| NSE/RU5' promoter | Mature Neurons |

TABLE 34

Additional exemplary cell or tissue-specific promoters

| Promoter | Gene Description | Gene Specificity |
|---|---|---|
| APOA2 | Apolipoprotein A-II | Hepatocytes (from hepatocyte progenitors) |
| SERPINA 1 (hAAT) | Serpin peptidase inhibitor, clade A (alpha-1 antiproteinase, antitrypsin), member 1 (also named alpha 1 anti-tryps in) | Hepatocytes (from definitive endoderm stage) |
| CYP3A | Cytochrome P450, family 3, subfamily A, polypeptide | Mature Hepatocytes |
| MIR122 | MicroRNA 122 | Hepatocytes (from early stage embryonic liver cells) and endoderm |
| Pancreatic specific promoters | | |
| INS | Insulin | Pancreatic beta cells (from definitive endoderm stage) |
| IRS2 | Insulin receptor substrate 2 | Pancreatic beta cells |
| Pdx1 | Pancreatic and duodenal homeobox 1 | Pancreas (from definitive endoderm stage) |
| Alx3 | Aristaless-like homeobox 3 | Pancreatic beta cells (from definitive endoderm stage) |
| Ppy | Pancreatic polypeptide | PP pancreatic cells (gamma cells) |
| Cardiac specific promoters | | |
| Myh6 (aMHC) | Myosin, heavy chain 6, cardiac muscle, alpha | Late differentiation marker of cardiac muscle cells (atrial specificity) |
| MYL2 (MLC-2v) | Myosin, light chain 2, regulatory, cardiac, slow | Late differentiation marker of cardiac muscle cells (ventricular specificity) |
| ITNN13 (cTnI) | Troponin I type 3 (cardiac) | Cardiomyocytes (from immature state) |
| ITNN13 (cTnI) | Troponin I type 3 (cardiac) | Cardiomyocytes (from immature state) |
| NPPA (ANF) | Natriuretic peptide precursor A (also named Atrial Natriuretic Factor) | Atrial specificity in adult cells |
| Slc8a1 (Ncx1) | Solute carrier family 8 (sodium/calcium exchanger), member 1 | Cardiomyocytes from early developmental stages |

TABLE 34-continued

Additional exemplary cell or tissue-specific promoters

| Promoter | Gene Description | Gene Specificity |
|---|---|---|
| CNS specific promoters | | |
| SYN1 (hSyn) | Synapsin I | Neurons |
| GFAP | Glial fibrillary acidic protein | Astrocytes |
| INA | Internexin neuronal intermediate filament protein, alpha (a-internexin) | Neuroprogenitors |
| NES | Nestin | Neuroprogenitors and ectoderm |
| MOBP | Myelin-associated oligodendrocyte basic protein | Oligodendrocytes |
| MBP | Myelin basic protein | Oligodendrocytes |
| TH | Tyrosine hydroxylase | Dopaminergic neurons |
| FOXA2 (HNF3 beta) | Forkhead box A2 | Dopaminergic neurons (also used as a marker of endoderm) |
| Skin specific promoters | | |
| FLG | Filaggrin | Keratinocytes from granular layer |
| K14 | Keratin 14 | Keratinocytes from granular and basal layers |
| TGM3 | Transglutaminase 3 | Keratinocytes from granular layer |
| Immune cell specific promoters | | |
| ITGAM (CD11B) | Integrin, alpha M (complement component 3 receptor 3 subunit) | Monocytes, macrophages, granulocytes, natural killer cells |
| Urogential cell specific promoters | | |
| Pbsn | Probasin | Prostatic epithelium |
| Upk2 | Uroplakin 2 | Bladder |
| Sbp | Spermine binding protein | Prostate |
| Ferl14 | Fer-1-like 4 | Bladder |
| Endothelial cell specific promoters | | |
| ENG | Endoglin | Endothelial cells |
| Pluripotent and embryonic cell specific promoters | | |
| Oct4 (POU5F1) | POU class 5 homeobox 1 | Pluripotent cells (germ cells, ES cells, iPS cells) |
| NANOG | Nanog homeobox | Pluripotent cells (ES cells, iPS cells) |
| Synthetic Oct4 | Synthetic promoter based on a Oct-4 core enhancer element | Pluripotent cells (ES cells, iPS cells) |
| T brachyury | Brachyury | Mesoderm |
| NES | Nestin | Neuroprogenitors and Ectoderm |
| SOX17 | SRY (sex determining region Y)-box 17 | Endoderm |
| FOXA2 (HNFJ beta) | Forkhead box A2 | Endoderm (also used as a marker of dopaminergic neurons) |
| MIR122 | MicroRNA 122 | Endoderm and hepatocytes (from early stage embryonic liver cells~ |

Depending on the host/vector system utilized, any of a number of suitable transcription and translation control elements, including constitutive and inducible promoters, transcription enhancer elements, transcription terminators, etc. may be used in the expression vector (see e.g., Bitter et al. (1987) *Methods in Enzymology*, 153:516-544; incorporated herein by reference in its entirety).

In some embodiments, a nucleic acid encoding a Gene Writer or template nucleic acid is operably linked to a control element, e.g., a transcriptional control element, such as a promoter. The transcriptional control element may, in some embodiment, be functional in either a eukaryotic cell, e.g., a mammalian cell; or a prokaryotic cell (e.g., bacterial or archaeal cell). In some embodiments, a nucleotide sequence encoding a polypeptide is operably linked to multiple control elements, e.g., that allow expression of the nucleotide sequence encoding the polypeptide in both prokaryotic and eukaryotic cells.

For illustration purposes, examples of spatially restricted promoters include, but are not limited to, neuron-specific promoters, adipocyte-specific promoters, cardiomyocyte-specific promoters, smooth muscle-specific promoters, photoreceptor-specific promoters, etc. Neuron-specific spatially restricted promoters include, but are not limited to, a neuron-specific enolase (NSE) promoter (see, e.g., EMBL HSENO2, X51956); an aromatic amino acid decarboxylase (AADC) promoter, a neurofilament promoter (see, e.g., GenBank HUMNFL, L04147); a synapsin promoter (see, e.g., GenBank HUMSYNIB, M55301); a thy-1 promoter (see, e.g., Chen et al. (1987) Cell 51:7-19; and Llewellyn, et al. (2010) Nat. Med. 16(10):1161-1166); a serotonin receptor promoter (see, e.g., GenBank S62283); a tyrosine hydroxylase promoter (TH) (see, e.g., Oh et al. (2009) Gene Ther 16:437; Sasaoka et al. (1992) Mol. Brain Res. 16:274; Boundy et al. (1998) J. Neurosci. 18:9989; and Kaneda et al. (1991) Neuron 6:583-594); a GnRH promoter (see, e.g., Radovick et al. (1991) Proc. Natl. Acad. Sci. USA 88:3402-3406); an L7 promoter (see, e.g., Oberdick et al. (1990) Science 248:223-226); a DNMT promoter (see, e.g., Bartge et al. (1988) Proc. Natl. Acad. Sci. USA 85:3648-3652); an enkephalin promoter (sce, e.g., Comb et al. (1988) EMBO J. 17:3793-3805); a myelin basic protein (MBP) promoter; a Ca2+-calmodulin-dependent protein kinase II-alpha (CamKIIa) promoter (see, e.g., Mayford et al. (1996) Proc. Natl. Acad. Sci. USA 93:13250; and Casanova et al. (2001) Genesis 31:37); a CMV enhancer/platelet-derived growth factor-β promoter (see, e.g., Liu et al. (2004) Gene Therapy 11:52-60); and the like.

Adipocyte-specific spatially restricted promoters include, but are not limited to, the aP2 gene promoter/enhancer, e.g., a region from −5.4 kb to +21 bp of a human aP2 gene (see, e.g., Tozzo et al. (1997) Endocrinol. 138:1604; Ross et al. (1990) Proc. Natl. Acad. Sci. USA 87:9590; and Pavjani et al. (2005) Nat. Med. 11:797); a glucose transporter-4 (GLUT4) promoter (see, e.g., Knight et al. (2003) Proc. Natl. Acad. Sci. USA 100:14725); a fatty acid translocase (FAT/CD36) promoter (see, e.g., Kuriki et al. (2002) Biol. Pharm. Bull. 25:1476; and Sato et al. (2002) J. Biol. Chem. 277:15703); a stearoyl-CoA desaturase-1 (SCD1) promoter (Tabor et al. (1999) J. Biol. Chem. 274:20603); a leptin promoter (see, e.g., Mason et al. (1998) Endocrinol. 139:1013; and Chen et al. (1999) Biochem. Biophys. Res. Comm. 262:187); an adiponectin promoter (see, e.g., Kita et al. (2005) Biochem. Biophys. Res. Comm. 331:484; and Chakrabarti (2010) Endocrinol. 151:2408); an adipsin promoter (see, e.g., Platt et al. (1989) Proc. Natl. Acad. Sci. USA 86:7490); a resistin promoter (see, e.g., Seo et al. (2003) Molec. Endocrinol. 17:1522); and the like.

Cardiomyocyte-specific spatially restricted promoters include, but are not limited to, control sequences derived from the following genes: myosin light chain-2, α-myosin heavy chain, AE3, cardiac troponin C, cardiac actin, and the like. Franz et al. (1997) Cardiovasc. Res. 35:560-566; Robbins et al. (1995) Ann. N.Y. Acad. Sci. 752:492-505; Linn et al. (1995) Circ. Res. 76:584-591; Parmacek et al. (1994) Mol. Cell. Biol. 14:1870-1885; Hunter et al. (1993) Hypertension 22:608-617; and Sartorelli et al. (1992) Proc. Natl. Acad. Sci. USA 89:4047-4051.

Smooth muscle-specific spatially restricted promoters include, but are not limited to, an SM22a promoter (see, e.g., Akyürek et al. (2000) Mol. Med. 6:983; and U.S. Pat. No. 7,169,874); a smoothelin promoter (see, e.g., WO 2001/018048); an α-smooth muscle actin promoter; and the like. For example, a 0.4 kb region of the SM22a promoter, within which lie two CArG elements, has been shown to mediate vascular smooth muscle cell-specific expression (sce, e.g., Kim, et al. (1997) Mol. Cell. Biol. 17, 2266-2278; Li, et al., (1996) J. Cell Biol. 132, 849-859; and Moessler, et al. (1996) Development 122, 2415-2425).

Photoreceptor-specific spatially restricted promoters include, but are not limited to, a rhodopsin promoter; a rhodopsin kinase promoter (Young et al. (2003) Ophthalmol. Vis. Sci. 44:4076); a beta phosphodiesterase gene promoter (Nicoud et al. (2007) J. Gene Med. 9:1015); a retinitis pigmentosa gene promoter (Nicoud et al. (2007) supra); an interphotoreceptor retinoid-binding protein (IRBP) gene enhancer (Nicoud et al. (2007) supra); an IRBP gene promoter (Yokoyama et al. (1992) Exp Eye Res. 55:225); and the like.

Nonlimiting Exemplary Cells-Specific Promoters

Cell-specific promoters known in the art may be used to direct expression of a Gene Writer protein, e.g., as described herein. Nonlimiting exemplary mammalian cell-specific promoters have been characterized and used in mice expressing Cre recombinase in a cell-specific manner. Certain nonlimiting exemplary mammalian cell-specific promoters are listed in Table 1 of U.S. Pat. No. 9,845,481, incorporated herein by reference.

In some embodiments, a cell-specific promoters is a promoter that is active in plants. Many exemplary cell-specific plant promoters are known in the art. See, e.g., U.S. Pat. Nos. 5,097,025; 5,783,393; 5,880,330; 5,981,727; 7,557,264; 6,291,666; 7,132,526; and 7,323,622; and U.S. Publication Nos. 2010/0269226; 2007/0180580; 2005/0034192; and 2005/0086712, which are incorporated by reference herein in their entireties for any purpose.

In some embodiments, a vector as described herein comprises an expression cassette. The term "expression cassette", as used herein, refers to a nucleic acid construct comprising nucleic acid elements sufficient for the expression of the nucleic acid molecule of the instant invention. Typically, an expression cassette comprises the nucleic acid molecule of the instant invention operatively linked to a promoter sequence. The term "operatively linked" refers to the association of two or more nucleic acid fragments on a single nucleic acid fragment so that the function of one is affected by the other. For example, a promoter is operatively linked with a coding sequence when it is capable of affecting the expression of that coding sequence (e.g., the coding sequence is under the transcriptional control of the promoter). Encoding sequences can be operatively linked to regulatory sequences in sense or antisense orientation. In certain embodiments, the promoter is a heterologous promoter. The term "heterologous promoter", as used herein, refers to a promoter that is not found to be operatively linked to a given encoding sequence in nature. In certain embodiments, an expression cassette may comprise additional elements, for example, an intron, an enhancer, a polyadenylation site, a woodchuck response element (WRE), and/or other elements known to affect expression levels of the encoding sequenceA "promoter" typically controls the expression of a coding sequence or functional RNA. In certain embodiments, a promoter sequence comprises proximal and more distal upstream elements and can further comprise an enhancer element. An "enhancer" can typically stimulate promoter activity and may be an innate element of the promoter or a heterologous element inserted to enhance the level or tissue-specificity of a promoter. In certain embodiments, the promoter is derived in its entirety from a native gene. In certain embodiments, the promoter is composed of different elements derived from different naturally occurring promoters. In certain embodiments, the promoter comprises a synthetic nucleotide sequence. It will be understood by those skilled in the art that different promoters will direct the expression of a gene in different tissues or cell types, or at different stages of development, or in response to different environmental conditions or to the presence or the absence of a drug or transcriptional co-factor. Ubiquitous, cell-type-specific, tissue-specific, developmental stage-specific, and conditional promoters, for example, drug-responsive promoters (e.g., tetracycline-responsive promoters) are well known to those of skill in the art. Examples of promoter include, but are not limited to, the phosphoglycerate kinase (PKG) promoter, CAG (composite of the CMV enhancer the chicken beta actin promoter (CBA) and the rabbit beta globin intron.), NSE (neuronal specific enolase), synapsin or NeuN promoters, the SV40 early promoter, mouse mammary tumor virus LTR promoter; adenovirus major late promoter (Ad MLP); a herpes simplex virus (HSV) promoter, a cytomegalovirus (CMV) promoter such as the CMV immediate early promoter region (CMVIE), SFFV promoter, rous sarcoma virus (RSV) promoter, synthetic promoters, hybrid promoters, and the like.

Other promoters can be of human origin or from other species, including from mice. Common promoters include, e.g., the human cytomegalovirus (CMV) immediate early gene promoter, the SV40 early promoter, the Rous sarcoma virus long terminal repeat, [beta]-actin, rat insulin promoter, the phosphoglycerate kinase promoter, the human alpha-1 antitrypsin (hAAT) promoter, the transthyretin promoter, the TBG promoter and other liver-specific promoters, the desmin promoter and similar muscle-specific promoters, the EF1-alpha promoter, the CAG promoter and other constitutive promoters, hybrid promoters with multi-tissue specificity, promoters specific for neurons like synapsin and glyceraldehyde-3-phosphate dehydrogenase promoter, all of which are promoters well known and readily available to those of skill in the art, can be used to obtain high-level expression of the coding sequence of interest. In addition, sequences derived from non-viral genes, such as the murine metallothionein gene, will also find use herein. Such promoter sequences are commercially available from, e.g., Stratagene (San Diego, CA). Additional exemplary promoter sequences are described, for example, in WO2018213786A1 (incorporated by reference herein in its entirety).

In some embodiments, the apolipoprotein E enhancer (ApoE) or a functional fragment thereof is used, e.g., to drive expression in the liver. In some embodiments, two copies of the ApoE enhancer or a functional fragment thereof is used. In some embodiments, the ApoE enhancer or functional fragment thereof is used in combination with a promoter, e.g., the human alpha-1 antitrypsin (hAAT) promoter.

In some embodiments, the regulatory sequences impart tissue-specific gene expression capabilities. In some cases, the tissue-specific regulatory sequences bind tissue-specific transcription factors that induce transcription in a tissue specific manner. Various tissue-specific regulatory sequences (e.g., promoters, enhancers, etc.) are known in the art. Exemplary tissue-specific regulatory sequences include, but are not limited to, the following tissue-specific promoters: a liver-specific thyroxin binding globulin (TBG) promoter, a insulin promoter, a glucagon promoter, a somatostatin promoter, a pancreatic polypeptide (PPY) promoter, a synapsin-1 (Syn) promoter, a creatine kinase (MCK) promoter, a mammalian desmin (DES) promoter, a α-myosin heavy chain (a-MHC) promoter, or a cardiac Troponin T (cTnT) promoter. Other exemplary promoters include Beta-actin promoter, hepatitis B virus core promoter, Sandig et al., Gene Ther., 3:1002-9 (1996); alpha-fetoprotein (AFP) promoter, Arbuthnot et al., Hum. Gene Ther., 7:1503-14 (1996)), bone osteocalcin promoter (Stein et al., Mol. Biol. Rep., 24:185-96 (1997)); bone sialoprotein promoter (Chen et al., J. Bone Miner. Res., 11:654-64 (1996)), CD2 promoter (Hansal et al., J. Immunol., 161:1063-8 (1998); immunoglobulin heavy chain promoter; T cell receptor α-chain promoter, neuronal such as neuron-specific enolase (NSE) promoter (Andersen et al., Cell. Mol. Neurobiol., 13:503-15 (1993)), neurofilament light-chain gene promoter (Piccioli et al., Proc. Natl. Acad. Sci. USA, 88:5611-5 (1991)), and the neuron-specific vgf gene promoter (Piccioli et al., Neuron, 15:373-84 (1995)), and others. Additional exemplary promoter sequences are described, for example, in U.S. patent Ser. No. 10/300,146 (incorporated herein by reference in its entirety). In some embodiments, a tissue-specific regulatory element, e.g., a tissue-specific promoter, is selected from one known to be operably linked to a gene that is highly expressed in a given tissue, e.g., as measured by RNA-seq or protein expression data, or a combination thereof. Methods for analyzing tissue specificity by expression are taught in Fagerberg et al. *Mol Cell Proteomics* 13(2):397-406 (2014), which is incorporated herein by reference in its entirety.

In some embodiments, a vector described herein is a multicistronic expression construct. Multicistronic expression constructs include, for example, constructs harboring a first expression cassette, e.g. comprising a first promoter and a first encoding nucleic acid sequence, and a second expression cassette, e.g. comprising a second promoter and a second encoding nucleic acid sequence. Such multicistronic expression constructs may, in some instances, be particularly useful in the delivery of non-translated gene products, such as hairpin RNAs, together with a polypeptide, for example, a gene writer and gene writer template. In some embodiments, multicistronic expression constructs may exhibit reduced expression levels of one or more of the included transgenes, for example, because of promoter interference or the presence of incompatible nucleic acid elements in close proximity. If a multicistronic expression construct is part of a viral vector, the presence of a self-complementary nucleic acid sequence may, in some instances, interfere with the formation of structures necessary for viral reproduction or packaging.

In some embodiments, the sequence encodes an RNA with a hairpin. In some embodiments, the hairpin RNA is an a guide RNA, a template RNA, shRNA, or a microRNA. In some embodiments, the first promoter is an RNA polymerase I promoter. In some embodiments, the first promoter is an RNA polymerase II promoter. In some embodiments, the second promoter is an RNA polymerase III promoter. In some embodiments, the second promoter is a U6 or H1 promoter. In some embodiments, the nucleic acid construct comprises the structure of AAV construct B1 or B2.

Without wishing to be bound by theory, multicistronic expression constructs may not achieve optimal expression levels as compared to expression systems containing only one cistron. One of the suggested causes of lower expression levels achieved with multicistronic expression constructs comprising two ore more promoter elements is the phenomenon of promoter interference (see, e.g., Curtin J A, Dane A P, Swanson A, Alexander I E, Ginn S L. *Bidirectional promoter interference between two widely used internal heterologous promoters in a late-generation lentiviral construct*. Gene Ther. 2008 March; 15(5):384-90; and Martin-Duque P, Jezzard S, Kaftansis L, Vassaux G. *Direct comparison of the insulating properties of two genetic elements in an adenoviral vector containing two different expression cassettes*. Hum Gene Ther. 2004 October; 15(10):995-1002; both references incorporated herein by reference for disclosure of promoter interference phenomenon). In some embodiments, the problem of promoter interference may be overcome, e.g., by producing multicistronic expression constructs comprising only one promoter driving transcription of multiple encoding nucleic acid sequences separated by internal ribosomal entry sites, or by separating cistrons comprising their own promoter with transcriptional insulator elements. In some embodiments, single-promoter driven expression of multiple cistrons may result in uneven expression levels of the cistrons. In some embodiments, a promoter cannot efficiently be isolated and isolation elements may not be compatible with some gene transfer vectors, for example, some retroviral vectors.

MicroRNAs miRNAs and other small interfering nucleic acids generally regulate gene expression via target RNA transcript cleavage/degradation or translational repression of the target messenger RNA (mRNA). miRNAs may, in some instances, be natively expressed, typically as final 19-25 non-translated RNA products. miRNAs generally exhibit their activity through sequence-specific interactions with the 3' untranslated regions (UTR) of target mRNAs. These endogenously expressed miRNAs may form hairpin precursors that are subsequently processed into an miRNA duplex, and further into a mature single stranded miRNA molecule. This mature miRNA generally guides a multiprotein complex, miRISC, which identifies target 3' UTR regions of target mRNAs based upon their complementarity to the mature miRNA. Useful transgene products may include, for example, miRNAs or miRNA binding sites that regulate the expression of a linked polypeptide. A non-limiting list of miRNA genes; the products of these genes and their homologues are useful as transgenes or as targets for small interfering nucleic acids (e.g., miRNA sponges, antisense oligonucleotides), e.g., in methods such as those listed in U.S. Ser. No. 10/300,146, 22:25-25:48, incorporated by reference. In some embodiments, one or more binding sites for one or more of the foregoing miRNAs are incorporated in a transgene, e.g., a transgene delivered by a rAAV vector, e.g., to inhibit the expression of the transgene in one or more tissues of an animal harboring the transgene. In some embodiments, a binding site may be selected to control the expression of a trangene in a tissue specific manner. For example, binding sites for the liver-specific miR-122 may be incorporated into a transgene to inhibit expression of that transgene in the liver. Additional exemplary miRNA sequences are described, for example, in U.S. patent Ser. No. 10/300,146 (incorporated herein by reference in its entirety). For liver-specific Gene Writing, however, overexpression of miR-122 may be utilized instead of using binding sites to effect miR-122-specific degradation. This miRNA is positively associated with hepatic differentiation and maturation, as well as enhanced expression of liver specific genes. Thus, in some embodiments, the coding sequence for miR-122 may be added to a component of a Gene Writing system to enhance a liver-directed therapy.

A miR inhibitor or miRNA inhibitor is generally an agent that blocks miRNA expression and/or processing. Examples of such agents include, but are not limited to, microRNA antagonists, microRNA specific antisense, microRNA sponges, and microRNA oligonucleotides (double-stranded, hairpin, short oligonucleotides) that inhibit miRNA interaction with a Drosha complex. MicroRNA inhibitors, e.g., miRNA sponges, can be expressed in cells from transgenes (e.g., as described in Ebert, M. S. Nature Methods, Epub Aug. 12, 2007; incorporated by reference herein in its entirety). In some embodiments, microRNA sponges, or other miR inhibitors, are used with the AAVs. microRNA sponges generally specifically inhibit miRNAs through a complementary heptameric seed sequence. In some embodiments, an entire family of miRNAs can be silenced using a single sponge sequence. Other methods for silencing miRNA function (derepression of miRNA targets) in cells will be apparent to one of ordinary skill in the art.

In some embodiments, a miRNA as described herein comprises a sequence listed in Table 4 of PCT Publication No. WO2020014209, incorporated herein by reference. Also incorporated herein by reference are the listing of exemplary miRNA sequences from WO2020014209.

In some embodiments, it is advantageous to silence one or more components of a Gene Writing system (e.g., mRNA encoding a Gene Writer polypeptide, a Gene Writer Template RNA, or a heterologous object sequence expressed from the genome after successful Gene Writing) in a portion of cells. In some embodiments, it is advantageous to restrict expression of a component of a Gene Writing system to select cell types within a tissue of interest.

For example, it is known that in a given tissue, e.g., liver, macrophages and immune cells, e.g., Kupffer cells in the liver, may engage in uptake of a delivery vehicle for one or more components of a Gene Writing system. In some embodiments, at least one binding site for at least one miRNA highly expressed in macrophages and immune cells, e.g., Kupffer cells, is included in at least one component of a Gene Writing system, e.g., nucleic acid encoding a Gene Writing polypeptide or a transgene. In some embodiments, a miRNA that targets the one or more binding sites is listed in a table referenced herein, e.g., miR-142, e.g., mature miRNA hsa-miR-142-5p or hsa-miR-142-3p.

In some embodiments, there may be a benefit to decreasing Gene Writer levels and/or Gene Writer activity in cells in which Gene Writer expression or overexpression of a transgene may have a toxic effect. For example, it has been shown that delivery of a transgene overexpression cassette to dorsal root ganglion neurons may result in toxicity of a gene therapy (see Hordeaux et al Sci Transl Med 12(569): eaba9188 (2020), incorporated herein by reference in its entirety). In some embodiments, at least one miRNA binding site may be incorporated into a nucleic acid component of a Gene Writing system to reduce expression of a system component in a neuron, e.g., a dorsal root ganglion neuron. In some embodiments, the at least one miRNA binding site incorporated into a nucleic acid component of a Gene Writing system to reduce expression of a system component in a neuron is a binding site of miR-182, e.g., mature miRNA hsa-miR-182-5p or hsa-miR-182-3p. In some embodiments, the at least one miRNA binding site incorporated into a nucleic acid component of a Gene Writing system to reduce expression of a system component in a neuron is a binding site of miR-183, e.g., mature miRNA hsa-miR-183-5p or hsa-miR-183-3p. In some embodiments, combinations of miRNA binding sites may be used to enhance the restriction of expression of one or more components of a Gene Writing system to a tissue or cell type of interest.

Table A5 below provides exemplary miRNAs and corresponding expressing cells, e.g., a miRNA for which one can, in some embodiments, incorporate binding sites (complementary sequences) in the transgene or polypeptide nucleic acid, e.g., to decrease expression in that off-target cell.

TABLE A5

Exemplary miRNA from off-target cells and tissues

| Silenced cell type | miRNA name | Mature miRNA | miRNA sequence | SEQ ID NO: |
|---|---|---|---|---|
| Kupffer cells | miR-142 | hsa-miR-142-5p | cauaaaguag aaagcacuac u | 2413 |
| Kupffer cells | miR-142 | hsa-miR-142-3p | uguaguguuu ccuacuuuau gga | 2414 |
| Dorsal root ganglion neurons | miR-182 | hsa-miR-182-5p | uuuggcaaug guagaacuca cacu | 2415 |

TABLE A5-continued

Exemplary miRNA from off-target cells and tissues

| Silenced cell type | miRNA name | Mature miRNA | miRNA sequence | SEQ ID NO: |
|---|---|---|---|---|
| Dorsal root ganglion neurons | miR-182 | hsa-miR-182-3p | ugguucuaga cuugccaacu a | 2416 |
| Dorsal root ganglion neurons | miR-183 | hsa-miR-183-5p | uauggcacug guagaauuca cu | 2417 |
| Table XDorsal root ganglion neurons | miR-183 | hsa-miR-183-3p | gugaauuacc gaagggccau aa | 2418 |
| Hepatocytes | miR-122 | hsa-miR-122-5p | uggaguguga caaugguguu ug | 2419 |
| Hepatocytes | miR-122 | hsa-miR-122-3p | aacgccauua ucacacuaaa ua | 2420 |

Anticrispr Systems for Regulating GeneWriter Activity

Various approaches for modulating Cas molecule activity may be used in conjunction with the systems and methods described herein. For instance, in some embodiments, a polypeptide described herein (e.g., a Cas molecule or a GeneWriter comprising a Cas domain) can be regulated using an anticrispr agent (e.g., an anticrispr protein or anticrispr small molecule). In some embodiments, the Cas molecule or Cas domain comprises a responsive intein such as, for example, a 4-hydroxytamoxifen (4-HT)-responsive intein, an iCas molecule (e.g., iCas9); a 4-HT-responsive Cas (e.g., allosterically regulated Cas9 (arC9) or dead Cas9 (dC9)). The systems and methods described herein can also utilize a chemically-induced dimerization system of split protein fragments (e.g., rapamycin-mediated dimerization of FK506 binding protein 12 (FKBP) and FKBP rapamycin binding domain (FRB)), an abscisic acid-inducible ABI-PYL1 and gibberellin-inducible GID1-GAI heterodimerization domains); a dimer of BCL-xL peptide and BH3 peptides, a A385358 (A3) small molecule, a degron system (e.g., a FKBP-Cas9 destabilized system, an auxin-inducible degron (AID) or an E. coli DHFR degron system), an aptamer or aptazyme fused with gRNA (e.g., tetracycline- and theophylline-responsive bioswitches), AcrIIA2 and AcrIIA4 proteins, and BRD0539.

In some embodiments, a small molecule-responsive intein (e.g., 4-hydroxytamoxifen (4-HT)-responsive intein) is inserted at specific sites within a Cas molecule (e.g., Cas9). In some embodiments, the insertion of a 4HT-responsive intein disrupts Cas9 enzymatic activity. In some embodiments, a Cas molecule (e.g., iCas9) is fused to the hormone binding domain of the estrogen receptor (ERT2). In some embodiments, the ligand binding domain of the human estrogen receptor-α can be inserted into a Cas molecule (e.g., Cas9 or dead Cas9 (dC9)), e.g., at position 231, yielding a 4HT-responsive anticrispr Cas9 (e.g., arC9 or dC9). In some embodiments, dCas9 can provide 4-HT dose-dependent repression of Cas9 function. In some embodiments, arC9 can provide 4-HT dose-dependent control of Cas9 function. In some embodiments, a Cas molecule (e.g., Cas9) is fused to split protein fragments. In some embodiments, chemically-induced dimerization of split protein fragments (e.g., rapamycin-mediated dimerization of FK506 binding protein 12 (FKBP) and FKBP rapamycin binding domain (FRB)) can induce low levels of Cas9 molecule activity. In some embodiments, a chemically-induced dimerization system (e.g., abscisic acid-inducible ABI-PYL1 and gibberellin-inducible GID1-GAI heterodimerization domains) can induce a dose-dependent and reversible transcriptional activation/repression of Cas9. In some embodiments, a Cas9 inducible system (ciCas9) comprises the replacement of a Cas molecule (e.g., Cas9) REC2 domain with a BCL-xl peptide and attachment of a BH3 peptide to the N- and C-termini of the modified Cas9.BCL. In some embodiments, the interaction between BCL-xL and BH3 peptides can keep Cas9 in an inactive state. In some embodiments, a small molecule (e.g., A-385358 (A3)) can disrupt the interaction between BLC-xl and BH3 peptides to activate Cas9. In some embodiments, a Cas9 inducible system can exhibit dose-dependent control of nuclease activity. In some embodiments, a degron system can induce degradation of a Cas molecule (e.g., Cas9) upon activation or deactivation by an external factor (e.g., small-molecule ligand, light, temperature, or a protein). In some embodiments, a small molecule BRD0539 inhibits a Cas molecule (e.g., Cas9) reversibly. Additional information on anticrispr proteins or anticrispr small molecules can be found, for example, in Gangopadhyay, S. A. et al. Precision control of CRISPR-Cas9 using small molecules and light, Biochemistry, 2019, Maji, B. et al. A high-throughput platform to identify small molecule inhibitors of CRISPR-Cas9, and Pawluk AntiCRISPR: discovery, mechanism and function Nature Reviews Microbiology volume 16, pages 12-17 (2018), each of which is incorporated by reference in its entirety.

Self-Inactivating Modules for Regulating GeneWriter Activity

In some embodiments the Gene Writer systems described herein includes a self-inactivating module. The self-inactivating module leads to a decrease of expression of the Gene Writer polypeptide, the Gene Writer template, or both. Without wishing to be bound by the theory, the self-inactivating module provides for a temporary period of Gene Writer expression prior to inactivation. Without wishing to be bound by theory, the activity of the Gene Writer polypeptide at a target site introduces a mutation (e.g. a substitution, insertion, or deletion) into the DNA encoding the Gene Writer polypeptide or Gene Writer template which results in a decrease of Gene Writer polypeptide or template expression. In some embodiments of the self-inactivating module, a target site for the Gene Writer polypeptide is included in the DNA encoding the Gene Writer polypeptide or Gene Writer template. In some embodiments, one, two, three, four, five, or more copies of the target site are included in the DNA encoding the Gene Writer polypeptide or Gene Writer template. In some embodiments, the target site in the DNA encoding the Gene Writer polypeptide or Gene Writer template is the same target site as the target site on the genome. In some embodiments, the target site is a different target site than the target site on the genome. In some embodiments, the self-inactivation module target site uses the same or a different template RNA or guide RNA as the genome target site. In some embodiments, the target site is modified via target primed reverse transcription based upon a template RNA. In some embodiments the target side is nicked. The target site may be incorporated into an enhancer, a promoter, an untranslated region, an exon, an intron, an open reading frame, or a stuffer sequence.

In some embodiments, upon inactivation, the decrease of expression is 25%, 50%, 60%, 70%, 80%, 90%, 95%, 99%, 99.9%, or more lower than a Gene Writing system that does not contain the self-inactivating module. In some embodiments, a Gene Writer system that contains the self-inactivating module has a 5%, 10%, 15%, 20%, 25%, 30%, 40%, 50%, 60%, 70%, 80%, 90%, 95% 99%, or higher rate of integrations in target sites than off-target sites compared to a Gene Writing system that does not contain the self-inactivation module. a Gene Writer system that contains the self-inactivating module has a 10%, 15%, 20%, 25%, 30%, 40%, 50%, 60%, 70%, 80%, 90%, 95% 99%, or higher efficiency of target site modification compared to a Gene Writing system that does not contain the self-inactivation module. In some embodiments, the self-inactivating module is included when the Gene Writer polypeptide is delivered as DNA, e.g. via a viral vector.

Self-inactivating modules have been described for nucleases. See, e.g. in Li et al A Self-Deleting AAV-CRISPR System for In Vivo Genome Editing, Mol Ther Methods Clin Dev. 2019 Mar. 15; 12: 111-122, P. Singhal, Self-Inactivating Cas9: a method for reducing exposure while maintaining efficacy in virally delivered Cas9 applications (available at editasmedicine.com/wp-content/uploads/2019/10/aef_asgct_poster_2017_final_-_present_5-11-17_515pm1_1494537387_1494558495_1497467403.pdf), and Epstein and Schaffer Engineering a Self-Inactivating CRISPR System for AAV Vectors Targeted Genome Editing I|Volume 24, SUPPLEMENT 1, S50, May 1, 2016, and WO2018106693A1.

Small Molecules

In some embodiments a polypeptide described herein (e.g., a Gene Writer polypeptide) is controllable via a small molecule. In some embodiments the polypeptide is dimerized via a small molecule.

In some embodiment, the polypeptide is controllable via Chemical Induction of Dimerization (CID) with small molecules. CID is generally used to generate switches of protein function to alter cell physiology. An exemplary high specificity, efficient dimerizer is rimiducid (AP1903), which has two identical, protein-binding surfaces arranged tail-to-tail, each with high affinity and specificity for a mutant of FKBP12: FKBP12(F36V) (FKBP12v36, $F_{v36}$ or $F_v$). Attachment of one or more Fv domains onto one or more cell signaling molecules that normally rely on homodimerization can convert that protein to rimiducid control. Homodimerization with rimiducid is used in the context of an inducible caspase safety switch. This molecular switch that is controlled by a distinct dimerizer ligand, based on the heterodimerizing small molecule, rapamycin, or rapamycin analogs ("rapalogs"). Rapamycin binds to FKBP12, and its variants, and can induce heterodimerization of signaling domains that are fused to FKBP12 by binding to both FKBP12 and to polypeptides that contain the FKBP-rapamycin-binding (FRB) domain of mTOR. Provided in some embodiments of the present application are molecular switches that greatly augment the use of rapamycin, rapalogs and rimiducid as agents for therapeutic applications.

In some embodiments of the dual switch technology, a homodimerizer, such as AP1903 (rimiducid), directly induces dimerization or multimerization of polypeptides comprising an FKBP12 multimerizing region. In other embodiments, a polypeptide comprising an FKBP12 multimerization is multimerized, or aggregated by binding to a heterodimerizer, such as rapamycin or a rapalog, which also binds to an FRB or FRB variant multimerizing region on a chimeric polypeptide, also expressed in the modified cell, such as, for example, a chimeric antigen receptor. Rapamycin is a natural product macrolide that binds with high affinity (<1 nM) to FKBP12 and together initiates the high-affinity, inhibitory interaction with the FKBP-Rapamycin-Binding (FRB) domain of mTOR. FRB is small (89 amino acids) and can thereby be used as a protein "tag" or "handle" when appended to many proteins. Coexpression of a FRB-fused protein with a FKBP12-fused protein renders their approximation rapamycin-inducible (12-16). This can serve as the basis for a cell safety switch regulated by the orally available ligand, rapamycin, or derivatives of rapamycin (rapalogs) that do not inhibit mTOR at a low, therapeutic dose but instead bind with selected, Caspase-9-fused mutant FRB domains. (see Sabatini D M, et al., Cell. 1994; 78(1): 35-43; Brown E J, et al., Nature. 1994; 369(6483):756-8; Chen J, et al., Proc Natl Acad Sci USA. 1995; 92(11):4947-51; and Choi J, Science. 1996; 273(5272):239-42).

In some embodiments, two levels of control are provided in the therapeutic cells. In embodiments, the first level of control may be tunable, i.e., the level of removal of the therapeutic cells may be controlled so that it results in partial removal of the therapeutic cells. In some embodiments, the chimeric antigen polypeptide comprises a binding site for rapamycin, or a rapamycin analog. In embodiments, also present in the therapeutic cell is a suicide gene, such as, for example, one encoding a caspase polypeptide. Using this controllable first level, the need for continued therapy may, in some embodiments, be balanced with the need to eliminate or reduce the level of negative side effects. In some embodiments, a rapamycin analog, a rapalog is administered to the patient, which then binds to both the caspase polypeptide and the chimeric antigen receptor, thus recruiting the caspase polypeptide to the location of the CAR, and aggregating the caspase polypeptide. Upon aggregation, the caspase polypeptide induces apoptosis. The amount of rapamycin or rapamycin analog administered to the patient may vary; if the removal of a lower level of cells by apoptosis is desired in order to reduce side effects and continue CAR therapy, a lower level of rapamycin or rapamycin may be administered to the patient. In some embodiments, the second level of control may be designed to achieve the maximum level of cell elimination. This second level may be based, for example, on the use of rimiducid, or AP1903. If there is a need to rapidly eliminate up to 100% of the therapeutic cells, the AP1903 may be administered to the patient. The multimeric AP1903 binds to the caspase polypeptide, leading to multimerization of the caspase polypeptide and apoptosis. In certain examples, second level may also be tunable, or controlled, by the level of AP1903 administered to the subject.

In certain embodiments, small molecules can be used to control genes, as described in for example, U.S. Ser. No. 10/584,351 at 47:53-56:47 (incorporated by reference herein in its entirety), together suitable ligands for the control features, e.g., in U.S. Ser. No. 10/584,351 at 56:48, et seq. as well as U10046049 at 43:27-52:20, incorporated by reference as well as the description of ligands for such control systems at 52:21, et seq.

Chemically Modified Nucleic Acids and Nucleic Acid End Features

A nucleic acid described herein (e.g., a template nucleic acid, e.g., a template RNA; or a nucleic acid (e.g., mRNA) encoding a GeneWriter) can comprise unmodified or modified nucleobases. Naturally occurring RNAs are synthesized from four basic ribonucleotides: ATP, CTP, UTP and GTP, but may contain post-transcriptionally modified nucleotides. Further, approximately one hundred different nucleoside modifications have been identified in RNA (Rozenski, J, Crain, P, and McCloskey, J. (1999). The RNA Modification Database: 1999 update. Nucl Acids Res 27: 196-197). An RNA can also comprise wholly synthetic nucleotides that do not occur in nature.

In some embodiments, the chemically modification is one provided in PCT/US2016/032454, US Pat. Pub. No. 20090286852, of International Application No. WO/2012/019168, WO/2012/045075, WO/2012/135805, WO/2012/158736, WO/2013/039857, WO/2013/039861, WO/2013/052523, WO/2013/090648, WO/2013/096709, WO/2013/101690, WO/2013/106496, WO/2013/130161, WO/2013/151669, WO/2013/151736, WO/2013/151672, WO/2013/151664, WO/2013/151665, WO/2013/151668, WO/2013/151671, WO/2013/151667, WO/2013/151670, WO/2013/151666, WO/2013/151663, WO/2014/028429, WO/2014/081507, WO/2014/093924, WO/2014/093574, WO/2014/113089, WO/2014/144711, WO/2014/144767, WO/2014/144039, WO/2014/152540, WO/2014/152030, WO/2014/152031, WO/2014/152027, WO/2014/152211, WO/2014/158795, WO/2014/159813, WO/2014/164253, WO/2015/006747, WO/2015/034928, WO/2015/034925, WO/2015/038892, WO/2015/048744, WO/2015/051214, WO/2015/051173, WO/2015/051169, WO/2015/058069, WO/2015/085318, WO/2015/089511, WO/2015/105926, WO/2015/164674, WO/2015/196130, WO/2015/196128, WO/2015/196118, WO/2016/011226, WO/2016/011222, WO/2016/011306, WO/2016/014846, WO/2016/022914, WO/2016/036902, WO/2016/077125, or WO/2016/077123, each of which is herein incorporated by reference in its entirety. It is understood that incorporation of a chemically modified nucleotide into a polynucleotide can result in the modification being incorporated into a nucleobase, the backbone, or both, depending on the location of the modification in the nucleotide. In some embodiments, the backbone modification is one provided in EP 2813570, which is herein incorporated by reference in its entirety. In some embodiments, the modified cap is one provided in US Pat. Pub. No. 20050287539, which is herein incorporated by reference in its entirety.

In some embodiments, the chemically modified nucleic acid (e.g., RNA, e.g., mRNA) comprises one or more of ARCA: anti-reverse cap analog (m27.3'-OGP3G), GP3G (Unmethylated Cap Analog), m7GP3G (Monomethylated Cap Analog), m32.2.7GP3G (Trimethylated Cap Analog), m5CTP (5'-methyl-cytidine triphosphate), m6ATP (N6-methyl-adenosine-5'-triphosphate), s2UTP (2-thio-uridine triphosphate), and Ψ (pseudouridine triphosphate).

In some embodiments, the chemically modified nucleic acid comprises a 5' cap, e.g.: a 7-methylguanosine cap (e.g., a O-Me-m7G cap); a hypermethylated cap analog; an NAD+-derived cap analog (e.g., as described in Kiledjian, Trends in Cell Biology 28, 454-464 (2018)); or a modified, e.g., biotinylated, cap analog (e.g., as described in Bednarek et al., Phil Trans R Soc B 373, 20180167 (2018)).

In some embodiments, the chemically modified nucleic acid comprises a 3' feature selected from one or more of: a polyA tail; a 16-nucleotide long stem-loop structure flanked by unpaired 5 nucleotides (e.g., as described by Mannironi et al., Nucleic Acid Research 17, 9113-9126 (1989)); a triple-helical structure (e.g., as described by Brown et al., PNAS 109, 19202-19207 (2012)); a tRNA, Y RNA, or vault RNA structure (e.g., as described by Labno et al., Biochemica et Biophysica Acta 1863, 3125-3147 (2016)); incorporation of one or more deoxyribonucleotide triphosphates (dNTPs), 2'O-Methylated NTPs, or phosphorothioate-NTPs; a single nucleotide chemical modification (e.g., oxidation of the 3' terminal ribose to a reactive aldehyde followed by conjugation of the aldehyde-reactive modified nucleotide); or chemical ligation to another nucleic acid molecule.

In some embodiments, the nucleic acid (e.g., template nucleic acid) comprises one or more modified nucleotides, e.g., selected from dihydrouridine, inosine, 7-methylguanosine, 5-methylcytidine (5mC), 5' Phosphate ribothymidine, 2'-O-methyl ribothymidine, 2'-O-ethyl ribothymidine, 2'-fluoro ribothymidine, C-5 propynyl-deoxycytidine (pdC), C-5 propynyl-deoxyuridine (pdU), C-5 propynyl-cytidine (pC), C-5 propynyl-uridine (pU), 5-methyl cytidine, 5-methyl uridine, 5-methyl deoxycytidine, 5-methyl deoxyuridine methoxy, 2,6-diaminopurine, 5'-Dimethoxytrityl-N4-ethyl-2'-deoxycytidine, C-5 propynyl-f-cytidine (pfC), C-5 propynyl-f-uridine (pfU), 5-methyl f-cytidine, 5-methyl f-uridine, C-5 propynyl-m-cytidine (pmC), C-5 propynyl-f-uridine (pmU), 5-methyl m-cytidine, 5-methyl m-uridine, LNA (locked nucleic acid), MGB (minor groove binder) pseudouridine (Ψ), 1-N-methylpseudouridine (1-Me-Ψ), or 5-methoxyuridine (5-MO-U).

In some embodiments, the nucleic acid comprises a backbone modification, e.g., a modification to a sugar or phosphate group in the backbone. In some embodiments, the nucleic acid comprises a nucleobase modification.

In some embodiments, the nucleic acid comprises one or more chemically modified nucleotides of Table M1, one or more chemical backbone modifications of Table M2, one or more chemically modified caps of Table M3. For instance, in some embodiments, the nucleic acid comprises two or more (e.g., 3, 4, 5, 6, 7, 8, 9, or 10 or more) different types of chemical modifications. As an example, the nucleic acid may comprise two or more (e.g., 3, 4, 5, 6, 7, 8, 9, or 10 or more) different types of modified nucleobases, e.g., as described herein, e.g., in Table M1. Alternatively or in combination, the nucleic acid may comprise two or more (e.g., 3, 4, 5, 6, 7, 8, 9, or 10 or more) different types of backbone modifications, e.g., as described herein, e.g., in Table M2. Alternatively or in combination, the nucleic acid may comprise one or more modified cap, e.g., as described herein, e.g., in Table M3. For instance, in some embodiments, the nucleic acid comprises one or more type of modified nucleobase and one or more type of backbone modification; one or more type of modified nucleobase and one or more modified cap; one or more type of modified cap and one or more type of backbone modification; or one or more type of modified nucleobase, one or more type of backbone modification, and one or more type of modified cap.

In some embodiments, the nucleic acid comprises one or more (e.g., 2, 3, 4, 5, 6, 7, 8, 9, 10, 20, 30, 40, 50, 60, 70, 80, 90, 100, 150, 200, 250, 300, 350, 400, 450, 500, 600, 700, 800, 900, 1000, or more) modified nucleobases. In some embodiments, all nucleobases of the nucleic acid are modified. In some embodiments, the nucleic acid is modified at one or more (e.g., 2, 3, 4, 5, 6, 7, 8, 9, 10, 20, 30, 40, 50, 60, 70, 80, 90, 100, 150, 200, 250, 300, 350, 400, 450, 500, 600, 700, 800, 900, 1000, or more) positions in the backbone. In some embodiments, all backbone positions of the nucleic acid are modified.

TABLE M1

| Modified nucleotides | |
|---|---|
| 5-aza-uridine | N2-methyl-6-thio-guanosine |
| 2-thio-5-aza-midine | N2,N2-dimethyl-6-thio-guanosine |
| 2-thiouridine | pyridin-4-one ribonucleoside |
| 4-thio-pseudouridine | 2-thio-5-aza-uridine |
| 2-thio-pseudouridine | 2-thiomidine |
| 5-hydroxyuridine | 4-thio-pseudomidine |
| 3-methyluridine | 2-thio-pseudowidine |
| 5-carboxymethyl-uridine | 3-methylmidine |
| 1-carboxymethyl-pseudouridine | 1-propynyl-pseudomidine |
| 5-propynyl-uridine | 1-methyl-1-deaza-pseudomidine |
| 1-propynyl-pseudouridine | 2-thio-1-methyl-1-deaza-pseudouridine |
| 5-taurinomethyluridine | 4-methoxy-pseudomidine |
| 1-taurinomethyl-pseudouridine | 5'-O-(1-Thiophosphate)-Adenosine |
| 5-taurinomethyl-2-thio-uridine | 5'-O-(1-Thiophosphate)-Cytidine |
| 1-taurinomethyl-4-thio-uridine | 5'-O-(1-thiophosphate)-Guanosine |
| 5-methyl-uridine | 5'-O-(1-Thiophophate)-Uridine |
| 1-methyl-pseudouridine | 5'-O-(1-Thiophosphate)-Pseudouridine |
| 4-thio-1-methyl-pseudouridine | 2'-O-methyl-Adenosine |
| 2-thio-1-methyl-pseudouridine | 2'-O-methyl-Cytidine |
| 1-methyl-1-deaza-pseudouridine | 2'-O-methyl-Guanosine |
| 2-thio-1-methyl-1-deaza-pseudomidine | 2'-O-methyl-Uridine |
| dihydrouridine | 2'-O-methyl-Pseudouridine |
| dihydropseudouridine | 2'-O-methyl-Inosine |
| 2-thio-dihydromidine | 2-methyladenosine |
| 2-thio-dihydropseudouridine | 2-methylthio-N6-methyladenosine |
| 2-methoxyuridine | 2-methylthio-N6 isopentenyladenosine |
| 2-methoxy-4-thio-uridine | 2-methylthio-N6-(cis- |
| 4-methoxy-pseudouridine | hydroxyisopentenyl)adenosine |
| 4-methoxy-2-thio-pseudouridine | N6-methyl-N6-threonylcarbamoyladenosine |
| 5-aza-cytidine | N6-hydroxynorvalylcarbamoyladenosine |
| pseudoisocytidine | 2-methylthio-N6-hydroxynorvalyl |
| 3-methyl-cytidine | carbamoyladenosine |
| N4-acetylcytidine | 2'-O-ribosyladenosine (phosphate) |
| 5-formylcytidine | 1,2'-O-dimethylinosine |
| N4-methylcytidine | 5,2'-O-dimethylcytidine |
| 5-hydroxymethylcytidine | N4-acetyl-2'-O-methylcytidine |
| 1-methyl-pseudoisocytidine | Lysidine |
| pyrrolo-cytidine | 7-methylguanosine |
| pyrrolo-pseudoisocytidine | N2,2'-O-dimethylguanosine |
| 2-thio-cytidine | N2,N2,2'-O-trimethylguanosine |
| 2-thio-5-methyl-cytidine | 2'-O-ribosylguanosine (phosphate) |
| 4-thio-pseudoisocytidine | Wybutosine |
| 4-thio-1-methyl-pseudoisocytidine | Peroxywybutosine |
| 4-thio-1-methyl-1-deaza-pseudoisocytidine | Hydroxywybutosine |
| 1-methyl-1-deaza-pseudoisocytidine | undermodified hydroxywybutosine |
| zebularine | methylwyosine |
| 5-aza-zebularine | queuosine |
| 5-methyl-zebularine | epoxyqueuosine |
| 5-aza-2-thio-zebularine | galactosyl-queuosine |
| 2-thio-zebularine | mannosyl-queuosine |
| 2-methoxy-cytidine | 7-cyano-7-deazaguanosine |
| 2-methoxy-5-methyl-cytidine | 7-aminomethyl-7-deazaguanosine |
| 4-methoxy-pseudoisocytidine | archaeosine |
| 4-methoxy-1-methyl-pseudoisocytidine | 5,2'-O-dimethyluridine |
| 2-aminopurine | 4-thiouridine |
| 2,6-diaminopurine | 5-methyl-2-thiouridine |
| 7-deaza-adenine | 2-thio-2'-O-methyluridine |
| 7-deaza-8-aza-adenine | 3-(3-amino-3-carboxypropyl)uridine |
| 7-deaza-2-aminopurine | 5-methoxyuridine |
| 7-deaza-8-aza-2-aminopurine | uridine 5-oxyacetic acid |
| 7-deaza-2,6-diaminopurine | uridine 5-oxyacetic acid methyl ester |
| 7-deaza-8-aza-2,6-diarninopurine | 5-(carboxyhydroxymethyl)uridine) |
| 1-methyladenosine | 5-(carboxyhydroxymethyl)uridine methyl ester |
| N6-isopentenyladenosine | 5-methoxycarbonylmethyluridine |
| N6-(cis-hydroxyisopentenyl)adenosine | 5-methoxycarbonylmethyl-2'-O-methyluridine |
| 2-methylthio-N6-(cis-hydroxyisopentenyl) adenosine | 5-methoxycarbonylmethyl-2-thiouridine |
| | 5-aminomethyl-2-thiouridine |
| N6-glycinylcarbamoyladenosine | 5-methylaminomethyluridine |
| N6-threonylcarbamoyladenosine | 5-methylaminomethyl-2-thiouridine |
| 2-methylthio-N6-threonyl carbamoyladenosine | 5-methylaminomethyl-2-selenouridine |
| | 5-carbamoylmethyluridine |
| N6,N6-dimethyladenosine | 5-carbamoylmethyl-2'-O-methyluridine |
| 7-methyladenine | 5-carboxymethylaminomethyluridine |
| 2-methylthio-adenine | 5-carboxymethylaminomethyl-2'-O-methyluridine |
| 2-methoxy-adenine | |
| inosine | 5-carboxymethylaminomethyl-2-thiouridine |
| 1-methyl-inosine | N4,2'-O-dimethylcytidine |
| wyosine | 5-carboxymethyluridine |

TABLE M1-continued

| Modified nucleotides | |
|---|---|
| wybutosine | N6,2'-O-dimethyladenosine |
| 7-deaza-guanosine | N,N6,O-2'-trimethyladenosine |
| 7-deaza-8-aza-guanosine | N2,7-dimethylguanosine |
| 6-thio-guanosine | N2,N2,7-trimethylguanosine |
| 6-thio-7-deaza-guanosine | 3,2'-O-dimethyluridine |
| 6-thio-7-deaza-8-aza-guanosine | 5-methyldihydrouridine |
| 7-methyl-guanosine | 5-formyl-2'-O-methylcytidine |
| 6-thio-7-methyl-guanosine | 1,2'-O-dimethylguanosine |
| 7-methylinosine | 4-demethylwyosine |
| 6-methoxy-guanosine | Isowyosine |
| 1-methylguanosine | N6-acetyladenosine |
| N2-methylguanosine | |
| N2,N2-dimethylguanosine | |
| 8-oxo-guanosine | |
| 7-methyl-8-oxo-guanosine | |
| 1-methyl-6-thio-guanosine | |

TABLE M2

| Backbone modifications |
|---|
| 2'-O-Methyl backbone |
| Peptide Nucleic Acid (PNA) backbone |
| phosphorothioate backbone |
| morpholino backbone |
| carbamate backbone |
| siloxane backbone |
| sulfide backbone |
| sulfoxide backbone |
| sulfone backbone |
| formacetyl backbone |
| thioformacetyl backbone |
| methyleneformacetyl backbone |
| riboacetyl backbone |
| alkene containing backbone |
| sulfamate backbone |
| sulfonate backbone |
| sulfonamide backbone |
| methyleneimino backbone |
| methylenehydrazino backbone |
| amide backbone |

TABLE M3

| Modified caps |
|---|
| m7GpppA |
| m7GpppC |
| m2,7GpppG |
| m2,2,7GpppG |
| m7Gpppm7G |
| m7,2'OmeGpppG |
| m72'dGpppG |
| m7,3'OmeGpppG |
| m7,3'dGpppG |
| GppppG |
| m7GppppG |
| m7GppppA |
| m7GppppC |
| m2,7GppppG |
| m2,2,7GppppG |
| m7Gppppm7G |
| m7,2'OmeGppppG |
| m72'dGppppG |
| m7,3'OmeGppppG |
| m7,3'dGppppG |

Production of Compositions and Systems

Methods of designing and constructing nucleic acid constructs and proteins or polypeptides (such as the systems, constructs and polypeptides described herein) are known. Generally, recombinant methods may be used. See, in general, Smales & James (Eds.), *Therapeutic Proteins: Methods and Protocols* (Methods in Molecular Biology), Humana Press (2005); and Crommelin, Sindelar & Meibohm (Eds.), *Pharmaceutical Biotechnology: Fundamentals and Applications*, Springer (2013). Methods of designing, preparing, evaluating, purifying and manipulating nucleic acid compositions are described in Green and Sambrook (Eds.), *Molecular Cloning: A Laboratory Manual* (Fourth Edition), Cold Spring Harbor Laboratory Press (2012).

The disclosure provides, in part, a nucleic acid, e.g., vector, encoding a Gene Writer polypeptide described herein, a template nucleic acid described herein, or both. In some embodiments, a vector comprises a selective marker, e.g., an antibiotic resistance marker. In some embodiments, the antibiotic resistance marker is a kanamycin resistance marker. In some embodiments, the antibiotic resistance marker does not confer resistance to beta-lactam antibiotics. In some embodiments, the vector does not comprise an ampicillin resistance marker. In some embodiments, the vector comprises a kanamycin resistance marker and does not comprise an ampicillin resistance marker. In some embodiments, a vector encoding a Gene Writer polypeptide is integrated into a target cell genome (e.g., upon administration to a target cell, tissue, organ, or subject). In some embodiments, a vector encoding a Gene Writer polypeptide is not integrated into a target cell genome (e.g., upon administration to a target cell, tissue, organ, or subject). In some embodiments, a vector encoding a template nucleic acid (e.g., template RNA) is not integrated into a target cell genome (e.g., upon administration to a target cell, tissue, organ, or subject). In some embodiments, if a vector is integrated into a target site in a target cell genome, the selective marker is not integrated into the genome. In some embodiments, if a vector is integrated into a target site in a target cell genome, genes or sequences involved in vector maintenance (e.g., plasmid maintenance genes) are not integrated into the genome. In some embodiments, if a vector is integrated into a target site in a target cell genome, transfer regulating sequences (e.g., inverted terminal repeats, e.g., from an AAV) are not integrated into the genome. In some embodiments, administration of a vector (e.g., encoding a Gene Writer polypeptide described herein, a template nucleic acid described herein, or both) to a target cell, tissue, organ, or subject results in integration of a portion of the vector into one or more target sites in the genome(s) of said target cell, tissue, organ, or subject. In some embodiments, less than 99, 95, 90, 80, 70, 60, 50, 40, 30, 20, 10, 5, 4, 3, 2, or 1% of target sites (e.g., no target sites) comprising integrated material comprise a selective marker (e.g., an antibiotic resistance gene), a transfer regulating sequence (e.g., an inverted terminal repeat, e.g., from an AAV), or both from the vector.

Exemplary methods for producing a therapeutic pharmaceutical protein or polypeptide described herein involve expression in mammalian cells, although recombinant proteins can also be produced using insect cells, yeast, bacteria, or other cells under control of appropriate promoters. Mammalian expression vectors may comprise non-transcribed elements such as an origin of replication, a suitable promoter, and other 5' or 3' flanking non-transcribed sequences, and 5' or 3' non-translated sequences such as necessary ribosome binding sites, a polyadenylation site, splice donor and acceptor sites, and termination sequences. DNA sequences derived from the SV40 viral genome, for example, SV40 origin, early promoter, splice, and polyadenylation sites may be used to provide other genetic elements required for expression of a heterologous DNA sequence. Appropriate cloning and expression vectors for use with bacterial, fungal, yeast, and mammalian cellular hosts are described in Green & Sambrook, *Molecular Cloning: A Laboratory Manual* (Fourth Edition), Cold Spring Harbor Laboratory Press (2012).

Various mammalian cell culture systems can be employed to express and manufacture recombinant protein. Examples of mammalian expression systems include CHO, COS, HEK293, HeLA, and BHK cell lines. Processes of host cell culture for production of protein therapeutics are described in Zhou and Kantardjieff (Eds.), *Mammalian Cell Cultures for Biologics Manufacturing* (*Advances in Biochemical Engineering/Biotechnology*), Springer (2014). Compositions described herein may include a vector, such as a viral vector, e.g., a lentiviral vector, encoding a recombinant protein. In some embodiments, a vector, e.g., a viral vector, may comprise a nucleic acid encoding a recombinant protein.

Purification of protein therapeutics is described in Franks, Protein Biotechnology: *Isolation, Characterization, and Stabilization*, Humana Press (2013); and in Cutler, *Protein Purification Protocols* (*Methods in Molecular Biology*), Humana Press (2010).

In some embodiments, quality standards include, but are not limited to:
  (i) the length of mRNA encoding the GeneWriter polypeptide, e.g., whether the mRNA has a length that is above a reference length or within a reference length range, e.g., whether at least 80, 85, 90, 95, 96, 97, 98, or 99% of the mRNA present is greater than 3000, 4000, or 5000 nucleotides long;
  (ii) the presence, absence, and/or length of a polyA tail on the mRNA, e.g., whether at least 80, 85, 90, 95, 96, 97, 98, or 99% of the mRNA present contains a polyA tail (e.g., a polyA tail that is at least 5, 10, 20, 30, 50, 70, 100 nucleotides in length (SEQ ID NO: 3376));
  (iii) the presence, absence, and/or type of a 5' cap on the mRNA, e.g., whether at least 80, 85, 90, 95, 96, 97, 98, or 99% of the mRNA present contains a 5' cap, e.g., whether that cap is a 7-methylguanosine cap, e.g., a O-Mc-m7G cap;
  (iv) the presence, absence, and/or type of one or more modified nucleotides (e.g., selected from pseudouridine, dihydrouridinc, inosine, 7-methylguanosine, 1-N-methylpseudouridine (1-Me-Ψ), 5-methoxyuridine (5-MO-U), 5-methylcytidine (5mC), or a locked nucleotide) in the mRNA, e.g., whether at least 80, 85, 90, 95, 96, 97, 98, or 99% of the mRNA present contains one or more modified nucleotides;
  (v) the stability of the mRNA (e.g., over time and/or under a pre-selected condition), e.g., whether at least 80, 85, 90, 95, 96, 97, 98, or 99% of the mRNA remains intact (e.g., greater than 100, 125, 150, 175, or 200 nucleotides long) after a stability test; or
  (vi) the potency of the mRNA in a system for modifying DNA, e.g., whether at least 1% of target sites are modified after a system comprising the mRNA is assayed for potency.

Kits, Articles of Manufacture, and Pharmaceutical Compositions

In an aspect the disclosure provides a kit comprising a Gene Writer or a Gene Writing system, e.g., as described herein. In some embodiments, the kit comprises a Gene Writer polypeptide (or a nucleic acid encoding the polypeptide) and a template RNA (or DNA encoding the template RNA). In some embodiments, the kit further comprises a reagent for introducing the system into a cell, e.g., transfection reagent, LNP, and the like. In some embodiments, the kit is suitable for any of the methods described herein. In some embodiments, the kit comprises one or more elements, compositions (e.g., pharmaceutical compositions), Gene Writers, and/or Gene Writer systems, or a functional fragment or component thereof, e.g., disposed in an article of manufacture. In some embodiments, the kit comprises instructions for use thereof.

In an aspect, the disclosure provides an article of manufacture, e.g., in which a kit as described herein, or a component thereof, is disposed.

In an aspect, the disclosure provides a pharmaceutical composition comprising a Gene Writer or a Gene Writing system, e.g., as described herein. In some embodiments, the pharmaceutical composition further comprises a pharmaceutically acceptable carrier or excipient. In some embodiments, the pharmaceutical composition comprises a template RNA and/or an RNA encoding the polypeptide. In embodiments, the pharmaceutical composition has one or more (e.g., 1, 2, 3, or 4) of the following characteristics:
  (a) less than 1% (e.g., less than 0.5%, 0.4%, 0.3%, 0.2%, or 0.1%) DNA template relative to the template RNA and/or the RNA encoding the polypeptide, e.g., on a molar basis;
  (b) less than 1% (e.g., less than 0.5%, 0.4%, 0.3%, 0.2%, or 0.1%) uncapped RNA relative to the template RNA and/or the RNA encoding the polypeptide, e.g., on a molar basis;
  (c) less than 1% (e.g., less than 0.5%, 0.4%, 0.3%, 0.2%, or 0.1%) partial length RNAs relative to the template RNA and/or the RNA encoding the polypeptide, e.g., on a molar basis;
  (d) substantially lacks unreacted cap dinucleotides.

Chemistry, Manufacturing, and Controls (CMC)

Purification of protein therapeutics is described, for example, in Franks, Protein Biotechnology: *Isolation, Characterization, and Stabilization*, Humana Press (2013); and in Cutler, *Protein Purification Protocols* (*Methods in Molecular Biology*), Humana Press (2010).

In some embodiments, a Gene Writer™ system, polypeptide, and/or template nucleic acid (e.g., template RNA) conforms to certain quality standards. In some embodiments, a Gene Writer™ system, polypeptide, and/or template nucleic acid (e.g., template RNA) produced by a method described herein conforms to certain quality standards. Accordingly, the disclosure is directed, in some aspects, to methods of manufacturing a Gene Writer™ system, polypeptide, and/or template nucleic acid (e.g., template RNA) that conforms to certain quality standards, e.g., in which said quality standards are assayed. The disclosure is also directed, in some aspects, to methods of assaying said quality standards in a Gene Writer™ system, polypeptide, and/or template nucleic acid (e.g., template RNA). In some embodiments, quality standards include, but are not limited to, one or more (e.g., 1, 2, 3, 4, 5, 6, 7, 8, 9, 10, 11, or 12) of the following:

(i) the length of the template RNA, e.g., whether the template RNA has a length that is above a reference length or within a reference length range, e.g., whether at least 80, 85, 90, 95, 96, 97, 98, or 99% of the template RNA present is greater than 100, 125, 150, 175, or 200 nucleotides long;

(ii) the presence, absence, and/or length of a polyA tail on the template RNA, e.g., whether at least 80, 85, 90, 95, 96, 97, 98, or 99% of the template RNA present contains a polyA tail (e.g., a polyA tail that is at least 5, 10, 20, 30, 50, 70, 100 nucleotides in length (SEQ ID NO: 3376));

(iii) the presence, absence, and/or type of a 5' cap on the template RNA, e.g., whether at least 80, 85, 90, 95, 96, 97, 98, or 99% of the template RNA present contains a 5' cap, e.g., whether that cap is a 7-methylguanosine cap, e.g., a O-Me-m7G cap;

(iv) the presence, absence, and/or type of one or more modified nucleotides (e.g., selected from pseudouridine, dihydrouridine, inosine, 7-methylguanosine, 1-N-methylpseudouridine (1-Me-Ψ), 5-methoxyuridine (5-MO-U), 5-methylcytidine (5mC), or a locked nucleotide) in the template RNA, e.g., whether at least 80, 85, 90, 95, 96, 97, 98, or 99% of the template RNA present contains one or more modified nucleotides;

(v) the stability of the template RNA (e.g., over time and/or under a pre-selected condition), e.g., whether at least 80, 85, 90, 95, 96, 97, 98, or 99% of the template RNA remains intact (e.g., greater than 100, 125, 150, 175, or 200 nucleotides long) after a stability test;

(vi) the potency of the template RNA in a system for modifying DNA, e.g., whether at least 1% of target sites are modified after a system comprising the template RNA is assayed for potency;

(vii) the length of the polypeptide, first polypeptide, or second polypeptide, e.g., whether the polypeptide, first polypeptide, or second polypeptide has a length that is above a reference length or within a reference length range, e.g., whether at least 80, 85, 90, 95, 96, 97, 98, or 99% of the polypeptide, first polypeptide, or second polypeptide present is greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long);

(viii) the presence, absence, and/or type of post-translational modification on the polypeptide, first polypeptide, or second polypeptide, e.g., whether at least 80, 85, 90, 95, 96, 97, 98, or 99% of the polypeptide, first polypeptide, or second polypeptide contains phosphorylation, methylation, acetylation, myristoylation, palmitoylation, isoprenylation, glipyatyon, or lipoylation, or any combination thereof;

(ix) the presence, absence, and/or type of one or more artificial, synthetic, or non-canonical amino acids (e.g., selected from ornithine, β-alanine, GABA, δ-Aminolevulinic acid, PABA, a D-amino acid (e.g., D-alanine or D-glutamate), aminoisobutyric acid, dehydroalanine, cystathionine, lanthionine, Djenkolic acid, Diaminopimelic acid, Homoalanine, Norvaline, Norleucine, Homonorleucine, homoserine, O-methyl-homoserine and O-ethyl-homoserine, ethionine, selenocysteine, selenohomocysteine, selenomethionine, selenoethionine, tellurocysteine, or telluromethionine) in the polypeptide, first polypeptide, or second polypeptide, e.g., whether at least 80, 85, 90, 95, 96, 97, 98, or 99% of the polypeptide, first polypeptide, or second polypeptide present contains one or more artificial, synthetic, or non-canonical amino acids;

(x) the stability of the polypeptide, first polypeptide, or second polypeptide (e.g., over time and/or under a pre-selected condition), e.g., whether at least 80, 85, 90, 95, 96, 97, 98, or 99% of the polypeptide, first polypeptide, or second polypeptide remains intact (e.g., greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long)) after a stability test;

(xi) the potency of the polypeptide, first polypeptide, or second polypeptide in a system for modifying DNA, e.g., whether at least 1% of target sites are modified after a system comprising the polypeptide, first polypeptide, or second polypeptide is assayed for potency; or (xii) the presence, absence, and/or level of one or more of a pyrogen, virus, fungus, bacterial pathogen, or host cell protein, e.g., whether the system is free or substantially free of pyrogen, virus, fungus, bacterial pathogen, or host cell protein contamination.

In some embodiments, a system or pharmaceutical composition described herein is endotoxin free.

In some embodiments, the presence, absence, and/or level of one or more of a pyrogen, virus, fungus, bacterial pathogen, and/or host cell protein is determined. In embodiments, whether the system is free or substantially free of pyrogen, virus, fungus, bacterial pathogen, and/or host cell protein contamination is determined.

In some embodiments, a pharmaceutical composition or system as described herein has one or more (e.g., 1, 2, 3, or 4) of the following characteristics:

(a) less than 1% (e.g., less than 0.5%, 0.4%, 0.3%, 0.2%, or 0.1%) DNA template relative to the template RNA and/or the RNA encoding the polypeptide, e.g., on a molar basis;

(b) less than 1% (e.g., less than 0.5%, 0.4%, 0.3%, 0.2%, or 0.1%) uncapped RNA relative to the template RNA and/or the RNA encoding the polypeptide, e.g., on a molar basis;

(c) less than 1% (e.g., less than 0.5%, 0.4%, 0.3%, 0.2%, or 0.1%) partial length RNAs relative to the template RNA and/or the RNA encoding the polypeptide, e.g., on a molar basis;

(d) substantially lacks unreacted cap dinucleotides.

Applications

By integrating coding genes into a RNA sequence template, the Gene Writer system can address therapeutic needs, for example, by providing expression of a therapeutic transgene in individuals with loss-of-function mutations, by replacing gain-of-function mutations with normal transgenes, by providing regulatory sequences to eliminate gain-of-function mutation expression, and/or by controlling the expression of operably linked genes, transgenes and systems thereof. In certain embodiments, the RNA sequence template encodes a promotor region specific to the therapeutic needs of the host cell, for example a tissue specific promotor or enhancer. In still other embodiments, a promotor can be operably linked to a coding sequence.

In embodiments, the Gene Writer™ gene editor system can provide therapeutic transgenes expressing, e.g., replacement blood factors or replacement enzymes, e.g., lysosomal enzymes. For example, the compositions, systems and methods described herein are useful to express, in a target human genome, agalsidase alpha or beta for treatment of Fabry Disease; imiglucerase, taliglucerase alfa, velaglucerase alfa, or alglucerase for Gaucher Disease; sebelipase alpha for lysosomal acid lipase deficiency (Wolman disease/CESD); laronidase, idursulfase, elosulfase alpha, or galsulfase for mucopolysaccharidoses; alglucosidase alpha for Pompe disease. For example, the compositions, systems and methods described herein are useful to express, in a target human genome factor I, II, V, VII, X, XI, XII or XIII for blood factor deficiencies.

In some embodiments, the heterologous object sequence encodes an intracellular protein (e.g., a cytoplasmic protein, a nuclear protein, an organellar protein such as a mitochondrial protein or lysosomal protein, or a membrane protein). In some embodiments, the heterologous object sequence encodes a membrane protein, e.g., a membrane protein other than a CAR, and/or an endogenous human membrane protein. In some embodiments, the heterologous object sequence encodes an extracellular protein. In some embodiments, the heterologous object sequence encodes an enzyme, a structural protein, a signaling protein, a regulatory protein, a transport protein, a sensory protein, a motor protein, a defense protein, or a storage protein. Other exemplary proteins that may be encoded by a heterologous object sequence include, without limitation, a immune receptor protein, e.g. a synthetic immune receptor protein such as a chimeric antigen receptor protein (CAR), a T cell receptor, a B cell receptor, or an antibody.

Administration

The composition and systems described herein may be used in vitro or in vivo. In some embodiments the system or components of the system are delivered to cells (e.g., mammalian cells, e.g., human cells), e.g., in vitro or in vivo. In some embodiments, the cells are eukaryotic cells, e.g., cells of a multicellular organism, e.g., an animal, e.g., a mammal (e.g., human, swine, bovine) a bird (e.g., poultry, such as chicken, turkey, or duck), or a fish. In some embodiments, the cells are non-human animal cells (e.g., a laboratory animal, a livestock animal, or a companion animal). In some embodiments, the cell is a stem cell (e.g., a hematopoietic stem cell), a fibroblast, or a T cell. In some embodiments, the cell is a non-dividing cell, e.g., a non-dividing fibroblast or non-dividing T cell. In some embodiments, the cell is an HSC and p53 is not upregulated or is upregulated by less than 10%, 5%, 2%, or 1%, e.g., as determined according to the method described in Example 30 of PCT Application No. PCT/US2019/048607, incorporated herein by reference in its entirety. The components of the Gene Writer system may, in some instances, be delivered in the form of polypeptide, nucleic acid (e.g., DNA, RNA), and combinations thereof.

For instance, delivery can use any of the following combinations for delivering the retrotransposase (e.g., as DNA encoding the retrotransposase protein, as RNA encoding the retrotransposase protein, or as the protein itself) and the template RNA (e.g., as DNA encoding the RNA, or as RNA):

1. Retrotransposase DNA+template DNA
2. Retrotransposase RNA+template DNA
3. Retrotransposase DNA+template RNA
4. Retrotransposase RNA+template RNA
5. Retrotransposase protein+template DNA
6. Retrotransposase protein+template RNA
7. Retrotransposase virus+template virus
8. Retrotransposase virus+template DNA
9. Retrotransposase virus+template RNA
10. Retrotransposase DNA+template virus
11. Retrotransposase RNA+template virus
12. Retrotransposase protein+template virus As indicated above, in some embodiments, the DNA or RNA that encodes the retrotransposase protein is delivered using a virus, and in some embodiments, the template RNA (or the DNA encoding the template RNA) is delivered using a virus.

In one embodiments the system and/or components of the system are delivered as nucleic acid. For example, the Gene Writer polypeptide may be delivered in the form of a DNA or RNA encoding the polypeptide, and the template RNA may be delivered in the form of RNA or its complementary DNA to be transcribed into RNA. In some embodiments the system or components of the system are delivered on 1, 2, 3, 4, or more distinct nucleic acid molecules. In some embodiments the system or components of the system are delivered as a combination of DNA and RNA. In some embodiments the system or components of the system are delivered as a combination of DNA and protein. In some embodiments the system or components of the system are delivered as a combination of RNA and protein. In some embodiments the Gene Writer genome editor polypeptide is delivered as a protein.

In some embodiments the system or components of the system are delivered to cells, e.g. mammalian cells or human cells, using a vector. The vector may be, e.g., a plasmid or a virus. In some embodiments delivery is in vivo, in vitro, ex vivo, or in situ. In some embodiments the virus is an adeno associated virus (AAV), a lentivirus, an adenovirus. In some embodiments the system or components of the system are delivered to cells with a viral-like particle or a virosome. In some embodiments the delivery uses more than one virus, viral-like particle or virosome.

In some embodiments, nucleic acid (e.g., encoding a polypeptide, or a template DNA, or both) delivered to cells is covalently closed linear DNA, or so-called "doggybone" DNA. During its lifecycle, the bacteriophage N15 employs protelomerase to convert its genome from circular plasmid DNA to a linear plasmid DNA (Ravin et al. J Mol Biol 2001). This process has been adapted for the production of covalently closed linear DNA in vitro (see, for example, WO2010086626A1). In some embodiments, a protelomerase is contacted with a DNA containing one or more protelomerase recognition sites, wherein protelomerase results in a cut at the one or more sites and subsequent ligation of the complementary strands of DNA, resulting in the covalent linkage between the complementary strands. In some embodiments, nucleic acid (e.g., encoding a transposase, or a template DNA, or both) is first generated as circular plasmid DNA containing a single protelomerase recognition site that is then contacted with protelomerase to yield a covalently closed linear DNA. In some embodiments, nucleic acid (e.g., encoding a transposase, or a template DNA, or both) flanked by protelomerase recognition sites on plasmid or linear DNA is contacted with protelomerase to generate a covalently closed linear DNA containing only the DNA contained between the protelomerase recognition sites. In some embodiments, the approach of flanking the desired nucleic acid sequence by protelomerase recognition sites results in covalently closed circular DNA lacking plasmid elements used for bacterial cloning and maintenance. In some embodiments, the plasmid or linear DNA containing the nucleic acid and one or more protelomerase recognition sites is optionally amplified prior to the protelomerase reaction, e.g., by rolling circle amplification or PCR.

In one embodiment, the compositions and systems described herein can be formulated in liposomes or other similar vesicles. Liposomes are spherical vesicle structures composed of a uni- or multilamellar lipid bilayer surrounding internal aqueous compartments and a relatively impermeable outer lipophilic phospholipid bilayer. Liposomes may be anionic, neutral or cationic. Liposomes are biocompatible, nontoxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi: 10.1155/2011/469679 for review).

Vesicles can be made from several different types of lipids; however, phospholipids are most commonly used to generate liposomes as drug carriers. Methods for preparation of multilamellar vesicle lipids are known in the art (see for example U.S. Pat. No. 6,693,086, the teachings of which relating to multilamellar vesicle lipid preparation are incorporated herein by reference). Although vesicle formation can be spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi: 10.1155/2011/469679 for review). Extruded lipids can be prepared by extruding through filters of decreasing size, as described in Templeton et al., Nature Biotech, 15:647-652, 1997, the teachings of which relating to extruded lipid preparation are incorporated herein by reference.

Lipid nanoparticles are another example of a carrier that provides a biocompatible and biodegradable delivery system for the pharmaceutical compositions described herein. Nanostructured lipid carriers (NLCs) are modified solid lipid nanoparticles (SLNs) that retain the characteristics of the SLN, improve drug stability and loading capacity, and prevent drug leakage. Polymer nanoparticles (PNPs) are an important component of drug delivery. These nanoparticles can effectively direct drug delivery to specific targets and improve drug stability and controlled drug release. Lipid-polymer nanoparticles (PLNs), a new type of carrier that combines liposomes and polymers, may also be employed. These nanoparticles possess the complementary advantages of PNPs and liposomes. A PLN is composed of a core-shell structure; the polymer core provides a stable structure, and the phospholipid shell offers good biocompatibility. As such, the two components increase the drug encapsulation efficiency rate, facilitate surface modification, and prevent leakage of water-soluble drugs. For a review, see, e.g., Li et al. 2017, Nanomaterials 7, 122; doi:10.3390/nano7060122.

Exosomes can also be used as drug delivery vehicles for the compositions and systems described herein. For a review, see Ha et al. July 2016. Acta Pharmaceutica Sinica B. Volume 6, Issue 4, Pages 287-296; doi.org/10.1016/j.apsb.2016.02.001.

Fusosomes interact and fuse with target cells, and thus can be used as delivery vehicles for a variety of molecules. They generally consist of a bilayer of amphipathic lipids enclosing a lumen or cavity and a fusogen that interacts with the amphipathic lipid bilayer. The fusogen component has been shown to be engineerable in order to confer target cell specificity for the fusion and payload delivery, allowing the creation of delivery vehicles with programmable cell specificity (see, for example, the relating to fusosome design, preparation, and usage in PCT Publication No. WO/2020014209, incorporated herein by reference in its entirety).

A Gene Writer system can be introduced into cells, tissues and multicellular organisms. In some embodiments the system or components of the system are delivered to the cells via mechanical means or physical means.

Formulation of protein therapeutics is described in Meyer (Ed.), *Therapeutic Protein Drug Products: Practical Approaches to formulation in the Laboratory, Manufacturing, and the Clinic*, Woodhead Publishing Series (2012).

Tissue Specific Activity/Administration

In some embodiments, a system, template RNA, or polypeptide described herein is administered to or is active in (e.g., is more active in) a target tissue, e.g., a first tissue. In some embodiments, the system, template RNA, or polypeptide is not administered to or is less active in (e.g., not active in) a non-target tissue. In some embodiments, a system, template RNA, or polypeptide described herein is useful for modifying DNA in a target tissue, e.g., a first tissue, (e.g., and not modifying DNA in a non-target tissue).

In some embodiments, a system comprises (a) a polypeptide described herein or a nucleic acid encoding the same, (b) a template nucleic acid (e.g., template RNA) described herein, and (c) one or more first tissue-specific expression-control sequences specific to the target tissue, wherein the one or more first tissue-specific expression-control sequences specific to the target tissue are in operative association with (a), (b), or (a) and (b), wherein, when associated with (a), (a) comprises a nucleic acid encoding the polypeptide.

In some embodiments, the nucleic acid in (b) comprises RNA.

In some embodiments, the nucleic acid in (b) comprises DNA.

In some embodiments, the nucleic acid in (b): (i) is single-stranded or comprises a single-stranded segment, e.g., is single-stranded DNA or comprises a single-stranded segment and one or more double stranded segments; (ii) has inverted terminal repeats; or (iii) both (i) and (ii).

In some embodiments, the nucleic acid in (b) is double-stranded or comprises a double-stranded segment.

In some embodiments, (a) comprises a nucleic acid encoding the polypeptide.

In some embodiments, the nucleic acid in (a) comprises RNA.

In some embodiments, the nucleic acid in (a) comprises DNA.

In some embodiments, the nucleic acid in (a): (i) is single-stranded or comprises a single-stranded segment, e.g., is single-stranded DNA or comprises a single-stranded segment and one or more double stranded segments; (ii) has inverted terminal repeats; or (iii) both (i) and (ii).

In some embodiments, the nucleic acid in (a) is double-stranded or comprises a double-stranded segment.

In some embodiments, the nucleic acid in (a), (b), or (a) and (b) is linear.

In some embodiments, the nucleic acid in (a), (b), or (a) and (b) is circular, e.g., a plasmid or minicircle.

In some embodiments, the heterologous object sequence is in operative association with a first promoter.

In some embodiments, the one or more first tissue-specific expression-control sequences comprises a tissue specific promoter.

In some embodiments, the tissue-specific promoter comprises a first promoter in operative association with: i. the heterologous object sequence, ii. a nucleic acid encoding the transposase, or iii. (i) and (ii).

In some embodiments, the one or more first tissue-specific expression-control sequences comprises a tissue-specific microRNA recognition sequence in operative association with: i. the heterologous object sequence, ii. a nucleic acid encoding the transposase, or iii. (i) and (ii).

In some embodiments, a system comprises a tissue-specific promoter, and the system further comprises one or more tissue-specific microRNA recognition sequences, wherein: i. the tissue specific promoter is in operative association with: I. the heterologous object sequence, II. a nucleic acid encoding the transposase, or III. (I) and (II); and/or ii. the one or more tissue-specific microRNA recognition sequences are in operative association with: I. the heterologous object sequence, II. a nucleic acid encoding the transposase, or III. (I) and (II).

In some embodiments, wherein (a) comprises a nucleic acid encoding the polypeptide, the nucleic acid comprises a promoter in operative association with the nucleic acid encoding the polypeptide.

In some embodiments, the nucleic acid encoding the polypeptide comprises one or more second tissue-specific expression-control sequences specific to the target tissue in operative association with the polypeptide coding sequence.

In some embodiments, the one or more second tissue-specific expression-control sequences comprises a tissue specific promoter.

In some embodiments, the tissue-specific promoter is the promoter in operative association with the nucleic acid encoding the polypeptide.

In some embodiments, the one or more second tissue-specific expression-control sequences comprises a tissue-specific microRNA recognition sequence.

In some embodiments, the promoter in operative association with the nucleic acid encoding the polypeptide is a tissue-specific promoter, the system further comprising one or more tissue-specific microRNA recognition sequences.

In some embodiments, a Gene Writer™ system described herein is delivered to a tissue or cell from the cerebrum, cerebellum, adrenal gland, ovary, pancreas, parathyroid gland, hypophysis, testis, thyroid gland, breast, spleen, tonsil, thymus, lymph node, bone marrow, lung, cardiac muscle, esophagus, stomach, small intestine, colon, liver, salivary gland, kidney, prostate, blood, or other cell or tissue type. In some embodiments, a Gene Writer™ system described herein is used to treat a disease, such as a cancer, inflammatory disease, infectious disease, genetic defect, or other disease. A cancer can be cancer of the cerebrum, cerebellum, adrenal gland, ovary, pancreas, parathyroid gland, hypophysis, testis, thyroid gland, breast, spleen, tonsil, thymus, lymph node, bone marrow, lung, cardiac muscle, esophagus, stomach, small intestine, colon, liver, salivary gland, kidney, prostate, blood, or other cell or tissue type, and can include multiple cancers.

In some embodiments, a Gene Writer™ system described herein described herein is administered by enteral administration (e.g. oral, rectal, gastrointestinal, sublingual, sublabial, or buccal administration). In some embodiments, a Gene Writer™ system described herein is administered by parenteral administration (e.g., intravenous, intramuscular, subcutaneous, intradermal, epidural, intracerebral, intracerebroventricular, epicutaneous, nasal, intra-arterial, intra-articular, intracavernous, intraocular, intraosseous infusion, intraperitoneal, intrathecal, intrauterine, intravaginal, intravesical, perivascular, or transmucosal administration). In some embodiments, a Gene Writer™ system described herein is administered by topical administration (e.g., transdermal administration).

In some embodiments, a Gene Writer™ system as described herein can be used to modify an animal cell, plant cell, or fungal cell. In some embodiments, a Gene Writer™ system as described herein can be used to modify a mammalian cell (e.g., a human cell). In some embodiments, a Gene Writer™ system as described herein can be used to modify a cell from a livestock animal (e.g., a cow, horse, sheep, goat, pig, llama, alpaca, camel, yak, chicken, duck, goose, or ostrich). In some embodiments, a Gene Writer™ system as described herein can be used as a laboratory tool or a research tool, or used in a laboratory method or research method, e.g., to modify an animal cell, e.g., a mammalian cell (e.g., a human cell), a plant cell, or a fungal cell.

In some embodiments, a Gene Writer™ system as described herein can be used to express a protein, template, or heterologous object sequence (e.g., in an animal cell, e.g., a mammalian cell (e.g., a human cell), a plant cell, or a fungal cell). In some embodiments, a Gene Writer™ system as described herein can be used to express a protein, template, or heterologous object sequence under the control of an inducible promoter (e.g., a small molecule inducible promoter). In some embodiments, a Gene Writing system or payload thereof is designed for tunable control, e.g., by the use of an inducible promoter. For example, a promoter, e.g., Tet, driving a gene of interest may be silent at integration, but may, in some instances, activated upon exposure to a small molecule inducer, e.g., doxycycline. In some embodiments, the tunable expression allows post-treatment control of a gene (e.g., a therapeutic gene), e.g., permitting a small molecule-dependent dosing effect. In embodiments, the small molecule-dependent dosing effect comprises altering levels of the gene product temporally and/or spatially, e.g., by local administration. In some embodiments, a promoter used in a system described herein may be inducible, e.g., responsive to an endogenous molecule of the host and/or an exogenous small molecule administered thereto.

In some embodiments, a Gene Writing system is used to make changes to non-coding and/or regulatory control regions, e.g., to tune the expression of endogenous genes. In some embodiments, a Gene Writing system is used to induce upregulation or downregulation of gene expression. In some embodiments, a regulatory control region comprises one or more of a promoter, enhancer, UTR, CTCF site, and/or a gene expression control region.

In some embodiments, a Gene Writing system may be used to treat or prevent a repeat expansion disease (e.g., a disease of Table 26), or to reduce the severity or a symptom thereof. In some embodiments, the repeat expansion disease comprises expansion of a trinucleotide repeat. In some embodiments, the subject has at least 10, 20, 30, 40, or 50 copies of the repeat. In embodiments, the repeat expansion disease is an inherited disease. Non-limiting examples of repeat expansion diseases include Huntington's disease (HD) and myotonic dystrophy. For example, healthy individuals may possess between 10 and 35 tandem copies of the CAG trinucleotide repeat (SEQ ID NO: 1608), while Huntington's patients frequently possess >40 copies, which can result, e.g., in an elongated and dysfunctional Huntingtin protein. In some embodiments, a Gene Writer corrects a repeat expansion, e.g., by recognizing DNA at the terminus of the repeat region and nicking one strand (FIG. 30). In some embodiments, the template RNA component of the Gene Writer comprises a region with a number of repeats characterstic of a healthy subject, e.g., about 20 repeats (e.g., between 5-10, 10-15, 15-20, 20-25, 25-30, 30-35, or 35-40 repeats). In some embodiments, the template RNA component of the Gene Writer is copied by TPRT into the target site. In some embodiments, a second strand nick and second strand synthesis then results in the integration of the newly copied DNA comprising a correct number of repeats (e.g., as described herein). In some embodiments, the system recognizes DNA at the terminus of the repeat region and the template carries the information for the new number of repeats. In embodiments, a Gene Writer can be used in this way regardless of the number of repeats present in an individual and/or in an individual cell. Owing to the presence of multiple repeats, an alternative non-GeneWriter therapeutic (e.g., a CRISPR-based homologous recombination therapeutic) might, in some embodiments, result in unpredictable repair behavior. Further non-limiting examples of repeat expansion diseases and the causative repeats can be found, for example, in La Spada and Taylor Nat Rev Genet 11(4):247-258 (2010), which is incorporated herein by reference in its entirety.

In some embodiments, a Gene Writing system may be used to treat a healthy individual, e.g., as a preventative therapy. Gene Writing systems can, in some embodiments, be targeted to generate mutations, e.g., that have been shown to be protective towards a disease of interest. An exemplary list of such diseases and protective mutation targets can be found in Table 22.

In some embodiments, a nucleic acid component of a system provided by the invention a sequence (e.g., encoding the polypeptide or comprising a heterologous object sequence) is flanked by untranslated regions (UTRs) that modify protein expression levels. Various 5' and 3' UTRs can affect protein expression. For example, in some embodiments, the coding sequence may be preceded by a 5' UTR that modifies RNA stability or protein translation. In some embodiments, the sequence may be followed by a 3' UTR that modifies RNA stability or translation. In some embodiments, the sequence may be preceded by a 5' UTR and followed by a 3' UTR that modify RNA stability or translation. In some embodiments, the 5' and/or 3' UTR may be selected from the 5' and 3' UTRs of complement factor 3 (C3) (cactcctccc-catcctctccctctgtccctctgtccctctgaccctgcactgtcccagcacc (SEQ ID NO: 1609)) or orosomucoid 1 (ORM1) (caggacacagccttggatcaggacagagacttgggggccatcctgcccctc-caacccgacatgtgtacctcagcttttccctcacttgcat caataaagcttctgtgtttggaacagctaa (SEQ ID NO: 1610)) (Asrani et al. RNA Biology 2018). In certain embodiments, the 5' UTR is the 5' UTR from C3 and the 3' UTR is the 3' UTR from ORM1.

In certain embodiments, a 5' UTR and 3' UTR for protein expression, e.g., mRNA (or DNA encoding the RNA) for a Gene Writer polypeptide or heterologous object sequence, comprise optimized expression sequences. In some embodiments, the 5' UTR comprises GGGAAAUAAGAGAGAAAAGAAGAGUAAGAAGA AAUAUAAGAGCCACC (SEQ ID NO: 1579) and/or the 3' UTR comprising UGAUAAUAGGCUGGAGCCUCG-GUGGCCAUGCUUCUUGCCCCUUGGGCCUCCCCCC AGCCCCUCCUCCCCUUC-CUGCACCCGUACCCCCGUGGUCUUUGAAUAAA-GUCUGA (SEQ ID NO: 1580), e.g., as described in Richner et al. Cell 168(6): P1114-1125 (2017), the sequences of which are incorporated herein by reference.

In some embodiments, a 5' and/or 3' UTR may be selected to enhance protein expression. In some embodiments, a 5' and/or 3' UTR may be selected to modify protein expression such that overproduction inhibition is minimized. In some embodiments, UTRs are around a coding sequence, e.g., outside the coding sequence and in other embodiments proximal to the coding sequence, In some embodiments additional regulatory elements (e.g., miRNA binding sites, cis-regulatory sites) are included in the UTRs.

In some embodiments, an open reading frame (ORF) of a Gene Writer system, e.g., an ORF of an mRNA (or DNA encoding an mRNA) encoding a Gene Writer polypeptide or one or more ORFs of an mRNA (or DNA encoding an mRNA) of a heterologous object sequence, is flanked by a 5' and/or 3' untranslated region (UTR) that enhances the expression thereof. In some embodiments, the 5' UTR of an mRNA component (or transcript produced from a DNA component) of the system comprises the sequence 5'-GG-GAAAUAAGAGAGAAAAGAAGAGUAAGAAGAAA UAUAAGAGCCACC-3' (SEQ ID NO: 1579). In some embodiments, the 3' UTR of an mRNA component (or transcript produced from a DNA component) of the system comprises the sequence 5'-UGAUAAUAGGCUGGAGC-CUCGGUGGCCAUGCUUCUUGCCCCUUGGGC-CUCCCCCC AGCCCUCCUCCCCUUC-CUGCACCCGUACCCCCGUGGUCUUUGAAUAAAGU-CUGA-3' (SEQ ID NO: 1580). This combination of 5' UTR and 3' UTR has been shown to result in desirable expression of an operably linked ORF by Richner et al. Cell 168(6): P1114-1125 (2017), the teachings and sequences of which are incorporated herein by reference. In some embodiments, a system described herein comprises a DNA encoding a transcript, wherein the DNA comprises the corresponding 5' UTR and 3' UTR sequences, with T substituting for U in the above-listed sequence). In some embodiments, a DNA vector used to produce an RNA component of the system further comprises a promoter upstream of the 5' UTR for initiating in vitro transcription, e.g, a T7, T3, or SP6 promoter. The 5' UTR above begins with GGG, which is a suitable start for optimizing transcription using T7 RNA polymerase. For tuning transcription levels and altering the transcription start site nucleotides to fit alternative 5' UTRs, the teachings of Davidson et al. Pac Symp Biocomput 433-443 (2010) describe T7 promoter variants, and the methods of discovery thereof, that fulfill both of these traits.

Viral Vectors and Components Thereof

Viruses are a useful source of delivery vehicles for the systems described herein, in addition to a source of relevant enzymes or domains as described herein, e.g., as sources of polymerases and polymerase functions used herein, e.g., DNA-dependent DNA polymerase, RNA-dependent RNA polymerase, RNA-dependent DNA polymerase, DNA-dependent RNA polymerase, reverse transcriptase. Some enzymes, e.g., reverse transcriptases, may have multiple activities, e.g., be capable of both RNA-dependent DNA polymerization and DNA-dependent DNA polymerization, e.g., first and second strand synthesis. In some embodiments, the virus used as a Gene Writer delivery system or a source of components thereof may be selected from a group as described by Baltimore Bacteriol Rev 35(3):235-241 (1971).

In some embodiments, the virus is selected from a Group I virus, e.g., is a DNA virus and packages dsDNA into virions. In some embodiments, the Group I virus is selected from, e.g., Adenoviruses, Herpesviruses, Poxviruses.

In some embodiments, the virus is selected from a Group II virus, e.g., is a DNA virus and packages ssDNA into virions. In some embodiments, the Group II virus is selected from, e.g., Parvoviruses. In some embodiments, the parvovirus is a dependoparvovirus, e.g., an adeno-associated virus (AAV).

In some embodiments, the virus is selected from a Group III virus, e.g., is an RNA virus and packages dsRNA into virions. In some embodiments, the Group III virus is selected from, e.g., Reoviruses. In some embodiments, one or both strands of the dsRNA contained in such virions is a coding molecule able to serve directly as mRNA upon transduction into a host cell, e.g., can be directly translated into protein upon transduction into a host cell without requiring any intervening nucleic acid replication or polymerization steps.

In some embodiments, the virus is selected from a Group IV virus, e.g., is an RNA virus and packages ssRNA(+) into virions. In some embodiments, the Group IV virus is selected from, e.g., Coronaviruses, Picornaviruses, Togaviruses. In some embodiments, the ssRNA(+) contained in such virions is a coding molecule able to serve directly as mRNA upon transduction into a host cell, e.g., can be directly translated into protein upon transduction into a host cell without requiring any intervening nucleic acid replication or polymerization steps.

In some embodiments, the virus is selected from a Group V virus, e.g., is an RNA virus and packages ssRNA(−) into virions. In some embodiments, the Group V virus is selected from, e.g., Orthomyxoviruses, Rhabdoviruses. In some embodiments, an RNA virus with an ssRNA(−) genome also carries an enzyme inside the virion that is transduced to host cells with the viral genome, e.g., an RNA-dependent RNA polymerase, capable of copying the ssRNA(−) into ssRNA (+) that can be translated directly by the host.

In some embodiments, the virus is selected from a Group VI virus, e.g., is a retrovirus and packages ssRNA(+) into virions. In some embodiments, the Group VI virus is selected from, e.g., Retroviruses. In some embodiments, the retrovirus is a lentivirus, e.g., HIV-1, HIV-2, SIV, BIV. In some embodiments, the retrovirus is a spumavirus, e.g., a foamy virus, e.g., HFV, SFV, BFV. In some embodiments, the ssRNA(+) contained in such virions is a coding molecule able to serve directly as mRNA upon transduction into a host cell, e.g., can be directly translated into protein upon transduction into a host cell without requiring any intervening nucleic acid replication or polymerization steps. In some embodiments, the ssRNA(+) is first reverse transcribed and copied to generate a dsDNA genome intermediate from which mRNA can be transcribed in the host cell. In some embodiments, an RNA virus with an ssRNA(+) genome also carries an enzyme inside the virion that is transduced to host cells with the viral genome, e.g., an RNA-dependent DNA polymerase, capable of copying the ssRNA(+) into dsDNA that can be transcribed into mRNA and translated by the host. In some embodiments, the reverse transcriptase from a Group VI retrovirus is incorporated as the reverse transcriptase domain of a Gene Writer polypeptide.

In some embodiments, the virus is selected from a Group VII virus, e.g., is a retrovirus and packages dsRNA into virions. In some embodiments, the Group VII virus is selected from, e.g., Hepadnaviruses. In some embodiments, one or both strands of the dsRNA contained in such virions is a coding molecule able to serve directly as mRNA upon transduction into a host cell, e.g., can be directly translated into protein upon transduction into a host cell without requiring any intervening nucleic acid replication or polymerization steps. In some embodiments, one or both strands of the dsRNA contained in such virions is first reverse transcribed and copied to generate a dsDNA genome intermediate from which mRNA can be transcribed in the host cell. In some embodiments, an RNA virus with a dsRNA genome also carries an enzyme inside the virion that is transduced to host cells with the viral genome, e.g., an RNA-dependent DNA polymerase, capable of copying the dsRNA into dsDNA that can be transcribed into mRNA and translated by the host. In some embodiments, the reverse transcriptase from a Group VII retrovirus is incorporated as the reverse transcriptase domain of a Gene Writer polypeptide.

In some embodiments, virions used to deliver nucleic acid in this invention may also carry enzymes involved in the process of Gene Writing. For example, a retroviral virion may contain a reverse transcriptase domain that is delivered into a host cell along with the nucleic acid. In some embodiments, an RNA template may be associated with a Gene Writer polypeptide within a virion, such that both are co-delivered to a target cell upon transduction of the nucleic acid from the viral particle. In some embodiments, the nucleic acid in a virion may comprise DNA, e.g., linear ssDNA, linear dsDNA, circular ssDNA, circular dsDNA, minicircle DNA, dbDNA, ceDNA. In some embodiments, the nucleic acid in a virion may comprise RNA, e.g., linear ssRNA, linear dsRNA, circular ssRNA, circular dsRNA. In some embodiments, a viral genome may circularize upon transduction into a host cell, e.g., a linear ssRNA molecule may undergo a covalent linkage to form a circular ssRNA, a linear dsRNA molecule may undergo a covalent linkage to form a circular dsRNA or one or more circular ssRNA. In some embodiments, a viral genome may replicate by rolling circle replication in a host cell. In some embodiments, a viral genome may comprise a single nucleic acid molecule, e.g., comprise a non-segmented genome. In some embodiments, a viral genome may comprise two or more nucleic acid molecules, e.g., comprise a segmented genome. In some embodiments, a nucleic acid in a virion may be associated with one or proteins. In some embodiments, one or more proteins in a virion may be delivered to a host cell upon transduction. In some embodiments, a natural virus may be adapted for nucleic acid delivery by the addition of virion packaging signals to the target nucleic acid, wherein a host cell is used to package the target nucleic acid containing the packaging signals.

In some embodiments, a virion used as a delivery vehicle may comprise a commensal human virus. In some embodiments, a virion used as a delivery vehicle may comprise an anellovirus, the use of which is described in WO2018232017A1, which is incorporated herein by reference in its entirety.

Adeno-Associated Viruses

In some embodiments, the virus is an adeno-associated virus (AAV). In some embodiments, the AAV genome comprises two genes that encode four replication proteins and three capsid proteins, respectively. In some embodiments, the genes are flanked on either side by 145-bp inverted terminal repeats (ITRs). In some embodiments, the virion comprises up to three capsid proteins (Vp1, Vp2, and/or Vp3), e.g., produced in a 1:1:10 ratio. In some embodiments, the capsid proteins are produced from the same open reading frame and/or from differential splicing (Vp1) and alternative translational start sites (Vp2 and Vp3, respectively). Generally, Vp3 is the most abundant subunit in the virion and participates in receptor recognition at the cell surface defining the tropism of the virus. In some embodiments, Vp1 comprises a phospholipase domain, e.g., which functions in viral infectivity, in the N-terminus of Vp1.

In some embodiments, packaging capacity of the viral vectors limits the size of the base editor that can be packaged into the vector. For example, the packaging capacity of the AAVs can be about 4.5 kb (e.g., about 3.0, 3.5, 4.0, 4.5, 5.0, 5.5, or 6.0 kb), e.g., including one or two inverted terminal repeats (ITRs), e.g., 145 base ITRs.

In some embodiments, recombinant AAV (rAAV) comprises cis-acting 145-bp ITRs flanking vector transgene cassettes, e.g., providing up to 4.5 kb for packaging of foreign DNA. Subsequent to infection, rAAV can, in some instances, express a fusion protein of the invention and persist without integration into the host genome by existing episomally in circular head-to-tail concatemers. rAAV can be used, for example, in vitro and in vivo. In some embodiments, AAV-mediated gene delivery requires that the length of the coding sequence of the gene is equal or greater in size than the wild-type AAV genome.

AAV delivery of genes that exceed this size and/or the use of large physiological regulatory elements can be accomplished, for example, by dividing the protein(s) to be delivered into two or more fragments. In some embodiments, the N-terminal fragment is fused to a split intein-N. In some embodiments, the C-terminal fragment is fused to a split intein-C. In embodiments, the fragments are packaged into two or more AAV vectors.

In some embodiments, dual AAV vectors are generated by splitting a large transgene expression cassette in two separate halves (5 and 3 ends, or head and tail), e.g., wherein each half of the cassette is packaged in a single AAV vector (of <5 kb). The re-assembly of the full-length transgene expression cassette can, in some embodiments, then be achieved upon co-infection of the same cell by both dual AAV vectors. In some embodiments, co-infection is followed by one or more of: (1) homologous recombination (HR) between 5 and 3 genomes (dual AAV overlapping vectors); (2) ITR-mediated tail-to-head concatemerization of 5 and 3 genomes (dual AAV trans-splicing vectors); and/or (3) a combination of these two mechanisms (dual AAV hybrid vectors). In some embodiments, the use of dual AAV vectors in vivo results in the expression of full-length proteins. In some embodiments, the use of the dual AAV vector platform represents an efficient and viable gene transfer strategy for transgenes of greater than about 4.0, 4.1, 4.2, 4.3, 4.4, 4.5, 4.6, 4.7, 4.8, 4.9, or 5.0 kb in size. In some embodiments, AAV vectors can also be used to transduce cells with target nucleic acids, e.g., in the in vitro production of nucleic acids and peptides. In some embodiments, AAV vectors can be used for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994); each of which is incorporated herein by reference in their entirety). The construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989) (incorporated by reference herein in their entirety).

In some embodiments, a Gene Writer described herein (e.g., with or without one or more guide nucleic acids) can be delivered using AAV, lentivirus, adenovirus or other plasmid or viral vector types, in particular, using formulations and doses from, for example, U.S. Pat. No. 8,454,972 (formulations, doses for adenovirus), U.S. Pat. No. 8,404, 658 (formulations, doses for AAV) and U.S. Pat. No. 5,846, 946 (formulations, doses for DNA plasmids) and from clinical trials and publications regarding the clinical trials involving lentivirus, AAV and adenovirus. For example, for AAV, the route of administration, formulation and dose can be as described in U.S. Pat. No. 8,454,972 and as in clinical trials involving AAV. For Adenovirus, the route of administration, formulation and dose can be as described in U.S. Pat. No. 8,404,658 and as in clinical trials involving adenovirus. For plasmid delivery, the route of administration, formulation and dose can be as described in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. In some embodiments, the viral vectors can be injected into the tissue of interest. For cell-type specific Gene Writing, the expression of the Gene Writer and optional guide nucleic acid can, in some embodiments, be driven by a cell-type specific promoter.

In some embodiments, AAV allows for low toxicity, for example, due to the purification method not requiring ultra-centrifugation of cell particles that can activate the immune response. In some embodiments, AAV allows low probability of causing insertional mutagenesis, for example, because it does not substantially integrate into the host genome.

In some embodiments, AAV has a packaging limit of about 4.4, 4.5, 4.6, 4.7, or 4.75 kb. In some embodiments, a Gene Writer, promoter, and transcription terminator can fit into a single viral vector. SpCas9 (4.1 kb) may, in some instances, be difficult to package into AAV. Therefore, in some embodiments, a Gene Writer is used that is shorter in length than other Gene Writers or base editors. In some embodiments, the Gene Writers are less than about 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb.

An AAV can be AAV1, AAV2, AAV5 or any combination thereof. In some embodiments, the type of AAV is selected with respect to the cells to be targeted; e.g., AAV serotypes 1, 2, 5 or a hybrid capsid AAV1, AAV2, AAV5 or any combination thereof can be selected for targeting brain or neuronal cells; or AAV4 can be selected for targeting cardiac tissue. In some embodiments, AAV8 is selected for delivery to the liver. Exemplary AAV serotypes as to these cells are described, for example, in Grimm, D. et al, J. Virol. 82: 5887-5911 (2008) (incorporated herein by reference in its entirety). In some embodiments, AAV refers all serotypes, subtypes, and naturally-occurring AAV as well as recombinant AAV. AAV may be used to refer to the virus itself or a derivative thereof. In some embodiments, AAV includes AAV1, AAV2, AAV3, AAV3B, AAV4, AAV5, AAV6, AAV6.2, AAV7, AAVrh.64R1, AAVhu.37, AAVrh.8, AAVrh.32.33, AAV8, AAV9, AAV-DJ, AAV2/8, AAVrh10, AAVLK03, AV10, AAV11, AAV 12, rh10, and hybrids thereof, avian AAV, bovine AAV, canine AAV, equine AAV, primate AAV, nonprimate AAV, and ovine AAV. The genomic sequences of various serotypes of AAV, as well as the sequences of the native terminal repeats (TRs), Rep proteins, and capsid subunits are known in the art. Such sequences may be found in the literature or in public databases such as GenBank. Additional exemplary AAV serotypes are listed in Table 36.

TABLE 36

Exemplary AAV serotypes.

| Target Tissue | Vehicle | Reference |
|---|---|---|
| Liver | AAV (AAV8[1], AAVrh.8[1], AAVhu.37[1], AAV2/8, AAV2/rh10[2], AAV9, AAV2, NP40[3], NP59[2,3], AAV3B[5], AAV-DJ[4], AAV-LK01[4], AAV-LK02[4], AAV-LK03[4], AAV-LK19[4] Adenovirus (Ad5, HC-AdV[6]) | 1. Wang et al., Mol. Ther. 18, 118-25 (2010) 2. Ginn et al., JHEP Reports, 100065 (2019) 3. Paulk et al., Mol. Ther. 26, 289-303 (2018). 4. L. Lisowski et al., Nature. 506, 382-6 (2014). 5. L. Wang et al., Mol. Ther. 23, 1877-87 (2015). 6. Hausl Mol Ther (2010) |
| Lung | AAV (AAV4, AAV5, AAV6[1], AAV9, H22[2]) Adenovirus (Ad5, Ad3, Ad21, Ad14)[3] | 1. Duncan et al., Mol Ther Methods Clin Dev (2018) 2. Cooney et al., Am J Respir Cell Mol Biol (2019) 3. Li et al., Mol Ther Methods Clin Dev (2019) |
| Skin | AAV (AAV6[1], AAV-LK19[2]) | 1. Petek et al., Mol. Ther. (2010) 2. L. Lisowski et al., Nature. 506, 382-6 (2014). |
| HSCs | Adenovirus (HDAd5/35[++]) | Wang et al. Blood Adv (2019) |

In some embodiments, a pharmaceutical composition (e.g., comprising an AAV as described herein) has less than 10% empty capsids, less than 8% empty capsids, less than 7% empty capsids, less than 5% empty capsids, less than 3% empty capsids, or less than 1% empty capsids. In some embodiments, the pharmaceutical composition has less than about 5% empty capsids. In some embodiments, the number of empty capsids is below the limit of detection. In some embodiments, it is advantageous for the pharmaceutical composition to have low amounts of empty capsids, e.g., because empty capsids may generate an adverse response (e.g., immune response, inflammatory response, liver response, and/or cardiac response), e.g., with little or no substantial therapeutic benefit.

In some embodiments, the residual host cell protein (rHCP) in the pharmaceutical composition is less than or equal to 100 ng/ml rHCP per $1\times10^{13}$ vg/ml, e.g., less than or equal to 40 ng/ml rHCP per $1\times10^{13}$ vg/ml or 1-50 ng/ml rHCP per $1\times10^{13}$ vg/ml. In some embodiments, the pharmaceutical composition comprises less than 10 ng rHCP per $1.0\times10^{13}$ vg, or less than 5 ng rHCP per $1.0\times10^{13}$ vg, less than 4 ng rHCP per $1.0\times10^{13}$ vg, or less than 3 ng rHCP per $1.0\times10^{13}$ vg, or any concentration in between. In some embodiments, the residual host cell DNA (hcDNA) in the pharmaceutical composition is less than or equal to $5\times10^{6}$ pg/ml hcDNA per $1\times10^{13}$ vg/ml, less than or equal to $1.2\times10^{6}$ pg/ml hcDNA per $1\times10^{13}$ vg/ml, or $1\times10^{5}$ pg/ml hcDNA per $1\times10^{13}$ vg/ml. In some embodiments, the residual host cell DNA in said pharmaceutical composition is less than $5.0\times10^{5}$ pg per $1\times10^{13}$ vg, less than $2.0\times10^{5}$ pg per $1.0\times10^{13}$ vg, less than $1.1\times10^{5}$ pg per $1.0\times10^{13}$ vg, less than $1.0\times10^{5}$ pg hcDNA per $1.0\times10^{13}$ vg, less than $0.9\times10^{5}$ pg hcDNA per $1.0\times10^{13}$ vg, less than $0.8\times10^{5}$ pg hcDNA per $1.0\times10^{13}$ vg, or any concentration in between.

In some embodiments, the residual plasmid DNA in the pharmaceutical composition is less than or equal to $1.7\times10^{5}$ pg/ml per $1.0\times10^{13}$ vg/ml, or $1\times10^{5}$ pg/ml per $1\times1.0\times10^{13}$ vg/ml, or $1.7\times10^{6}$ pg/ml per $1.0\times10^{13}$ vg/ml. In some embodiments, the residual DNA plasmid in the pharmaceutical composition is less than $10.0\times10\ 5$ pg by $1.0\times10^{13}$ vg, less than $8.0\times10^{5}$ pg by $1.0\times10^{13}$ vg or less than $6.8\times10^{5}$ pg by $1.0\times10^{13}$ vg. In embodiments, the pharmaceutical composition comprises less than 0.5 ng per $1.0\times10^{13}$ vg, less than 0.3 ng per $1.0\times10^{13}$ vg, less than 0.22 ng per $1.0\times10^{13}$ vg or less than 0.2 ng per $1.0\times10^{13}$ vg or any intermediate concentration of bovine serum albumin (BSA). In embodiments, the benzonase in the pharmaceutical composition is less than 0.2 ng by $1.0\times10^{13}$ vg, less than 0.1 ng by $1.0\times10^{13}$ vg, less than 0.09 ng by $1.0\times10^{13}$ vg, less than 0.08 ng by $1.0\times10^{13}$ vg or any intermediate concentration. In embodiments, Poloxamer 188 in the pharmaceutical composition is about 10 to 150 ppm, about 15 to 100 ppm or about 20 to 80 ppm. In embodiments, the cesium in the pharmaceutical composition is less than 50 pg/g (ppm), less than 30 pg/g (ppm) or less than 20 pg/g (ppm) or any intermediate concentration.

In embodiments, the pharmaceutical composition comprises total impurities, e.g., as determined by SDS-PAGE, of less than 10%, less than 8%, less than 7%, less than 6%, less than 5%, less than 4%, less than 3%, less than 2%, or any percentage in between. In embodiments, the total purity, e.g., as determined by SDS-PAGE, is greater than 90%, greater than 92%, greater than 93%, greater than 94%, greater than 95%, greater than 96%, greater than 97%, greater than 98%, or any percentage in between. In embodiments, no single unnamed related impurity, e.g., as measured by SDS-PAGE, is greater than 5%, greater than 4%, greater than 3% or greater than 2%, or any percentage in between. In embodiments, the pharmaceutical composition comprises a percentage of filled capsids relative to total capsids (e.g., peak 1+peak 2 as measured by analytical ultracentrifugation) of greater than 85%, greater than 86%, greater than 87%, greater than 88%, greater than 89%, greater than 90%, greater than 91%, greater than 91.9%, greater than 92%, greater than 93%, or any percentage in between. In embodiments of the pharmaceutical composition, the percentage of filled capsids measured in peak 1 by analytical ultracentrifugation is 20-80%, 25-75%, 30-75%, 35-75%, or 37.4-70.3%. In embodiments of the pharmaceutical composition, the percentage of filled capsids measured in peak 2 by analytical ultracentrifugation is 20-80%, 20-70%, 22-65%, 24-62%, or 24.9-60.1%.

In one embodiment, the pharmaceutical composition comprises a genomic titer of 1.0 to $5.0\times10^{13}$ vg/mL, 1.2 to $3.0\times10^{13}$ vg/mL or 1.7 to $2.3\times10^{13}$ vg/ml. In one embodiment, the pharmaceutical composition exhibits a biological load of less than 5 CFU/mL, less than 4 CFU/mL, less than 3 CFU/mL, less than 2 CFU/mL or less than 1 CFU/mL or any intermediate contraction. In embodiments, the amount of endotoxin according to USP, for example, USP <85> (incorporated by reference in its entirety) is less than 1.0 EU/mL, less than 0.8 EU/mL or less than 0.75 EU/mL. In embodiments, the osmolarity of a pharmaceutical composition according to USP, for example, USP <785> (incorporated by reference in its entirety) is 350 to 450 mOsm/kg, 370 to 440 mOsm/kg or 390 to 430 mOsm/kg. In embodiments, the pharmaceutical composition contains less than 1200 particles that are greater than 25 μm per container, less than 1000 particles that are greater than 25 μm per container, less than 500 particles that are greater than 25 μm per container or any intermediate value. In embodiments, the pharmaceutical composition contains less than 10,000 particles that are greater than 10 μm per container, less than 8000 particles that are greater than 10 μm per container or less than 600 particles that are greater than 10 pm per container.

In one embodiment, the pharmaceutical composition has a genomic titer of 0.5 to $5.0\times10^{13}$ vg/mL, 1.0 to $4.0\times10^{13}$ vg/mL, 1.5 to $3.0\times10^{13}$ vg/ml or 1.7 to $2.3\times10^{13}$ vg/ml. In one embodiment, the pharmaceutical composition described herein comprises one or more of the following: less than about 0.09 ng benzonase per $1.0 \times 10^{13}$ vg, less than about 30 pg/g (ppm) of cesium, about 20 to 80 ppm Poloxamer 188, less than about 0.22 ng BSA per $1.0 \times 10^{13}$ vg, less than about 6.8×10 5 pg of residual DNA plasmid per $1.0 \times 10^{13}$ vg, less than about $1.1 \times 10^5$ pg of residual hcDNA per $1.0 \times 10^{13}$ vg, less than about 4 ng of rHCP per $1.0 \times 10^{13}$ vg, pH 7.7 to 8.3, about 390 to 430 mOsm/kg, less than about 600 particles that are >25 µm in size per container, less than about 6000 particles that are >10 µm in size per container, about $1.7 \times 10^{13}$-$2.3 \times 10^{13}$ vg/mL genomic titer, infectious titer of about $3.9 \times 10^8$ to $8.4 \times 10^{10}$ IU per 1.0×13 vg, total protein of about 100-300 µg per $1.0 \times 10^{13}$ vg, mean survival of >24 days in A7SMA mice with about $7.5 \times 10^{13}$ vg/kg dose of viral vector, about 70 to 130% relative potency based on an in vitro cell based assay and/or less than about 5% empty capsid. In various embodiments, the pharmaceutical compositions described herein comprise any of the viral particles discussed here, retain a potency of between ±20%, between ±15%, between ±10% or within ±5% of a reference standard. In some embodiments, potency is measured using a suitable in vitro cell assay or in vivo animal model.

Additional methods of preparation, characterization, and dosing AAV particles are taught in WO2019094253, which is incorporated herein by reference in its entirety.

Additional rAAV constructs that can be employed consonant with the invention include those described in Wang et al 2019, available at: /doi.org/10.1038/s41573-019-0012-9, including Table 1 thereof, which is incorporated by reference in its entirety.

AAV Administration

In some embodiments, an adeno-associated virus (AAV) is used in conjunction with the system, template nucleic acid, and/or polypeptide described herein. In some embodiments, an AAV is used to deliver, administer, or package the system, template nucleic acid, and/or polypeptide described herein. In some embodiments, the AAV is a recombinant AAV (rAAV).

In some embodiments, a system comprises (a) a polypeptide described herein or a nucleic acid encoding the same, (b) a template nucleic acid (e.g., template RNA) described herein, and (c) one or more first tissue-specific expression-control sequences specific to the target tissue, wherein the one or more first tissue-specific expression-control sequences specific to the target tissue are in operative association with (a), (b), or (a) and (b), wherein, when associated with (a), (a) comprises a nucleic acid encoding the polypeptide.

In some embodiments, a system described herein further comprises a first recombinant adeno-associated virus (rAAV) capsid protein; wherein the at least one of (a) or (b) is associated with the first rAAV capsid protein, wherein at least one of (a) or (b) is flanked by AAV inverted terminal repeats (ITRs).

In some embodiments, (a) and (b) are associated with the first rAAV capsid protein.

In some embodiments, (a) and (b) are on a single nucleic acid.

In some embodiments, the system further comprises a second rAAV capsid protein, wherein at least one of (a) or (b) is associated with the second rAAV capsid protein, and wherein the at least one of (a) or (b) associated with the second rAAV capsid protein is different from the at least one of (a) or (b) is associated with the first rAAV capsid protein.

In some embodiments, the at least one of (a) or (b) is associated with the first or second rAAV capsid protein is dispersed in the interior of the first or second rAAV capsid protein, which first or second rAAV capsid protein is in the form of an AAV capsid particle.

In some embodiments, the system further comprises a nanoparticle, wherein the nanoparticle is associated with at least one of (a) or (b).

In some embodiments, (a) and (b), respectively are associated with: a) a first rAAV capsid protein and a second rAAV capsid protein; b) a nanoparticle and a first rAAV capsid protein; c) a first rAAV capsid protein; d) a first adenovirus capsid protein; e) a first nanoparticle and a second nanoparticle; or f) a first nanoparticle.

Viral vectors are useful for delivering all or part of a system provided by the invention, e.g., for use in methods provided by the invention. Systems derived from different viruses have been employed for the delivery of polypeptides, nucleic acids, or transposons; for example: integrase-deficient lentivirus, adenovirus, adeno-associated virus (AAV), herpes simplex virus, and baculovirus (reviewed in Hodge et al. Hum Gene Ther 2017; Narayanavari et al. Crit Rev Biochem Mol Biol 2017; Boehme et al. Curr Gene Ther 2015).

Adenoviruses are common viruses that have been used as gene delivery vehicles given well-defined biology, genetic stability, high transduction efficiency, and ease of large-scale production (see, for example, review by Lee et al. Genes & Diseases 2017). They possess linear dsDNA genomes and come in a variety of serotypes that differ in tissue and cell tropisms. In order to prevent replication of infectious virus in recipient cells, adenovirus genomes used for packaging are deleted of some or all endogenous viral proteins, which are provided in trans in viral production cells. This renders the genomes helper-dependent, meaning they can only be replicated and packaged into viral particles in the presence of the missing components provided by so-called helper functions. A helper-dependent adenovirus system with all viral ORFs removed may be compatible with packaging foreign DNA of up to ~37 kb (Parks et al. J Virol 1997). In some embodiments, an adenoviral vector is used to deliver DNA corresponding to the polypeptide or template component of the Gene Writing™ system, or both are contained on separate or the same adenoviral vector. In some embodiments, the adenovirus is a helper-dependent adenovirus (HD-AdV) that is incapable of self-packaging. In some embodiments, the adenovirus is a high-capacity adenovirus (HC-AdV) that has had all or a substantial portion of endogenous viral ORFs deleted, while retaining the necessary sequence components for packaging into adenoviral particles. For this type of vector, the only adenoviral sequences required for genome packaging are noncoding sequences: the inverted terminal repeats (ITRs) at both ends and the packaging signal at the 5'-end (Jager et al. Nat Protoc 2009). In some embodiments, the adenoviral genome also comprises stuffer DNA to meet a minimal genome size for optimal production and stability (see, for example, Hausl et al. Mol Ther 2010). Adenoviruses have been used in the art for the delivery of transposons to various tissues. In some embodiments, an adenovirus is used to deliver a Gene Writing™ system to the liver.

In some embodiments, an adenovirus is used to deliver a Gene Writing™ system to HSCs, e.g., HDAd5/35++. HDAd5/35++ is an adenovirus with modified serotype 35 fibers that de-target the vector from the liver (Wang et al. Blood Adv 2019). In some embodiments, the adenovirus that delivers a Gene Writing™ system to HSCs utilizes a receptor that is expressed specifically on primitive HSCs, e.g., CD46.

Adeno-associated viruses (AAV) belong to the parvoviridae family and more specifically constitute the dependoparvovirus genus. The AAV genome is composed of a linear single-stranded DNA molecule which contains approximately 4.7 kilobases (kb) and consists of two major open reading frames (ORFs) encoding the non-structural Rep (replication) and structural Cap (capsid) proteins. A second ORF within the cap gene was identified that encodes the assembly-activating protein (AAP). The DNAs flanking the AAV coding regions are two cis-acting inverted terminal repeat (ITR) sequences, approximately 145 nucleotides in length, with interrupted palindromic sequences that can be folded into energetically stable hairpin structures that function as primers of DNA replication. In addition to their role in DNA replication, the ITR sequences have been shown to be involved in viral DNA integration into the cellular genome, rescue from the host genome or plasmid, and encapsidation of viral nucleic acid into mature virions (Muzyczka, (1992) Curr. Top. Micro. Immunol. 158:97-129). In some embodiments, one or more Gene Writing™ nucleic acid components is flanked by ITRs derived from AAV for viral packaging. See, e.g., WO2019113310.

In some embodiments, one or more components of the Gene Writing™ system are carried via at least one AAV vector. In some embodiments, the at least one AAV vector is selected for tropism to a particular cell, tissue, organism. In some embodiments, the AAV vector is pseudotyped, e.g., AAV2/8, wherein AAV2 describes the design of the construct but the capsid protein is replaced by that from AAV8. It is understood that any of the described vectors could be pseudotype derivatives, wherein the capsid protein used to package the AAV genome is derived from that of a different AAV serotype. In some embodiments, an AAV to be employed for Gene Writing™ may be evolved for novel cell or tissue tropism as has been demonstrated in the literature (e.g., Davidsson et al. Proc Natl Acad Sci USA 2019).

In some embodiments, the AAV delivery vector is a vector which has two AAV inverted terminal repeats (ITRs) and a nucleotide sequence of interest (for example, a sequence coding for a Gene Writer™ polypeptide or a DNA template, or both), each of said ITRs having an interrupted (or noncontiguous) palindromic sequence, i.e., a sequence composed of three segments: a first segment and a last segment that are identical when read 5'→3' but hybridize when placed against each other, and a segment that is different that separates the identical segments. Such sequences, notably the ITRs, form hairpin structures. See, for example, WO2012123430.

Conventionally, AAV virions with capsids are produced by introducing a plasmid or plasmids encoding the rAAV or scAAV genome, Rep proteins, and Cap proteins (Grimm et al, 1998). Upon introduction of these helper plasmids in trans, the AAV genome is "rescued" (i.e., released and subsequently recovered) from the host genome, and is further encapsidated to produce infectious AAV. In some embodiments, one or more Gene Writing™ nucleic acids are packaged into AAV particles by introducing the ITR-flanked nucleic acids into a packaging cell in conjunction with the helper functions.

In some embodiments, the AAV genome is a so called self-complementary genome (referred to as scAAV), such that the sequence located between the ITRs contains both the desired nucleic acid sequence (e.g., DNA encoding the Gene Writer™ polypeptide or template, or both) in addition to the reverse complement of the desired nucleic acid sequence, such that these two components can fold over and self-hybridize. In some embodiments, the self-complementary modules are separated by an intervening sequence that permits the DNA to fold back on itself, e.g., forms a stem-loop. An scAAV has the advantage of being poised for transcription upon entering the nucleus, rather than being first dependent on ITR priming and second-strand synthesis to form dsDNA. In some embodiments, one or more Gene Writing™ components is designed as an scAAV, wherein the sequence between the AAV ITRs contains two reverse complementing modules that can self-hybridize to create dsDNA.

In some embodiments, nucleic acid (e.g., encoding a polypeptide, or a template, or both) delivered to cells is closed-ended, linear duplex DNA (CELID DNA or ceDNA). In some embodiments, ceDNA is derived from the replicative form of the AAV genome (Li et al. PLOS One 2013). In some embodiments, the nucleic acid (e.g., encoding a polypeptide, or a template DNA, or both) is flanked by ITRs, e.g., AAV ITRs, wherein at least one of the ITRs comprises a terminal resolution site and a replication protein binding site (sometimes referred to as a replicative protein binding site). In some embodiments, the ITRs are derived from an adeno-associated virus, e.g., AAV1, AAV2, AAV3, AAV4, AAV5, AAV6, AAV7, AAV8, AAV9, AAV10, AAV11, AAV12, or a combination thereof. In some embodiments, the ITRs are symmetric. In some embodiments, the ITRs are asymmetric. In some embodiments, at least one Rep protein is provided to enable replication of the construct. In some embodiments, the at least one Rep protein is derived from an adeno-associated virus, e.g., AAV1, AAV2, AAV3, AAV4, AAV5, AAV6, AAV7, AAV8, AAV9, AAV10, AAV11, AAV12, or a combination thereof. In some embodiments, ceDNA is generated by providing a production cell with (i) DNA flanked by ITRs, e.g., AAV ITRs, and (ii) components required for ITR-dependent replication, e.g., AAV proteins Rep78 and Rep52 (or nucleic acid encoding the proteins). In some embodiments, ceDNA is free of any capsid protein, e.g., is not packaged into an infectious AAV particle. In some embodiments, ceDNA is formulated into LNPs (see, for example, WO2019051289A1).

In some embodiments, the ceDNA vector consists of two self complementary sequences, e.g., asymmetrical or symmetrical or substantially symmetrical ITRs as defined herein, flanking said expression cassette, wherein the ceDNA vector is not associated with a capsid protein. In some embodiments, the ceDNA vector comprises two self-complementary sequences found in an AAV genome, where at least one ITR comprises an operative Rep-binding element (RBE) (also sometimes referred to herein as "RBS") and a terminal resolution site (trs) of AAV or a functional variant of the RBE. See, for example, WO2019113310.

Inteins

In some embodiments, as described in more detail below, Intein-N may be fused to the N-terminal portion of a first domain described herein, and and intein-C may be fused to the C-terminal portion of a second domain described herein for the joining of the N-terminal portion to the C-terminal portion, thereby joining the first and second domains. In some embodiments, the first and second domains are each independent chosen from a DNA binding domain, an RNA binding domain, an RT domain, and an endonuclease domain.

As used herein, "intein" refers to a self-splicing protein intron (e.g., peptide), e.g., which ligates flanking N-terminal and C-terminal exteins (e.g., fragments to be joined). An intein may, in some instances, comprise a fragment of a protein that is able to excise itself and join the remaining fragments (the exteins) with a peptide bond in a process known as protein splicing. Inteins are also referred to as "protein introns." The process of an intein excising itself and joining the remaining portions of the protein is herein termed "protein splicing" or "intein-mediated protein splicing." In some embodiments, an intein of a precursor protein (an intein containing protein prior to intein-mediated protein splicing) comes from two genes. Such intein is referred to herein as a split intein (e.g., split intein-N and split intein-C). For example, in cyanobacteria, DnaE, the catalytic subunit a of DNA polymerase III, is encoded by two separate genes, dnaE-n and dnaE-c. The intein encoded by the dnaE-n gene may be herein referred as "intein-N." The intein encoded by the dnaE-c gene may be herein referred as "intein-C."

Use of inteins for joining heterologous protein fragments is described, for example, in Wood et al., J. Biol. Chem. 289(21); 14512-9 (2014) (incorporated herein by reference in its entirety). For example, when fused to separate protein fragments, the inteins IntN and IntC may recognize each other, splice themselves out, and/or simultaneously ligate the flanking N- and C-terminal exteins of the protein fragments to which they were fused, thereby reconstituting a full-length protein from the two protein fragments.

In some embodiments, a synthetic intein based on the dnaE intein, the Cfa-N (e.g., split intein-N) and Cfa-C (e.g., split intein-C) intein pair, is used. Examples of such inteins have been described, e.g., in Stevens et al., J Am Chem Soc. 2016 Feb. 24; 138(7):2162-5 (incorporated herein by reference in its entirety). Non-limiting examples of intein pairs that may be used in accordance with the present disclosure include: Cfa DnaE intein, Ssp GyrB intein, Ssp DnaX intein, Ter DnaE3 intein, Ter ThyX intein, Rma DnaB intein and Cne Prp8 intein (e.g., as described in U.S. Pat. No. 8,394,604, incorporated herein by reference.

In some embodiments, Intein-N and intein-C may be fused to the N-terminal portion of the split Cas9 and the C-terminal portion of a split Cas9, respectively, for the joining of the N-terminal portion of the split Cas9 and the C-terminal portion of the split Cas9. For example, in some embodiments, an intein-N is fused to the C-terminus of the N-terminal portion of the split Cas9, i.e., to form a structure of N—[N-terminal portion of the split Cas9]-[intein-N]~C. In some embodiments, an intein-C is fused to the N-terminus of the C-terminal portion of the split Cas9, i.e., to form a structure of N-[intein-C]~[C-terminal portion of the split Cas9]-C. The mechanism of intein-mediated protein splicing for joining the proteins the inteins are fused to (e.g., split Cas9) is described in Shah et al., Chem Sci. 2014; 5(1):446-461, incorporated herein by reference. Methods for designing and using inteins are known in the art and described, for example by WO2020051561, WO2014004336, WO2017132580, US20150344549, and US20180127780, each of which is incorporated herein by reference in their entirety.

In some embodiments, a split refers to a division into two or more fragments. In some embodiments, a split Cas9 protein or split Cas9 comprises a Cas9 protein that is provided as an N-terminal fragment and a C-terminal fragment encoded by two separate nucleotide sequences. The polypeptides corresponding to the N-terminal portion and the C-terminal portion of the Cas9 protein may be spliced to form a reconstituted Cas9 protein. In embodiments, the Cas9 protein is divided into two fragments within a disordered region of the protein, e.g., as described in Nishimasu et al., Cell, Volume 156, Issue 5, pp. 935-949, 2014, or as described in Jiang et al. (2016) Science 351: 867-871 and PDB file: 5F9R (each of which is incorporated herein by reference in its entirety). A disordered region may be determined by one or more protein structure determination techniques known in the art, including, without limitation, X-ray crystallography, NMR spectroscopy, electron microscopy (e.g., cryoEM), and/or in silico protein modeling. In some embodiments, the protein is divided into two fragments at any C, T, A, or S, e.g., within a region of SpCas9 between amino acids A292-G364, F445-K483, or E565-T637, or at corresponding positions in any other Cas9, Cas9 variant (e.g., nCas9, dCas9), or other napDNAbp. In some embodiments, protein is divided into two fragments at SpCas9 T310, T313, A456, S469, or C574. In some embodiments, the process of dividing the protein into two fragments is referred to as splitting the protein.

In some embodiments, a protein fragment ranges from about 2-1000 amino acids (e.g., between 2-10, 10-50, 50-100, 100-200, 200-300, 300-400, 400-500, 500-600, 600-700, 700-800, 800-900, or 900-1000 amino acids) in length. In some embodiments, a protein fragment ranges from about 5-500 amino acids (e.g., between 5-10, 10-50, 50-100, 100-200, 200-300, 300-400, or 400-500 amino acids) in length. In some embodiments, a protein fragment ranges from about 20-200 amino acids (e.g., between 20-30, 30-40, 40-50, 50-100, or 100-200 amino acids) in length.

In some embodiments, a portion or fragment of a Gene Writer (e.g., Cas9-R2Tg) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein.

In some embodiments, an endonuclease domain (e.g., a nickase Cas9 domain) is fused to intein-N and a polypeptide comprising an RT domain is fused to an intein-C.

Exemplary nucleotide and amino acid sequences of interns are provided below:

```
DnaE Intein-N DNA:
                            (SEQ ID NO: 1611)
TGCCTGTCATACGAAACCGAGATACTGACAGTAGAATATG

GCCTTCTGCCAATCGGGAAGATTGTGGAGAAACGGATAGA

ATGCACAGTTTACTCTGTCGATAACAATGGTAACATTTAT

ACTCAGCCAGTTGCCCAGTGGCACGACCGGGGAGAGCAGG

AAGTATTCGAATACTGTCTGGAGGATGGAAGTCTCATTAG

GGCCACTAAGGACCACAAATTTATGACAGTCGATGGCCAG

ATGCTGCCTATAGACGAAATCTTTGAGCGAGAGTTGGACC

TCATGCGAGTTGACAACCTTCCTAAT

DnaE Intein-N Protein:
                            (SEQ ID NO: 1612)
CLSYETEILTVEYGLLPIGKIVEKRIECTVYSVDNNGNIY

TQPVAQWHDRGEQEVFEYCLEDGSLIRATKDHKFMTVDGQ

MLPIDEIFERELDLMRVDNLPN

DnaE Intein-C DNA:
                            (SEQ ID NO: 1613)
ATGATCAAGATAGCTACAAGGAAGTATCTTGGCAAACAAA
```

```
                        -continued
ACGTTTATGATATTGGAGTCGAAAGAGATCACAACTTTGC

TCTGAAGAACGGATTCATAGCTTCTAAT

Intein-C:
                                       (SEQ ID NO: 1614)
MIKIATRKYLGKQNVYDIGVERDHNFALKNGFIASN Cfa-N DNA:
                                       (SEQ ID NO: 1615)
TGCCTGTCTTATGATACCGAGATACTTACCGTTGAATATG

GCTTCTTGCCTATTGGAAAGATTGTCGAAGAGAGAATTGA

ATGCACAGTATATACTGTAGACAAGAATGGTTTCGTTTAC

ACACAGCCCATTGCTCAATGGCACAATCGCGGCGAACAAG

AAGTATTTGAGTACTGTCTCGAGGATGGAAGCATCATACG

AGCAACTAAAGATCATAAATTCATGACCACTGACGGGCAG

ATGTTGCCAATAGATGAGATATTCGAGCGGGGCTTGGATC

TCAAACAAGTGGATGGATTGCCA

Cfa-N Protein:
                                       (SEQ ID NO: 1616)
CLSYDTEILTVEYGFLPIGKIVEERIECTVYTVDKNGFVY

TQPIAQWHNRGEQEVFEYCLEDGSIIRATKDHKFMTTDGQ

MLPIDEIFERGLDLKQVDGLP

Cfa-C DNA:
                                       (SEQ ID NO: 1617)
ATGAAGAGGACTGCCGATGGATCAGAGTTTGAATCTCCCA

AGAAGAAGAGGAAAGTAAAGATAATATCTCGAAAAAGTCT

TGGTACCCAAAATGTCTATGATATTGGAGTGGAGAAAGAT

CACAACTTCCTTCTCAAGAACGGTCTCGTAGCCAGCAAC

Cfa-C Protein:
                                       (SEQ ID NO: 1618)
MKRTADGSEFESPKKKRKVKIISRKSLGTQNVYDIGVEKD

HNFLLKNGLVASN
```

Lipid Nanoparticles

The methods and systems provided by the invention, may employ any suitable carrier or delivery modality, including, in certain embodiments, lipid nanoparticles (LNPs). Lipid nanoparticles, in some embodiments, comprise one or more ionic lipids, such as non-cationic lipids (e.g., neutral or anionic, or zwitterionic lipids); one or more conjugated lipids (such as PEG-conjugated lipids or lipids conjugated to polymers described in Table 5 of WO2019217941; incorporated herein by reference in its entirety); one or more sterols (e.g., cholesterol); and, optionally, one or more targeting molecules (e.g., conjugated receptors, receptor ligands, antibodies); or combinations of the foregoing.

Lipids that can be used in nanoparticle formations (e.g., lipid nanoparticles) include, for example those described in Table 4 of WO2019217941, which is incorporated by reference—e.g., a lipid-containing nanoparticle can comprise one or more of the lipids in table 4 of WO2019217941. Lipid nanoparticles can include additional elements, such as polymers, such as the polymers described in table 5 of WO2019217941, incorporated by reference.

In some embodiments, conjugated lipids, when present, can include one or more of PEG-diacylglycerol (DAG) (such as 1-(monomethoxy-polyethyleneglycol)-2,3-dimyristoylglycerol (PEG-DMG)), PEG-dialkyloxypropyl (DAA), PEG-phospholipid, PEG-ceramide (Cer), a pegylated phosphatidylethanoloamine (PEG-PE), PEG succinate diacylglycerol (PEGS-DAG) (such as 4-O-(2',3'-di(tetradecanoyloxy)propyl-1-O-(w-methoxy(polyethoxy)ethyl) butanedioate (PEG-S-DMG)), PEG dialkoxypropylcarbam, N-(carbonyl-methoxypoly ethylene glycol 2000)-1,2-distearoyl-sn-glycero-3-phosphoethanolamine sodium salt, and those described in Table 2 of WO2019051289 (incorporated by reference), and combinations of the foregoing.

In some embodiments, sterols that can be incorporated into lipid nanoparticles include one or more of cholesterol or cholesterol derivatives, such as those in WO2009/127060 or US2010/0130588, which are incorporated by reference. Additional exemplary sterols include phytosterols, including those described in Eygeris et al (2020), dx.doi.org/10.1021/acs.nanolett.0c01386, incorporated herein by reference.

In some embodiments, the lipid particle comprises an ionizable lipid, a non-cationic lipid, a conjugated lipid that inhibits aggregation of particles, and a sterol. The amounts of these components can be varied independently and to achieve desired properties. For example, in some embodiments, the lipid nanoparticle comprises an ionizable lipid is in an amount from about 20 mol % to about 90 mol % of the total lipids (in other embodiments it may be 20-70% (mol), 30-60% (mol) or 40-50% (mol); about 50 mol % to about 90 mol % of the total lipid present in the lipid nanoparticle), a non-cationic lipid in an amount from about 5 mol % to about 30 mol % of the total lipids, a conjugated lipid in an amount from about 0.5 mol % to about 20 mol % of the total lipids, and a sterol in an amount from about 20 mol % to about 50 mol % of the total lipids. The ratio of total lipid to nucleic acid (e.g., encoding the Gene Writer or template nucleic acid) can be varied as desired. For example, the total lipid to nucleic acid (mass or weight) ratio can be from about 10:1 to about 30:1.

In some embodiments, an ionizable lipid may be a cationic lipid, an ionizable cationic lipid, e.g., a cationic lipid that can exist in a positively charged or neutral form depending on pH, or an amine-containing lipid that can be readily protonated. In some embodiments, the cationic lipid is a lipid capable of being positively charged, e.g., under physiological conditions. Exemplary cationic lipids include one or more amine group(s) which bear the positive charge. In some embodiments, the lipid particle comprises a cationic lipid in formulation with one or more of neutral lipids, ionizable amine-containing lipids, biodegradable alkyn lipids, steroids, phospholipids including polyunsaturated lipids, structural lipids (e.g., sterols), PEG, cholesterol and polymer conjugated lipids. In some embodiments, the cationic lipid may be an ionizable cationic lipid. An exemplary cationic lipid as disclosed herein may have an effective pKa over 6.0. In embodiments, a lipid nanoparticle may comprise a second cationic lipid having a different effective pKa (e.g., greater than the first effective pKa), than the first cationic lipid. A lipid nanoparticle may comprise between 40 and 60 mol percent of a cationic lipid, a neutral lipid, a steroid, a polymer conjugated lipid, and a therapeutic agent, e.g., a nucleic acid (e.g., RNA) described herein (e.g., a template nucleic acid or a nucleic acid encoding a GeneWriter), encapsulated within or associated with the lipid nanoparticle. In some embodiments, the nucleic acid is co-formulated with the cationic lipid. The nucleic acid may be adsorbed to the surface of an LNP, e.g., an LNP comprising a cationic lipid. In some embodiments, the nucleic acid may be encapsulated in an LNP, e.g., an LNP comprising a cationic lipid. In some embodiments, the lipid nanoparticle may comprise a targeting moiety, e.g., coated with a targeting agent. In embodiments, the LNP formulation is biodegradable. In some embodiments, a lipid nanoparticle comprising one or more lipid described herein, e.g., Formula (i), (ii), (ii), (vii) and/or (ix) encapsulates at least 1%, at least 5%, at least 10%, at least 20%, at least 30%, at least 40%, at least 50%, at least 60%, at least 70%, at least 80%, at least 90%, at least 92%, at least 95%, at least 97%, at least 98% or 100% of an RNA molecule, e.g., template RNA and/or a mRNA encoding the Gene Writer polypeptide.

In some embodiments, the lipid to nucleic acid ratio (mass/mass ratio; w/w ratio) can be in the range of from about 1:1 to about 25:1, from about 10:1 to about 14:1, from about 3:1 to about 15:1, from about 4:1 to about 10:1, from about 5:1 to about 9:1, or about 6:1 to about 9:1. The amounts of lipids and nucleic acid can be adjusted to provide a desired N/P ratio, for example, N/P ratio of 3, 4, 5, 6, 7, 8, 9, 10 or higher. Generally, the lipid nanoparticle formulation's overall lipid content can range from about 5 mg/ml to about 30 mg/mL.

Exemplary ionizable lipids that can be used in lipid nanoparticle formulations include, without limitation, those listed in Table 1 of WO2019051289, incorporated herein by reference. Additional exemplary lipids include, without limitation, one or more of the following formulae: X of US2016/0311759; I of US20150376115 or in US2016/0376224; I, II or III of US20160151284; I, IA, II, or IIA of US20170210967; I-c of US20150140070; A of US2013/0178541; I of US2013/0303587 or US2013/0123338; I of US2015/0141678; II, III, IV, or V of US2015/0239926; I of US2017/0119904; I or II of WO2017/117528; A of US2012/0149894; A of US2015/0057373; A of WO2013/116126; A of US2013/0090372; A of US2013/0274523; A of US2013/0274504; A of US2013/0053572; A of WO2013/016058; A of WO2012/162210; I of US2008/042973; I, II, III, or IV of US2012/01287670; I or II of US2014/0200257; I, II, or III of US2015/0203446; I or III of US2015/0005363; I, IA, IB, IC, ID, II, IIA, IIB, IIC, IID, or III-XXIV of US2014/0308304; of US2013/0338210; I, II, III, or IV of WO2009/132131; A of US2012/01011478; I or XXXV of US2012/0027796; XIV or XVII of US2012/0058144; of US2013/0323269; I of US2011/0117125; I, II, or III of US2011/0256175; I, II, III, IV, V, VI, VII, VIII, IX, X, XI, XII of US2012/0202871; I, II, III, IV, V, VI, VII, VIII, X, XII, XIII, XIV, XV, or XVI of US2011/0076335; I or II of US2006/008378; I of US2013/0123338; I or X-A-Y-Z of US2015/0064242; XVI, XVII, or XVIII of US2013/0022649; I, II, or III of US2013/0116307; I, II, or III of US2013/0116307; I or II of US2010/0062967; I-X of US2013/0189351; I of US2014/0039032; V of US2018/0028664; I of US2016/0317458; I of US2013/0195920; 5, 6, or 10 of U.S. Pat. No. 10,221,127; III-3 of WO2018/081480; I-5 or 1-8 of WO2020/081938; 18 or 25 of U.S. Pat. No. 9,867,888; A of US2019/0136231; II of WO2020/219876; 1 of US2012/0027803; OF-02 of US2019/0240349; 23 of U.S. Pat. No. 10,086,013; cKK-E12/A6 of Miao et al (2020); C12-200 of WO2010/053572; 7C1 of Dahlman et al (2017); 304-013 or 503-013 of Whitehead et al; TS-P4C2 of U.S. Pat. No. 9,708,628; I of WO2020/106946; I of WO2020/106946.

In some embodiments, the ionizable lipid is MC3 (6Z, 9Z,28Z,31Z)-heptatriaconta-6,9,28,31-tetraen-19-yl-4-(dimethylamino) butanoate (DLin-MC3-DMA or MC3), e.g., as described in Example 9 of WO2019051289A9 (incorporated by reference herein in its entirety). In some embodiments, the ionizable lipid is the lipid ATX-002, e.g., as described in Example 10 of WO2019051289A9 (incorporated by reference herein in its entirety). In some embodiments, the ionizable lipid is (13Z,16Z)-A,A-dimethyl-3-nonyldocosa-13, 16-dien-1-amine (Compound 32), e.g., as described in Example 11 of WO2019051289A9 (incorporated by reference herein in its entirety). In some embodiments, the ionizable lipid is Compound 6 or Compound 22, e.g., as described in Example 12 of WO2019051289A9 (incorporated by reference herein in its entirety). In some embodiments, the ionizable lipid is heptadecan-9-yl 8-((2-hydroxyethyl)(6-oxo-6-(undecyloxy)hexyl)amino)octanoate (SM-102); e.g., as described in Example 1 of U.S. Pat. No. 9,867,888 (incorporated by reference herein in its entirety). In some embodiments, the ionizable lipid is 9Z,12Z)-3-((4,4-bis(octyloxy)butanoyl)oxy)-2-((((3-(diethylamino)propoxy)carbonyl)oxy)methyl)propyl octadeca-9, 12-dienoate (LP01) e.g., as synthesized in Example 13 of WO2015/095340 (incorporated by reference herein in its entirety). In some embodiments, the ionizable lipid is Di((Z)-non-2-en-1-yl) 9-((4-dimethylamino)butanoyl)oxy) heptadecanedioate (L319), e.g. as synthesized in Example 7, 8, or 9 of US2012/0027803 (incorporated by reference herein in its entirety). In some embodiments, the ionizable lipid is 1,1'-((2-(4-(2-((2-(Bis(2-hydroxydodecyl)amino) ethyl)(2-hydroxydodecyl) amino)ethyl)piperazin-1-yl) ethyl)azanediyl)bis(dodecan-2-ol) (C12-200), e.g., as synthesized in Examples 14 and 16 of WO2010/053572 (incorporated by reference herein in its entirety). In some embodiments, the ionizable lipid is; Imidazole cholesterol ester (ICE) lipid (3S,10R,13R,17R)-10,13-dimethyl-17-((R)-6-methylheptan-2-yl)-2,3,4,7,8,9,10,11,12,13,14,15, 16,17-tetradecahydro-1H-cyclopenta[a]phenanthren-3-yl 3-(1H-imidazol-4-yl)propanoate, e.g., Structure (I) from WO2020/106946 (incorporated by reference herein in its entirety).

Some non-limiting example of lipid compounds that may be used (e.g., in combination with other lipid components) to form lipid nanoparticles for the delivery of compositions described herein, e.g., nucleic acid (e.g., RNA) described herein (e.g., a template nucleic acid or a nucleic acid encoding a GeneWriter) includes,

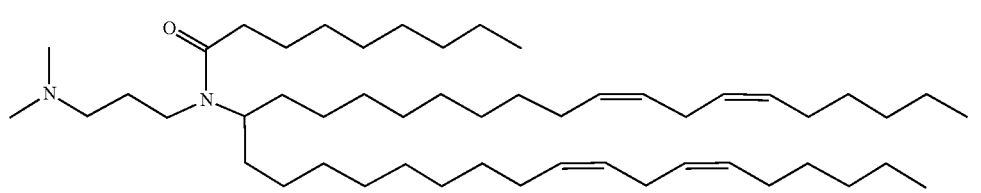

(i)

In some embodiments an LNP comprising Formula (i) is used to deliver a GeneWriter composition described herein to the liver and/or hepatocyte cells.

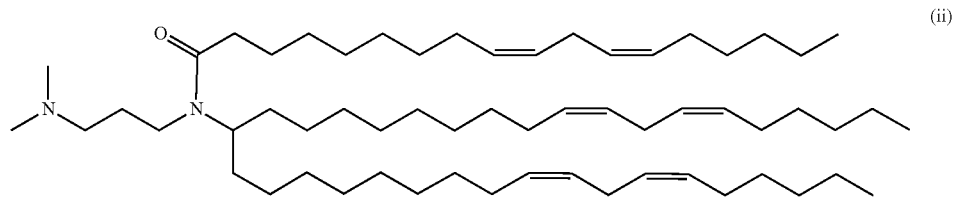 [SMILES: CCCCC/C=C\C/C=C\CCCCCCCCC(CCCCCCCC/C=C\C/C=C\CCCCC)N(CCCN(C)C)C(=O)CCCCCCC/C=C\C/C=C\CCCCC]
(ii)

In some embodiments an LNP comprising Formula (ii) is used to deliver a GeneWriter composition described herein to the liver and/or hepatocyte cells.

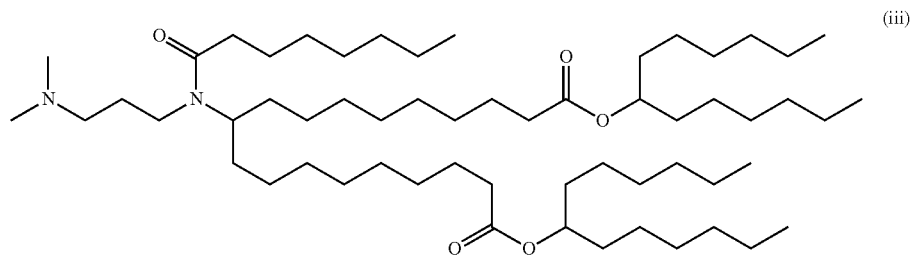 [SMILES: CCCCCCCC(=O)N(CCCN(C)C)C(CCCCCCCCC(=O)OC(CCCCCC)CCCCCC)CCCCCCCCC(=O)OC(CCCCCC)CCCCCC]
(iii)

In some embodiments an LNP comprising Formula (iii) is used to deliver a GeneWriter composition described herein to the liver and/or hepatocyte cells.

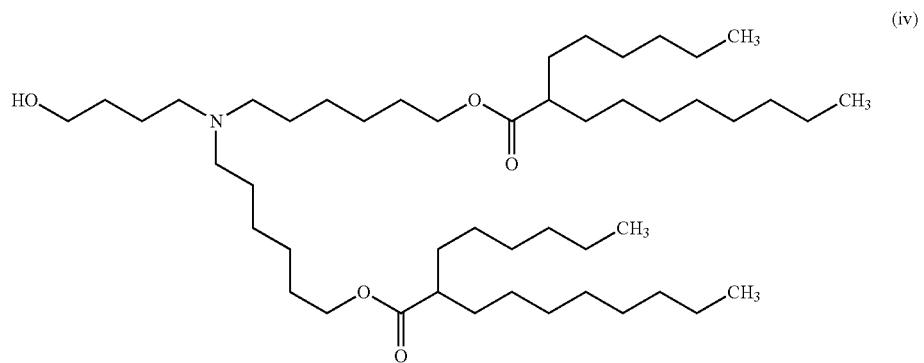
(iv)

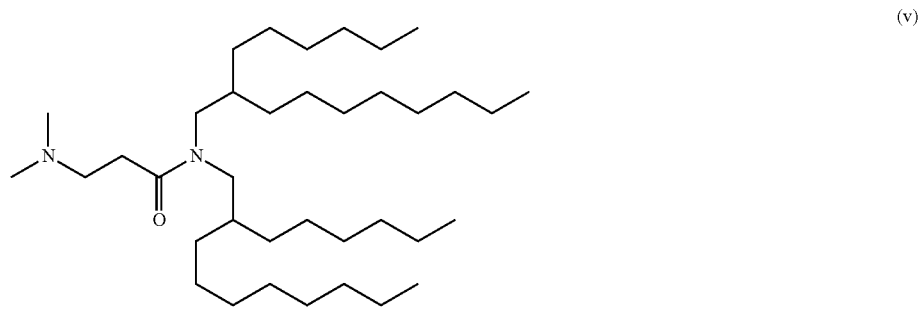
(v)

In some embodiments an LNP comprising Formula (v) is used to deliver a GeneWriter composition described herein to the liver and/or hepatocyte cells.

(vi)

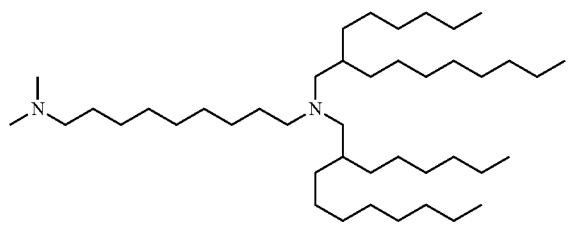

In some embodiments an LNP comprising Formula (vi) is used to deliver a GeneWriter composition described herein to the liver and/or hepatocyte cells.

(vii)

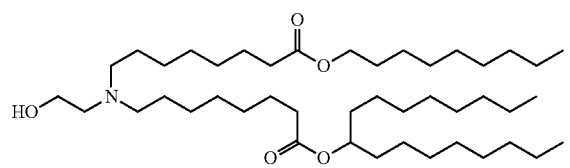

(viii)

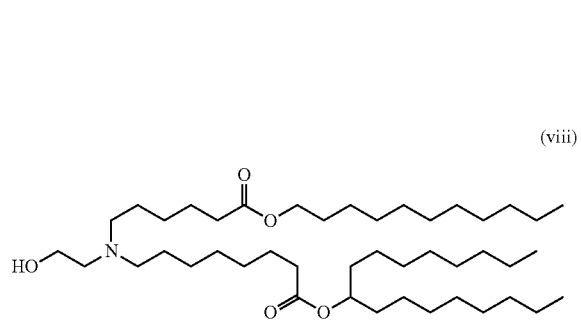

In some embodiments an LNP comprising Formula (viii) is used to deliver a GeneWriter composition described herein to the liver and/or hepatocyte cells.

In some embodiments an LNP comprising Formula (ix) is used to deliver a GeneWriter composition described herein to the liver and/or hepatocyte cells.

(x)

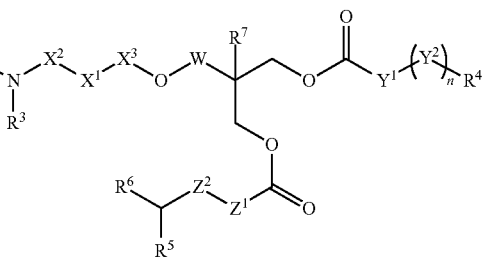

wherein $X^1$ is O, $NR^1$, or a direct bond, $X^2$ is C2-5 alkylene, $X^3$ is C(=O) or a direct bond, $R^1$ is H or Me, $R^3$ is Ci-3 alkyl, $R^2$ is Ci-3 alkyl, or $R^2$ taken together with the nitrogen atom to which it is attached and 1-3 carbon atoms of $X^2$ form a 4-, 5-, or 6-membered ring, or $X^1$ is $NR^1$, $R^1$ and $R^2$ taken together with the nitrogen atoms to which they are attached form a 5- or 6-membered ring, or $R^2$ taken together with $R^3$ and the nitrogen atom to which they are attached form a 5-, 6-, or 7-membered ring, $Y^1$ is C2-12 alkylene, $Y^2$ is selected from

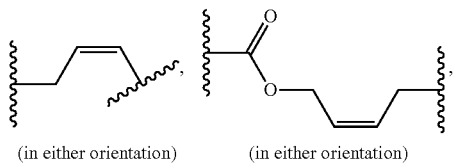

(in either orientation)    (in either orientation)

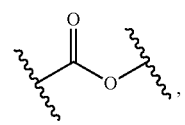

(in either orientation)

n is 0 to 3, R4 is Ci-15 alkyl, $Z^1$ is Ci-6 alkylene or a direct bond, (ix)

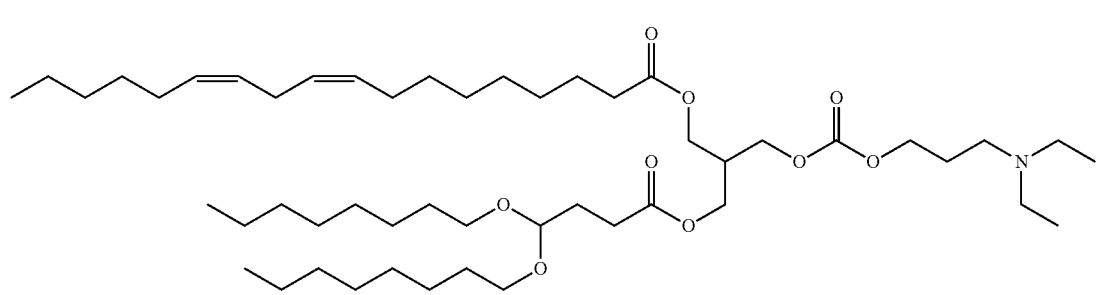

$Z^2$ is

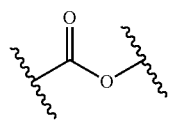 [SMILES: *OC(*)=O]

(in either orientation) or absent, provided that if $Z^1$ is a direct bond, $Z^2$ is absent;

$R^5$ is C5-9 alkyl or C6-10 alkoxy, $R^6$ is C5-9 alkyl or C6-10 alkoxy, W is methylene or a direct. bond, and $R^7$ is H or Me, or a salt thereof, provided that if $R^3$ and $R^2$ are C2 alkyls, $X^1$ is O, $X^2$ is linear C3 alkylene, $X^3$ is C(=O), $Y^1$ is linear Ce alkylene, $(Y^2)n-R^4$ is

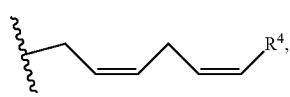

$R^4$ is linear C5 alkyl, Z' is C2 alkylene, $Z^2$ is absent, W is methylene, and $R^7$ is H, then $R^5$ and $R^6$ are not Cx alkoxy.

In some embodiments an LNP comprising Formula (xii) is used to deliver a GeneWriter composition described herein to the liver and/or hepatocyte cells.

(xi)

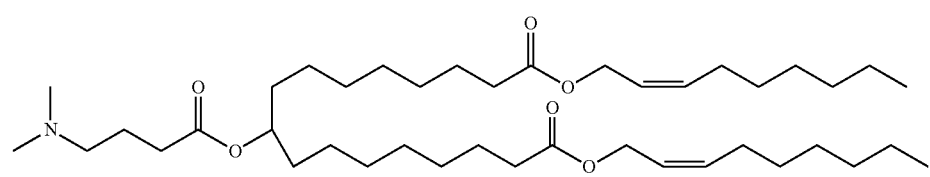

In some embodiments an LNP comprising Formula (xi) is used to deliver a GeneWriter composition described herein to the liver and/or hepatocyte cells.

(xii)

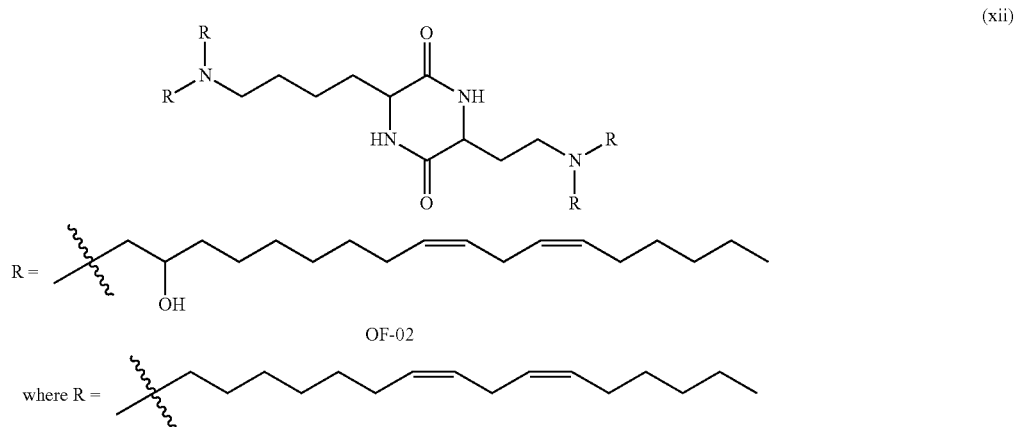

OF-02

(xiii)

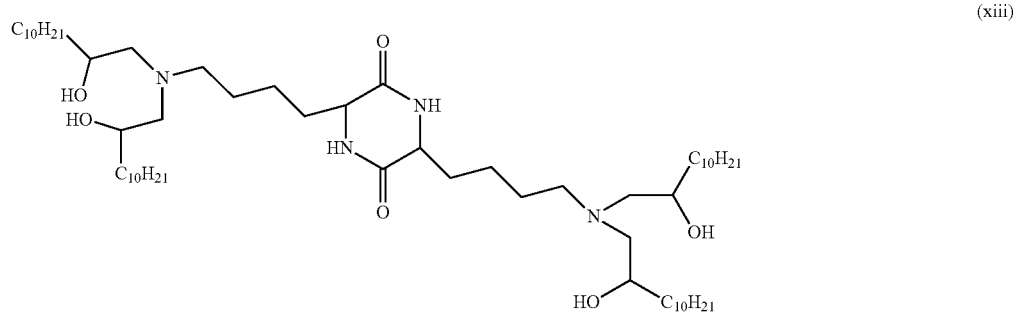

(xiv)

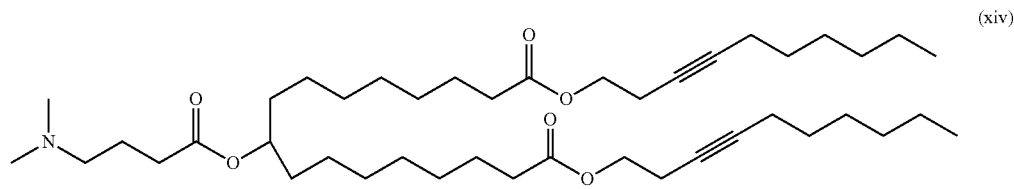

In some embodiments an LNP comprises a compound of Formula (xiii) and a compound of Formula (xiv).

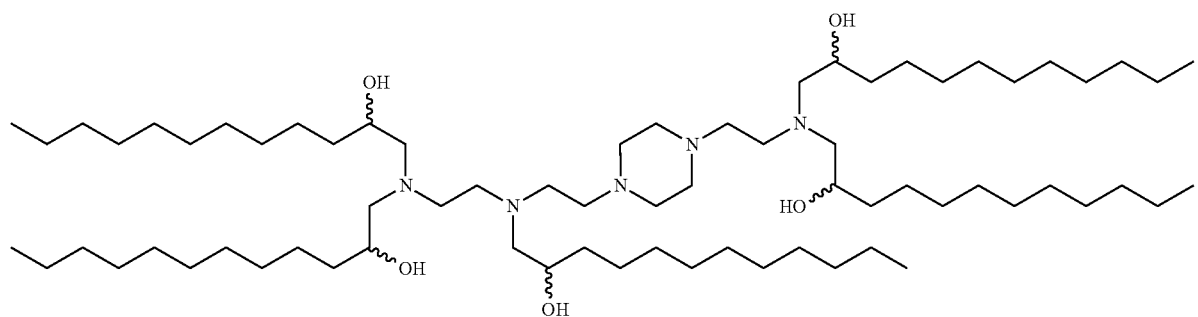

(xv)

In some embodiments an LNP comprising Formula (xv) is used to deliver a Gene Writer composition described herein to the liver and/or hepatocyte cells.

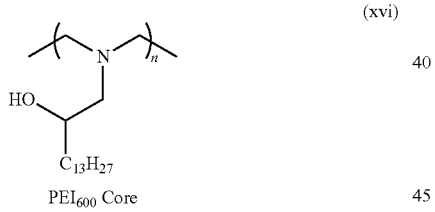

(xvi)

In some embodiments an LNP comprising a formulation of Formula (xvi) is used to deliver a Gene Writer composition described herein to the lung endothelial cells.

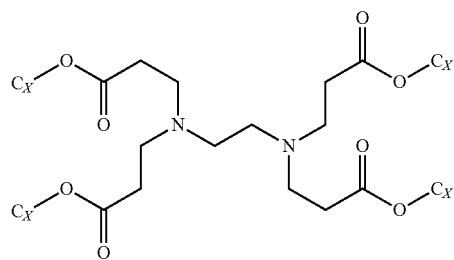

(xvii)

-continued
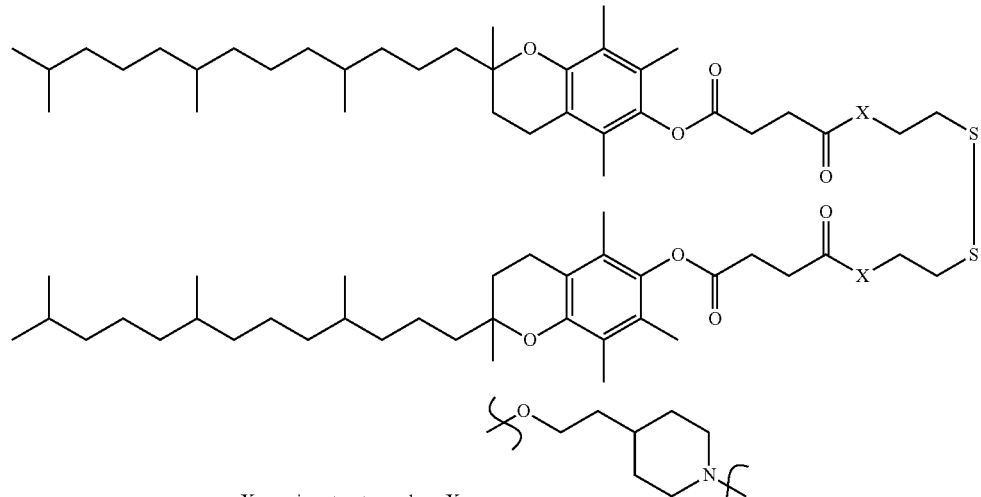
(xviii)(a)
X = amino structure where X =
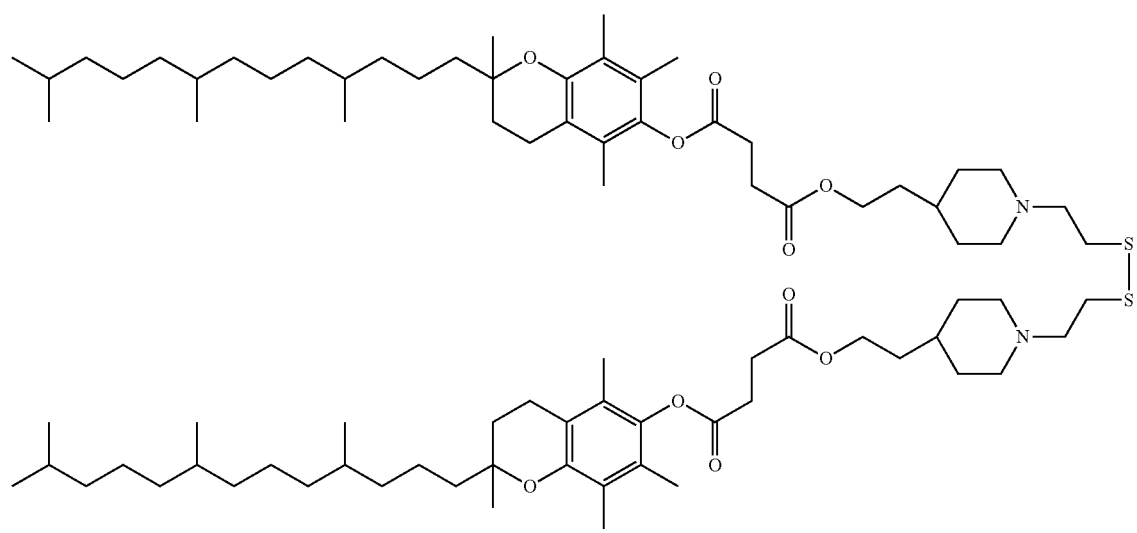
(xviii)(b)
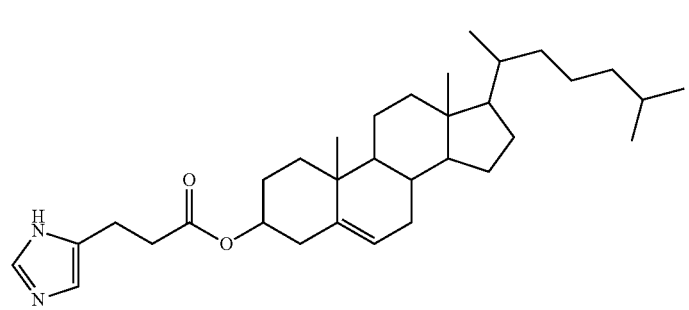
(xix)

In some embodiments, a lipid compound used to form lipid nanoparticles for the delivery of compositions described herein, e.g., nucleic acid (e.g., RNA) described herein (e.g., a template nucleic acid or a nucleic acid encoding a GeneWriter) is made by one of the following reactions:

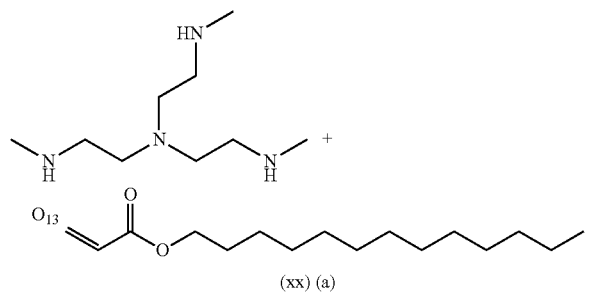

(xx) (a)

lysophosphatidylethanolamine, phosphatidylserine, phosphatidylinositol, sphingomyelin, egg sphingomyelin (ESM), cephalin, cardiolipin, phosphatidicacid, cerebrosides, dicetylphosphate, lysophosphatidylcholine, dilinoleoylphosphatidylcholine, or mixtures thereof. It is understood that other diacylphosphatidylcholine and diacylphosphatidylethanolamine phospholipids can also be used. The acyl groups in these lipids are preferably acyl groups derived from fatty acids having C10-C24 carbon chains, e.g., lauroyl, myristoyl, paimitoyl, stearoyl, or oleoyl. Additional exemplary lipids, in certain embodiments, include, without limitation, those described in Kim et al. (2020) dx.doi.org/10.1021/acs.nanolett.0c01386, incorporated herein by reference. Such lipids include, in some embodiments, plant lipids found to improve liver transfection with mRNA (e.g., DGTS In some embodiments, the non-cationic lipid may have the following structure,

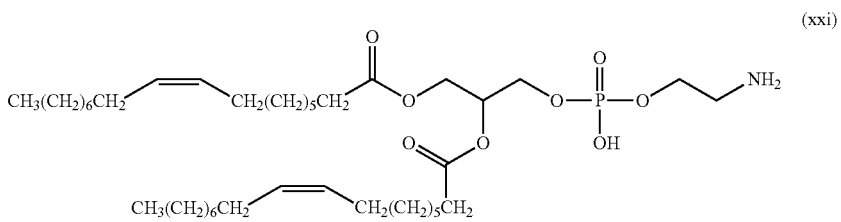

(xxi)

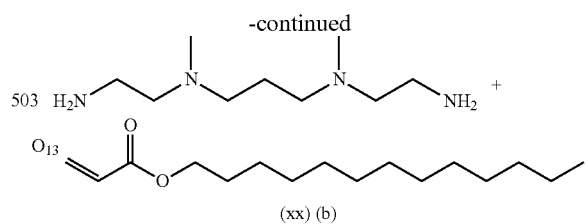

(xx) (b)

Exemplary non-cationic lipids include, but are not limited to, distearoyl-sn-glycero-phosphoethanolamine, distearoylphosphatidylcholine (DSPC), dioleoylphosphatidylcholine (DOPC), dipalmitoylphosphatidylcholine (DPPC), dioleoylphosphatidylglycerol (DOPG), 1,2-dioleoyl-sn-glycero-3-phosphoethanolamine (DOPE), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidylethanolamine (DSPE), monomethyl-phosphatidylethanolamine (such as 16-O-monomethyl PE), dimethyl-phosphatidylethanolamine (such as 16-O-dimethyl PE), 18-1-trans PE, 1-stearoyl-2-oleoyl-phosphatidyethanolamine (SOPE), hydrogenated soy phosphatidylcholine (HSPC), egg phosphatidylcholine (EPC), dioleoylphosphatidylserine (DOPS), sphingomyelin (SM), dimyristoyl phosphatidylcholine (DMPC), dimyristoyl phosphatidylglycerol (DMPG), distearoylphosphatidylglycerol (DSPG), dierucoylphosphatidylcholine (DEPC), palmitoyloleoylphosphatidylglycerol (POPG), dielaidoyl-phosphatidylethanolamine (DEPE), lecithin, phosphatidylethanolamine, lysolecithin, Other examples of non-cationic lipids suitable for use in the lipid nanopartieles include, without limitation, nonphosphorous lipids such as, e.g., stearylamine, dodeeylamine, hexadecylamine, acetyl palmitate, glycerol ricinoleate, hexadecyl stereate, isopropyl myristate, amphoteric acrylic polymers, triethanolamine-lauryl sulfate, alkyl-aryl sulfate polyethyloxylated fatty acid amides, dioctadecyl dimethyl ammonium bromide, ceramide, sphingomyelin, and the like. Other non-cationic lipids are described in WO2017/099823 or US patent publication US2018/0028664, the contents of which is incorporated herein by reference in their entirety.

In some embodiments, the non-cationic lipid is oleic acid or a compound of Formula I, II, or IV of US2018/0028664, incorporated herein by reference in its entirety. The non-cationic lipid can comprise, for example, 0-30% (mol) of the total lipid present in the lipid nanoparticle. In some embodiments, the non-cationic lipid content is 5-20% (mol) or 10-15% (mol) of the total lipid present in the lipid nanoparticle. In embodiments, the molar ratio of ionizable lipid to the neutral lipid ranges from about 2:1 to about 8:1 (e.g., about 2:1, 3:1, 4:1, 5:1, 6:1, 7:1, or 8:1).

In some embodiments, the lipid nanoparticles do not comprise any phospholipids.

In some aspects, the lipid nanoparticle can further comprise a component, such as a sterol, to provide membrane integrity. One exemplary sterol that can be used in the lipid nanoparticle is cholesterol and derivatives thereof. Non-limiting examples of cholesterol derivatives include polar analogues such as 5a-choiestanol, 53-coprostanol, choiesteryl-(2'-hydroxy)-ethyl ether, choiesteryl-(4'-hydroxy)-butyl ether, and 6-ketocholestanol; non-polar analogues such as 5a-cholestane, cholestenone, 5a-cholestanone, 5p-cholestanone, and cholesteryl decanoate; and mixtures thereof. In some embodiments, the cholesterol derivative is a polar analogue, e.g., choiesteryl-(4'-hydroxy)-butyl ether.

Exemplary cholesterol derivatives are described in PCT publication WO2009/127060 and US patent publication US2010/0130588, each of which is incorporated herein by reference in its entirety.

In some embodiments, the component providing membrane integrity, such as a sterol, can comprise 0-50% (mol) (e.g., 0-10%, 10-20%, 20-30%, 30-40%, or 40-50%) of the total lipid present in the lipid nanoparticle. In some embodiments, such a component is 20-50% (mol) 30-40% (mol) of the total lipid content of the lipid nanoparticle.

In some embodiments, the lipid nanoparticle can comprise a polyethylene glycol (PEG) or a conjugated lipid molecule. Generally, these are used to inhibit aggregation of lipid nanoparticles and/or provide steric stabilization. Exemplary conjugated lipids include, but are not limited to, PEG-lipid conjugates, polyoxazoline (POZ)-lipid conjugates, polyamide-lipid conjugates (such as ATTA-lipid conjugates), cationic-polymer lipid (CPL) conjugates, and mixtures thereof. In some embodiments, the conjugated lipid molecule is a PEG-lipid conjugate, for example, a (methoxy polyethylene glycol)-conjugated lipid.

Exemplary PEG-lipid conjugates include, but are not limited to, PEG-diacylglycerol (DAG) (such as 1-(monomethoxy-polyethyleneglycol)-2,3-dimyristoylglycerol (PEG-DMG)), PEG-dialkyloxypropyl (DAA), PEG-phospholipid, PEG-ceramide (Cer), a pegylated phosphatidylethanoloamine (PEG-PE), 1,2-dimyristoyl-sn-glycerol, methoxypoly ethylene glycol (DMG-PEG-2K), PEG succinate diacylglycerol (PEGS-DAG) (such as 4-0-(2',3'-di(tetradecanoyloxy)propyl-1-0-(w-methoxy(polyethoxy)ethyl) butanedioate (PEG-S-DMG)), PEG dialkoxypropylcarbam, N-(carbonyl-methoxypolyethylene glycol 2000)-1,2-distearoyl-sn-glycero-3-phosphoethanolamine sodium salt, or a mixture thereof. Additional exemplary PEG-lipid conjugates are described, for example, in U.S. Pat. Nos. 5,885,613, 6,287,591, US2003/0077829, US2003/0077829, US2005/0175682, US2008/0020058, US2011/0117125, US2010/0130588, US2016/0376224, US2017/0119904, and US/099823, the contents of all of which are incorporated herein by reference in their entirety. In some embodiments, a PEG-lipid is a compound of Formula III, III-a-I, III-a-2, III-b-1, III-b-2, or V of US2018/0028664, the content of which is incorporated herein by reference in its entirety. In some embodiments, a PEG-lipid is of Formula II of US20150376115 or US2016/0376224, the content of both of which is incorporated herein by reference in its entirety. In some embodiments, the PEG-DAA conjugate can be, for example, PEG-dilauryloxypropyl, PEG-dimyristyloxypropyl, PEG-dipalmityloxypropyl, or PEG-distearyloxypropyl. The PEG-lipid can be one or more of PEG-DMG, PEG-dilaurylglycerol, PEG-dipalmitoylglycerol, PEG-disterylglycerol, PEG-dilaurylglycamide, PEG-dimyristylglycamide, PEG-dipalmitoylglycamide, PEG-disterylglycamide, PEG-cholesterol (1-[8'-(Cholest-5-en-3 [beta]-oxy)carboxamido-3',6'-dioxaoctanyl] carbamoyl-[omega]-methyl-poly(ethylene glycol), PEG-DMB (3,4-Ditetradecoxylbenzyl-[omega]-methyl-poly(ethylene glycol) ether), and 1,2-dimyristoyl-sn-glycero-3-phosphoethanolamine-N-[methoxy(polyethylene glycol)-2000]. In some embodiments, the PEG-lipid comprises PEG-DMG, 1,2-dimyristoyl-sn-glycero-3-phosphoethanolamine-N-[methoxy(polyethylene glycol)-2000]. In some embodiments, the PEG-lipid comprises a structure selected from:

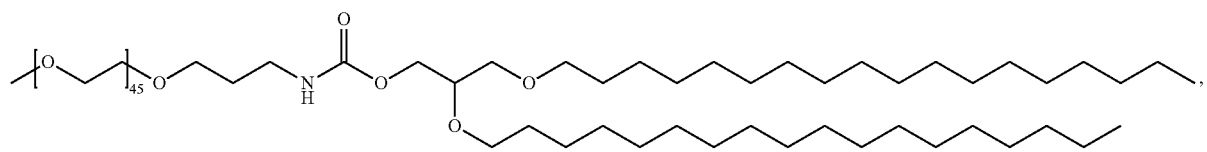

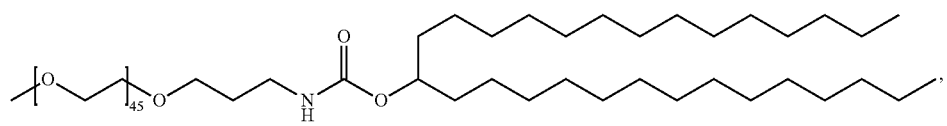

(xxii)

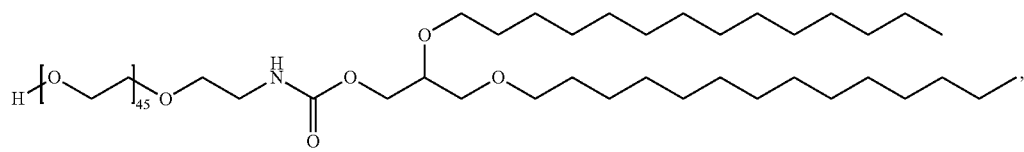

(xxiii)

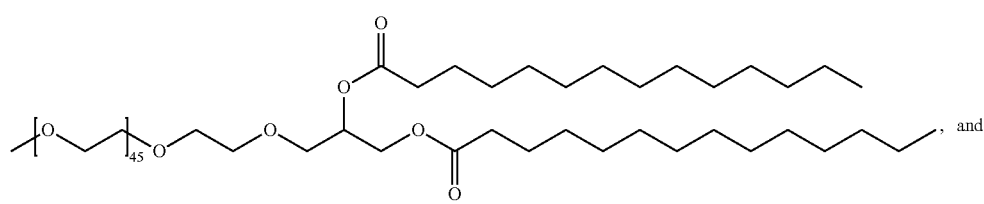

, and (xxiv)

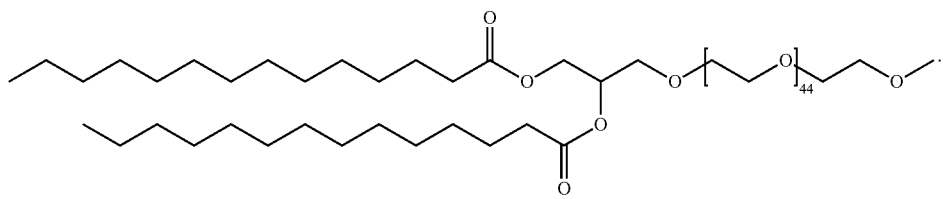

(xxv)

In some embodiments, lipids conjugated with a molecule other than a PEG can also be used in place of PEG-lipid. For example, polyoxazoline (POZ)-lipid conjugates, polyamide-lipid conjugates (such as ATTA-lipid conjugates), and cationic-polymer lipid (GPL) conjugates can be used in place of or in addition to the PEG-lipid.

Exemplary conjugated lipids, i.e., PEG-lipids, (POZ)-lipid conjugates, ATTA-lipid conjugates and cationic polymer-lipids are described in the PCT and LIS patent applications listed in Table 2 of WO2019051289A9 and in WO2020106946A1, the contents of all of which are incorporated herein by reference in their entirety.

In some embodiments an LNP comprises a compound of Formula (xix), a compound of Formula (xxi) and a compound of Formula (xxv). In some embodiments a LNP comprising a formulation of Formula (xix), Formula (xxi) and Formula (xxv) is used to deliver a GeneWriter composition described herein to the lung or pulmonary cells.

In some embodiments, the PEG or the conjugated lipid can comprise 0-20% (mol) of the total lipid present in the lipid nanoparticle. In some embodiments, PEG or the conjugated lipid content is 0.5-10% or 2-5% (mol) of the total lipid present in the lipid nanoparticle. Molar ratios of the ionizable lipid, non-cationic-lipid, sterol, and PEG/conjugated lipid can be varied as needed. For example, the lipid particle can comprise 30-70% ionizable lipid by mole or by total weight of the composition, 0-60% cholesterol by mole or by total weight of the composition, 0-30% non-cationic-lipid by mole or by total weight of the composition and 1-10% conjugated lipid by mole or by total weight of the composition. Preferably, the composition comprises 30-40% ionizable lipid by mole or by total weight of the composition, 40-50% cholesterol by mole or by total weight of the composition, and 10-20% non-cationic-lipid by mole or by total weight of the composition. In some other embodiments, the composition is 50-75% ionizable lipid by mole or by total weight of the composition, 20-40% cholesterol by mole or by total weight of the composition, and 5 to 10% non-cationic-lipid, by mole or by total weight of the composition and 1-10% conjugated lipid by mole or by total weight of the composition. The composition may contain 60-70% ionizable lipid by mole or by total weight of the composition, 25-35% cholesterol by mole or by total weight of the composition, and 5-10% non-cationic-lipid by mole or by total weight of the composition. The composition may also contain up to 90% ionizable lipid by mole or by total weight of the composition and 2 to 15% non-cationic lipid by mole or by total weight of the composition. The formulation may also be a lipid nanoparticle formulation, for example comprising 8-30% ionizable lipid by mole or by total weight of the composition, 5-30% non-cationic lipid by mole or by total weight of the composition, and 0-20% cholesterol by mole or by total weight of the composition; 4-25% ionizable lipid by mole or by total weight of the composition, 4-25% non-cationic lipid by mole or by total weight of the composition, 2 to 25% cholesterol by mole or by total weight of the composition, 10 to 35% conjugate lipid by mole or by total weight of the composition, and 5% cholesterol by mole or by total weight of the composition; or 2-30% ionizable lipid by mole or by total weight of the composition, 2-30% non-cationic lipid by mole or by total weight of the composition, 1 to 15% cholesterol by mole or by total weight of the composition, 2 to 35% conjugate lipid by mole or by total weight of the composition, and 1-20% cholesterol by mole or by total weight of the composition; or even up to 90% ionizable lipid by mole or by total weight of the composition and 2-10% non-cationic lipids by mole or by total weight of the composition, or even 100% cationic lipid by mole or by total weight of the composition. In some embodiments, the lipid particle formulation comprises ionizable lipid, phospholipid, cholesterol and a PEG-ylated lipid in a molar ratio of 50:10:38.5:1.5. In some other embodiments, the lipid particle formulation comprises ionizable lipid, cholesterol and a PEG-ylated lipid in a molar ratio of 60:38.5:1.5.

In some embodiments, the lipid particle comprises ionizable lipid, non-cationic lipid (e.g. phospholipid), a sterol (e.g., cholesterol) and a PEG-ylated lipid, where the molar ratio of lipids ranges from 20 to 70 mole percent for the ionizable lipid, with a target of 40-60, the mole percent of non-cationic lipid ranges from 0 to 30, with a target of 0 to 15, the mole percent of sterol ranges from 20 to 70, with a target of 30 to 50, and the mole percent of PEG-ylated lipid ranges from 1 to 6, with a target of 2 to 5.

In some embodiments, the lipid particle comprises ionizable lipid/non-cationic-lipid/sterol/conjugated lipid at a molar ratio of 50:10:38.5:1.5.

In an aspect, the disclosure provides a lipid nanoparticle formulation comprising phospholipids, lecithin, phosphatidylcholine and phosphatidylethanolamine.

In some embodiments, one or more additional compounds can also be included. Those compounds can be administered separately or the additional compounds can be included in the lipid nanoparticles of the invention. In other words, the lipid nanoparticles can contain other compounds in addition to the nucleic acid or at least a second nucleic acid, different than the first. Without limitations, other additional compounds can be selected from the group consisting of small or large organic or inorganic molecules, monosaccharides, disaccharides, trisaccharides, oligosaccharides, polysaccharides, peptides, proteins, peptide analogs and derivatives thereof, peptidomimetics, nucleic acids, nucleic acid analogs and derivatives, an extract made from biological materials, or any combinations thereof.

In some embodiments, a lipid nanoparticle (or a formulation comprising lipid nanoparticles) lacks reactive impurities (e.g., aldehydes or ketones), or comprises less than a preselected level of reactive impurities (e.g., aldehydes or ketones). While not wishing to be bound by theory, in some embodiments, a lipid reagent is used to make a lipid nanoparticle formulation, and the lipid reagent may comprise a contaminating reactive impurity (e.g., an aldehyde or ketone). A lipid regent may be selected for manufacturing based on having less than a preselected level of reactive impurities (e.g., aldehydes or ketones). Without wishing to be bound by theory, in some embodiments, aldehydes can cause modification and damage of RNA, e.g., cross-linking between bases and/or covalently conjugating lipid to RNA (e.g., forming lipid-RNA adducts). This may, in some instances, lead to failure of a reverse transcriptase reaction and/or incorporation of inappropriate bases, e.g., at the site(s) of lesion(s), e.g., a mutation in a newly synthesized target DNA.

In some embodiments, a lipid nanoparticle formulation is produced using a lipid reagent comprising less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, a lipid nanoparticle formulation is produced using a lipid reagent comprising less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, a lipid nanoparticle formulation is produced using a lipid reagent comprising: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, the lipid nanoparticle formulation is produced using a plurality of lipid reagents, and each lipid reagent of the plurality independently meets one or more criterion described in this paragraph. In some embodiments, each lipid reagent of the plurality meets the same criterion, e.g., a criterion of this paragraph.

In some embodiments, the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, the lipid nanoparticle formulation comprises: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

In some embodiments, one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, one or more, or optionally all, of the lipid reagents used for a lipid nanoparticle as described herein or a formulation thereof comprise: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

In some embodiments, total aldehyde content and/or quantity of any single reactive impurity (e.g., aldehyde) species is determined by liquid chromatography (LC), e.g., coupled with tandem mass spectrometry (MS/MS), e.g., according to the method described in Example 34. In some embodiments, reactive impurity (e.g., aldehyde) content and/or quantity of reactive impurity (e.g., aldehyde) species is determined by detecting one or more chemical modifications of a nucleic acid molecule (e.g., an RNA molecule, e.g., as described herein) associated with the presence of reactive impurities (e.g., aldehydes), e.g., in the lipid reagents. In some embodiments, reactive impurity (e.g., aldehyde) content and/or quantity of reactive impurity (e.g., aldehyde) species is determined by detecting one or more chemical modifications of a nucleotide or nucleoside (e.g., a ribonucleotide or ribonucleoside, e.g., comprised in or isolated from a template nucleic acid, e.g., as described herein) associated with the presence of reactive impurities (e.g., aldehydes), e.g., in the lipid reagents, e.g., as described in Example 7. In embodiments, chemical modifications of a nucleic acid molecule, nucleotide, or nucleoside are detected by determining the presence of one or more modified nucleotides or nucleosides, e.g., using LC-MS/MS analysis, e.g., as described in Example 7.

In some embodiments, a nucleic acid (e.g., RNA) described herein (e.g., a template nucleic acid or a nucleic acid encoding a GeneWriter) does not comprise an aldehyde modification, or comprises less than a preselected amount of aldehyde modifications. In some embodiments, on average, a nucleic acid has less than 50, 20, 10, 5, 2, or 1 aldehyde modifications per 1000 nucleotides, e.g., wherein a single cross-linking of two nucleotides is a single aldehyde modification. In some embodiments, the aldehyde modification is an RNA adduct (e.g., a lipid-RNA adduct). In some embodiments, the aldehyde-modified nucleotide is cross-linking between bases. In some embodiments, a nucleic acid (e.g., RNA) described herein comprises less than 50, 20, 10, 5, 2, or 1 cross-links between nucleotide.

In some embodiments, LNPs are directed to specific tissues by the addition of targeting domains. For example, biological ligands may be displayed on the surface of LNPs to enhance interaction with cells displaying cognate receptors, thus driving association with and cargo delivery to tissues wherein cells express the receptor. In some embodiments, the biological ligand may be a ligand that drives delivery to the liver, e.g., LNPs that display GalNAc result in delivery of nucleic acid cargo to hepatocytes that display asialoglycoprotein receptor (ASGPR). The work of Akinc et al. *Mol Ther* 18(7): 1357-1364 (2010) teaches the conjugation of a trivalent GalNAc ligand to a PEG-lipid (GalNAc-PEG-DSG) to yield LNPs dependent on ASGPR for observable LNP cargo effect (see, e.g., FIG. 6). Other ligand-displaying LNP formulations, e.g., incorporating folate, transferrin, or antibodies, are discussed in WO2017223135, which is incorporated herein by reference in its entirety, in addition to the references used therein, namely Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; and Peer and Lieberman, Gene Ther. 2011 18:1127-1133.

In some embodiments, LNPs are selected for tissue-specific activity by the addition of a Selective ORgan Targeting (SORT) molecule to a formulation comprising traditional components, such as ionizable cationic lipids, amphipathic phospholipids, cholesterol and poly(ethylene glycol) (PEG) lipids. The teachings of Cheng et al. Nat Nanotechnol 15(4):313-320 (2020) demonstrate that the addition of a supplemental "SORT" component precisely alters the in vivo RNA delivery profile and mediates tissue-specific (e.g., lungs, liver, spleen) gene delivery and editing as a function of the percentage and biophysical property of the SORT molecule.

In some embodiments, the LNPs comprise biodegradable, ionizable lipids. In some embodiments, the LNPs comprise (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl) propyl (9Z,12Z)-octadeca-9,12-dienoate) or another ionizable lipid. See, e.g, lipids of WO2019/067992, WO/2017/173054, WO2015/095340, and WO2014/136086, as well as references provided therein. In some embodiments, the term cationic and ionizable in the context of LNP lipids is interchangeable, e.g., wherein ionizable lipids are cationic depending on the pH.

In some embodiments, multiple components of a Gene Writer system may be prepared as a single LNP formulation, e.g., an LNP formulation comprises mRNA encoding for the Gene Writer polypeptide and an RNA template. Ratios of nucleic acid components may be varied in order to maximize the properties of a therapeutic. In some embodiments, the ratio of RNA template to mRNA encoding a Gene Writer polypeptide is about 1:1 to 100:1, e.g., about 1:1 to 20:1, about 20:1 to 40:1, about 40:1 to 60:1, about 60:1 to 80:1, or about 80:1 to 100:1, by molar ratio. In other embodiments, a system of multiple nucleic acids may be prepared by separate formulations, e.g., one LNP formulation comprising a template RNA and a second LNP formulation comprising an mRNA encoding a Gene Writer polypeptide. In some embodiments, the system may comprise more than two nucleic acid components formulated into LNPs. In some embodiments, the system may comprise a protein, e.g., a Gene Writer polypeptide, and a template RNA formulated into at least one LNP formulation.

In some embodiments, the average LNP diameter of the LNP formulation may be between 10s of nm and 100s of nm, e.g., measured by dynamic light scattering (DLS). In some embodiments, the average LNP diameter of the LNP formulation may be from about 40 nm to about 150 nm, such as about 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, or 150 nm. In some embodiments, the average LNP diameter of the LNP formulation may be from about 50 nm to about 100 nm, from about 50 nm to about 90 nm, from about 50 nm to about 80 nm, from about 50 nm to about 70 nm, from about 50 nm to about 60 nm, from about 60 nm to about 100 nm, from about 60 nm to about 90 nm, from about 60 nm to about 80 nm, from about 60 nm to about 70 nm, from about 70 nm to about 100 nm, from about 70 nm to about 90 nm, from about 70 nm to about 80 nm, from about 80 nm to about 100 nm, from about 80 nm to about 90 nm, or from about 90 nm to about 100 nm. In some embodiments, the average LNP diameter of the LNP formulation may be from about 70 nm to about 100 nm. In a particular embodiment, the average LNP diameter of the LNP formulation may be about 80 nm. In some embodiments, the average LNP diameter of the LNP formulation may be about 100 nm. In some embodiments, the average LNP diameter of the LNP formulation ranges from about 1mm to about 500 mm, from about 5 mm to about 200 mm, from about 10 mm to about 100 mm, from about 20 mm to about 80 mm, from about 25 mm to about 60 mm, from about 30 mm to about 55 mm, from about 35 mm to about 50 mm, or from about 38 mm to about 42 mm.

A LNP may, in some instances, be relatively homogenous. A polydispersity index may be used to indicate the homogeneity of a LNP, e.g., the particle size distribution of the lipid nanoparticles. A small (e.g., less than 0.3) polydispersity index generally indicates a narrow particle size distribution. A LNP may have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25. In some embodiments, the polydispersity index of a LNP may be from about 0.10 to about 0.20.

The zeta potential of a LNP may be used to indicate the electrokinetic potential of the composition. In some embodiments, the zeta potential may describe the surface charge of a LNP. Lipid nanoparticles with relatively low charges, positive or negative, are generally desirable, as more highly charged species may interact undesirably with cells, tissues, and other elements in the body. In some embodiments, the zeta potential of a LNP may be from about −10 mV to about +20 mV, from about −10 mV to about +15 mV, from about −10 mV to about +10 mV, from about −10 mV to about +5 mV, from about −10 mV to about 0 mV, from about −10 mV to about −5 mV, from about −5 mV to about +20 mV, from about −5 mV to about +15 mV, from about −5 mV to about +10 mV, from about −5 mV to about +5 mV, from about −5 mV to about 0 mV, from about 0 mV to about +20 mV, from about 0 mV to about +15 mV, from about 0 mV to about +10 mV, from about 0 mV to about +5 mV, from about +5 mV to about +20 mV, from about +5 mV to about +15 mV, or from about +5 mV to about +10 mV.

The efficiency of encapsulation of a protein and/or nucleic acid, e.g., Gene Writer polypeptide or mRNA encoding the polypeptide, describes the amount of protein and/or nucleic acid that is encapsulated or otherwise associated with a LNP after preparation, relative to the initial amount provided. The encapsulation efficiency is desirably high (e.g., close to 100%). The encapsulation efficiency may be measured, for example, by comparing the amount of protein or nucleic acid in a solution containing the lipid nanoparticle before and after breaking up the lipid nanoparticle with one or more organic solvents or detergents. An anion exchange resin may be used to measure the amount of free protein or nucleic acid (e.g., RNA) in a solution. Fluorescence may be used to measure the amount of free protein and/or nucleic acid (e.g., RNA) in a solution. For the lipid nanoparticles described herein, the encapsulation efficiency of a protein and/or nucleic acid may be at least 50%, for example 50%, 55%, 60%, 65%, 70%, 75%, 80%, 85%, 90%, 91%, 92%, 93%, 94%, 95%, 96%, 97%, 98%, 99%, or 100%. In some embodiments, the encapsulation efficiency may be at least 80%. In some embodiments, the encapsulation efficiency may be at least 90%. In some embodiments, the encapsulation efficiency may be at least 95%.

A LNP may optionally comprise one or more coatings. In some embodiments, a LNP may be formulated in a capsule, film, or table having a coating. A capsule, film, or tablet including a composition described herein may have any useful size, tensile strength, hardness or density.

Additional exemplary lipids, formulations, methods, and characterization of LNPs are taught by WO2020061457, which is incorporated herein by reference in its entirety.

In some embodiments, in vitro or ex vivo cell lipofections are performed using Lipofectamine MessengerMax (Thermo Fisher) or TransIT-mRNA Transfection Reagent (Mirus Bio). In certain embodiments, LNPs are formulated using the GenVoy_ILM ionizable lipid mix (Precision Nano-Systems). In certain embodiments, LNPs are formulated using 2,2-dilinoleyl-4-dimethylaminoethyl-[1,3]-dioxolane (DLin-KC2-DMA) or dilinoleylmethyl-4-dimethylaminobutyrate (DLin-MC3-DMA or MC3), the formulation and in vivo use of which are taught in Jayaraman et al. Angew Chem Int Ed Engl 51(34):8529-8533 (2012), incorporated herein by reference in its entirety.

LNP formulations optimized for the delivery of CRISPR-Cas systems, e.g., Cas9-gRNA RNP, gRNA, Cas9 mRNA, are described in WO2019067992 and WO2019067910, both incorporated by reference.

Additional specific LNP formulations useful for delivery of nucleic acids are described in U.S. Pat. Nos. 8,158,601 and 8,168,775, both incorporated by reference, which include formulations used in patisiran, sold under the name ONPATTRO.

Exemplary dosing of Gene Writer LNP may include about 0.1, 0.25, 0.3, 0.5, 1, 2, 3, 4, 5, 6, 8, 10, or 100 mg/kg (RNA). Exemplary dosing of AAV comprising a nucleic acid encoding one or more components of the system may include an MOI of about $10^{11}$, $10^{12}$, $10^{13}$, and $10^{14}$ vg/kg.

Suitable Indications

Exemplary suitable diseases and disorders that can be treated by the systems or methods provided herein, for example, those comprising Gene Writers, include, without limitation: Baraitser-Winter syndromes 1 and 2; Diabetes mellitus and insipidus with optic atrophy and deafness; Alpha-1-antitrypsin deficiency; Heparin cofactor II deficiency; Adrenoleukodystrophy; Keppen-Lubinsky syndrome; Treacher collins syndrome 1; Mitochondrial complex I, II, III, III (nuclear type 2, 4, or 8) deficiency; Hypermanganesemia with dystonia, polycythemia and cirrhosis; Carcinoid tumor of intestine; Rhabdoid tumor predisposition syndrome 2; Wilson disease; Hyperphenylalaninemia, bh4-deficient, a, due to partial pts deficiency, BH4-deficient, D, and non-pku; Hyperinsulinemic hypoglycemia familial 3, 4, and 5; Keratosis follicularis; Oral-facial-digital syndrome; SeSAME syndrome; Deafness, nonsyndromic sensorineural, mitochondrial; Proteinuria; Insulin-dependent diabetes mellitus secretory diarrhea syndrome; Moyamoya disease 5; Diamond-Blackfan anemia 1, 5, 8, and 10; Pseudoachondroplastic spondyloepiphyseal dysplasia syndrome; Brittle cornea syndrome 2; Methylmalonic acidemia with homocystinuria, Adams-Oliver syndrome 5 and 6; autosomal recessive Agammaglobulinemia 2; Cortical malformations, occipital; Febrile seizures, familial, 11; Mucopolysaccharidosis type VI, type VI (severe), and type VII; Marden Walker like syndrome; Pseudoneonatal adrenoleukodystrophy; Spheroid body myopathy; Cleidocranial dysostosis; Multiple Cutaneous and Mucosal Venous Malformations; Liver failure acute infantile; Neonatal intrahepatic cholestasis caused by citrin deficiency; Ventricular septal defect 1; Oculodentodigital dysplasia; Wilms tumor 1; Weill-Marchesani-like syndrome; Renal adysplasia; Cataract 1, 4, autosomal dominant, autosomal dominant, multiple types, with microcornea, coppock-like, juvenile, with microcornea and glucosuria, and nuclear diffuse nonprogressive; Odontohypophosphatasia; Cerebro-oculo-facio-skeletal syndrome; Schizophrenia 15; Cerebral amyloid angiopathy, APP-related; Hemophagocytic lymphohistiocytosis, familial, 3; Porphobilinogen synthase deficiency; Episodic ataxia type 2; Trichorhinophalangeal syndrome type 3; Progressive familial heart block type IB; Glioma susceptibility 1; Lichtenstein-Knorr Syndrome; Hypohidrotic X-linked ectodermal dysplasia; Bartter syndrome types 3, 3 with hypocalciuria, and 4; Carbonic anhydrase VA deficiency, hyperammonemia due to; Cardiomyopathy; Poikiloderma, hereditary fibrosing, with tendon contractures, myopathy, and pulmonary fibrosis; Combined d-2- and 1-2-hydroxyglutaric aciduria; Arginase deficiency; Cone-rod dystrophy 2 and 6; Smith-Lemli-Opitz syndrome; Mucolipidosis III Gamma; Blau syndrome; Werner syndrome; Meningioma; Iodotyrosyl coupling defect; Dubin-Johnson syndrome; 3-Oxo-5 alpha-steroid delta 4-dehydrogenase deficiency; Boucher Neuhauser syndrome; Iron accumulation in brain; Mental Retardation, X-Linked 102 and syndromic 13; familial, Pituitary adenoma predisposition; Hypoplasia of the corpus callosum; Hyperalphalipoproteinemia 2; Deficiency of ferroxidase; Growth hormone insensitivity with immunodeficiency; Marinesco-Sj\xc3\xb6gren syndrome; Martsolf syndrome; Gaze palsy, familial horizontal, with progressive scoliosis; Mitchell-Riley syndrome; Hypocalciuric hypercalcemia, familial, types 1 and 3; Rubinstein-Taybi syndrome; Epstein syndrome; Juvenile retinoschisis; Becker muscular dystrophy; Loeys-Dietz syndrome 1, 2, 3; Congenital muscular hypertrophy-cerebral syndrome; Familial juvenile gout; Spermatogenic failure 11, 3, and 8; Orofacial cleft 11 and 7, Cleft lip/palate-ectodermal dysplasia syndrome; Mental retardation, X-linked, nonspecific, syndromic, Hedera type, and syndromic, wu type; Combined oxidative phosphorylation deficiencies 1, 3, 4, 12, 15, and 25; Frontotemporal dementia; Kniest dysplasia; Familial cardiomyopathy; Benign familial hematuria; Pheochromocytoma; Aminoglycoside-induced deafness; Gamma-aminobutyric acid transaminase deficiency; Oculocutaneous albinism type IB, type 3, and type 4; Renal coloboma syndrome; CNS hypomyelination; Hennekam lymphangiectasia-lymphedema syndrome 2; Migraine, familial basilar; Distal spinal muscular atrophy, X-linked 3; X-linked periventricular heterotopia; Microcephaly; Mucopolysaccharidosis, MPS—I-H/S, MPS-II, MPS-III-A, MPS-III-B, MPS-III-C, MPS-IV-A, MPS-IV-B; Infantile Parkinsonism-dystonia; Frontotemporal dementia with TDP43 inclusions, TARDBP-related; Hereditary diffuse gastric cancer; Sialidosis type I and II; Microcephaly-capillary malformation syndrome; Hereditary breast and ovarian cancer syndrome; Brain small vessel disease with hemorrhage; Non-ketotic hyperglycinemia; Navajo neurohepatopathy; Auriculocondylar syndrome 2; Spastic paraplegia 15, 2, 3, 35, 39, 4, autosomal dominant, 55, autosomal recessive, and 5A; Autosomal recessive cutis *laxa* type IA and IB; Hemolytic anemia, nonspherocytic, due to glucose phosphate isomerase deficiency; Hutchinson-Gilford syndrome; Familial amyloid nephropathy with urticaria and deafness; Supravalvar aortic stenosis; Diffuse palmoplantar keratoderma, Bothnian type; Holt-Oram syndrome; Coffin Siris/Intellectual Disability; Left-right axis malformations; Rapadilino syndrome; Nanophthalmos 2; Craniosynostosis and dental anomalies; Paragangliomas 1; Snyder Robinson syndrome; Ventricular fibrillation; Activated PI3K-delta syndrome; Howel-Evans syndrome; Larsen syndrome, dominant type; Van Maldergem syndrome 2; MYH-associated polyposis; 6-pymvoyl-tetrahydropterin synthase deficiency; Alagille syndromes 1 and 2; Lymphangiomyomatosis; Muscle eye brain disease; WFSI-Related Disorders; Primary hypertrophic osteoarthropathy, autosomal recessive 2; Infertility; Nestor-Guillermo progeria syndrome; Mitochondrial trifunctional protein deficiency; Hypoplastic left heart syndrome 2; Primary dilated cardiomyopathy; Retinitis pigmentosa; Hirschsprung disease 3; Upshaw-Schulman syndrome; Desbuquois dysplasia 2; Diarrhea 3 (secretory sodium, congenital, syndromic) and 5 (with tufting enteropathy, congenital); Pachyonychia congenita 4 and type 2; Cerebral autosomal dominant and recessive arteriopathy with subcortical infarcts and leukoencephalopathy; Vi tel 1i form dystrophy; type II, type IV, IV (combined hepatic and myopathic), type V, and type VI; Atypical Rett syndrome; Atrioventricular septal defect 4; Papillon-Lef\xc3\xa8vre syndrome; Leber amaurosis; X-linked hereditary motor and sensory neuropathy; Progressive sclerosing poliodystrophy; Goldmann-Favre syndrome; Renal-hepatic-pancreatic dysplasia; Pallister-Hall syndrome; Amyloidogenic transthyretin amyloidosis; Melnick-Needles syndrome; Hyperimmunoglobulin E syndrome; Posterior column ataxia with retinitis pigmentosa; Chondrodysplasia punctata 1, X-linked recessive and 2 X-linked dominant; Ectopia lentis, isolated autosomal recessive and dominant; Familial cold urticarial; Familial adenomatous polyposis 1 and 3; Porokeratosis 8, disseminated superficial actinic type; PIK3CA Related Overgrowth Spectrum; Cerebral cavernous malformations 2; Exudative vitreoretinopathy 6; Megalencephaly cutis marmorata telangiectatica congenital; TARP syndrome; Diabetes mellitus, permanent neonatal, with neurologic features; Short-rib thoracic dysplasia 11 or 3 with or without polydactyly; Hypertrichotic osteochondrodysplasia; beta Thalassemia; Niemann-Pick disease type C1, C2, type A, and type C1, adult form; Charcot-Marie-Tooth disease types IB, 2B2, 2C, 2F, 21, 2U (axonal), 1C (demyelinating), dominant intermediate C, recessive intermediate A, 2A2, 4C, 4D, 4H, IF, IVF, and X; Tyrosinemia type I; Paroxysmal atrial fibrillation; UV-sensitive syndrome; Tooth agenesis, selective, 3 and 4; Merosin deficient congenital muscular dystrophy; Long-chain 3-hydroxyacyl-CoA dehydrogenase deficiency; Congenital aniridia; Left ventricular noncompaction 5; Deficiency of aromatic-L-amino-acid decarboxylase; Coronary heart disease; Leukonychia totalis; Distal arthrogryposis type 2B; Retinitis pigmentosa 10, 11, 12, 14, 15, 17, and 19; Robinow Sorauf syndrome; Tenorio Syndrome; Prolactinoma; Neurofibromatosis, type land type 2; Congenital muscular dystrophy-dystroglycanopathy with brain and eye anomalies, types A2, A7, A8, All, and A14; Heterotaxy, visceral, 2, 4, and 6, autosomal; Jankovic Rivera syndrome; Lipodystrophy, familial partial, type 2 and 3; Hemoglobin H disease, nondeletional; Multicentric osteolysis, nodulosis and arthropathy; Thyroid agenesis; deficiency of Acyl-CoA dehydrogenase family, member 9; Alexander disease; Phytanic acid storage disease; Breast-ovarian cancer, familial 1, 2, and 4; Proline dehydrogenase deficiency; Childhood hypophosphatasia; Pancreatic agenesis and congenital heart disease; Vitamin D-dependent rickets, types land 2; Iridogoniodysgenesis dominant type and type 1; Autosomal recessive hypohidrotic ectodermal dysplasia syndrome; Mental retardation, X-linked, 3, 21, 30, and 72; Hereditary hemorrhagic telangiectasia type 2; Blepharophimosis, ptosis, and epicanthus *inversus*; Adenine phosphoribosyltransferase deficiency; Seizures, benign familial infantile, 2; Acrodysostosis 2, with or without hormone resistance; Tetralogy of Fallot; Retinitis pigmentosa 2, 20, 25, 35, 36, 38, 39, 4, 40, 43, 45, 48, 66, 7, 70, 72; Lysosomal acid lipase deficiency; Eichsfeld type congenital muscular dystrophy; Walker-Warburg congenital muscular dystrophy; TNF receptor-associated periodic fever syndrome (TRAPS); Progressive myoclonus epilepsy with ataxia; Epilepsy, childhood absence 2, 12 (idiopathic generalized, susceptibility to) 5 (nocturnal frontal lobe), nocturnal frontal lobe type 1, partial, with variable foci, progressive myoclonic 3, and X-linked, with variable learning disabilities and behavior disorders; Long QT syndrome; Dicarboxylic aminoaciduria; Brachydactyly types A1 and A2; Pseudoxanthoma elasticum-like disorder with multiple coagulation factor deficiency; Multisystemic smooth muscle dysfunction syndrome; Syndactyly Cenani Lenz type; Joubert syndrome 1, 6, 7, 9/15 (digenic), 14, 16, and 17, and Orofaciodigital syndrome xiv; Digitorenocerebral syndrome; Retinoblastoma; Dyskinesia, familial, with facial myokymia; Hereditary sensory and autonomic neuropathy type IIB amd IIA; familial hyperinsulinism; Megalencephalic leukoencephalopathy with subcortical cysts land 2a; Aase syndrome; Wiedemann-Steiner syndrome; Ichthyosis exfoliativa; Myotonia congenital; Granulomatous disease, chronic, X-linked, variant; Deficiency of 2-methylbutyryl-CoA dehydrogenase; Sarcoidosis, early-onset; Glaucoma, congenital and Glaucoma, congenital, Coloboma; Breast cancer, susceptibility to; Ceroid lipofuscinosis neuronal 2, 6, 7, and 10; Congenital generalized lipodystrophy type 2; Fructose-biphosphatase deficiency; Congenital contractural arachnodactyly; Lynch syndrome I and II; Phosphoglycerate dehydrogenase deficiency; Burn-Mckeown syndrome; Myocardial infarction 1; Achromatopsia 2 and 7; Retinitis Pigmentosa 73; Protan defect; Polymicrogyria, asymmetric, bilateral frontoparietal; Spinal muscular atrophy, distal, autosomal recessive, 5; Methylmalonic aciduria due to methylmalonyl-CoA mutase deficiency; Familial porencephaly; Hurler syndrome; Otopalato-digital syndrome, types I and II; Sotos syndrome 1 or 2; Cardioencephalomyopathy, fatal infantile, due to cytochrome c oxidase deficiency; Parastremmatic dwarfism; Thyrotropin releasing hormone resistance, generalized; Diabetes mellitus, type 2, and insulin-dependent, 20; Thoracic aortic aneurysms and aortic dissections; Estrogen resistance; Maple syrup urine disease type 1A and type 3; Hypospadias 1 and 2, X-linked; Metachromatic leukodystrophy juvenile, late infantile, and adult types; Early T cell progenitor acute lymphoblastic leukemia; Neuropathy, Hereditary Sensory, Type IC; Mental retardation, autosomal dominant 31; Retinitis pigmentosa 39; Breast cancer, early-onset; May-Hegglin anomaly; Gaucher disease type 1 and Subacute neuronopathic; Temtamy syndrome; Spinal muscular atrophy, lower extremity predominant 2, autosomal dominant; Fanconi anemia, complementation group E, I, N, and O; Alkaptonuria; Hirschsprung disease; Combined malonic and methylmalonic aciduria; Arrhythmogenic right ventricular cardiomyopathy types 5, 8, and 10; Congenital lipomatous overgrowth, vascular malformations, and epidermal nevi; Timothy syndrome; Deficiency of guanidinoacetate methyltransferase; Myoclonic dystonia; Kanzaki disease; Neutral 1 amino acid transport defect; Neurohypophyseal diabetes insipidus; Thyroid hormone metabolism, abnormal; Benign scapuloperoneal muscular dystrophy with cardiomyopathy; Hypoglycemia with deficiency of glycogen synthetase in the liver; Hypertrophic cardiomyopathy; Myasthenic Syndrome, Congenital, 11, associated with acetylcholine receptor deficiency; Mental retardation X-linked syndromic 5; Stormorken syndrome; Aplastic anemia; Intellectual disability; Normokalemic periodic paralysis, potassium-sensitive; Danon disease; Nephronophthisis 13, 15 and 4; Thyrotoxic periodic paralysis and Thyrotoxic periodic paralysis 2; Infertility associated with multi-tailed spermatozoa and excessive DNA; Glaucoma, primary open angle, juvenile-onset; Afibrinogenemia and congenital Afibrinogenemia; Polycystic kidney disease 2, adult type, and infantile type; Familial *Porphyria cutanea* tarda; Cerebello-oculo-renal syndrome (nephronophthisis, oculomotor apraxia and cerebellar abnormalities); Frontotemporal Dementia Chromosome 3-Linked and Frontotemporal dementia ubiquitin-positive; Metatrophic dysplasia; Immunodeficiency-centromeric instability-facial anomalies syndrome 2; Anemia, nonspherocytic hemolytic, due to G6PD deficiency; Bronchiectasis with or without elevated sweat chloride 3; Congenital myopathy with fiber type disproportion; Carney complex, type 1; Cryptorchidism, unilateral or bilateral; Ichthyosis bullosa of Siemens; Isolated lutropin deficiency; DFNA 2 Nonsyndromic Hearing Loss; Klein-Waardenberg syndrome; Gray platelet syndrome; Bile acid synthesis defect, congenital, 2; 46, XY sex reversal, type 1, 3, and 5; Acute intermittent porphyria; Cornelia de Fange syndromes 1 and 5; Hyperglycinuria; Cone-rod dystrophy 3; Dysfibrinogenemia; Karak syndrome; Congenital muscular dystrophy-dystroglycanopathy without mental retardation, type B5; Infantile nystagmus, X-linked; Dyskeratosis congenita, autosomal recessive, 1, 3, 4, and 5; Microcephaly with or without chorioretinopathy, lymphedema, or mental retardation; Hyperlysinemia; Bardet-Biedl syndromes 1, 11, 16, and 19; Autosomal recessive centronuclear myopathy; Frasier syndrome; Caudal regression syndrome; Fibrosis of extraocular muscles, congenital, 1, 2, 3a (with or without extraocular involvement), 3b; Prader-Willi-like syndrome; Malignant melanoma; Bloom syndrome; Darier disease, segmental; Multicentric osteolysis nephropathy; Hemochromatosis type 1, 2B, and 3; Cerebellar ataxia infantile with progressive external ophthalmoplegi and Cerebellar ataxia, mental retardation, and dysequilibrium syndrome 2; Hypoplastic left heart syndrome; Epilepsy, Hearing Loss, And Mental Retardation Syndrome; Transferrin serum level quantitative trait locus 2; Ocular albinism, type I; Marfan syndrome; Congenital muscular dystrophy-dystroglycanopathy with brain and eye anomalies, type A14 and B14; Hyperammonemia, type III; Cryptophthalmos syndrome; Alopecia universalis congenital; Adult hypophosphatasia; Mannose-binding protein deficiency; Bull eye macular dystrophy; Autosomal dominant torsion dystonia 4; Nephrotic syndrome, type 3, type 5, with or without ocular abnormalities, type 7, and type 9; Seizures, Early infantile epileptic encephalopathy 7; Persistent hyperinsulinemic hypoglycemia of infancy; Thrombocytopenia, X-linked; Neonatal hypotonia; Orstavik Lindemann Solberg syndrome; Pulmonary hypertension, primary, 1, with hereditary hemorrhagic telangiectasia; Pituitary dependent hypercortisolism; Epidermodysplasia verruciformis; Epidermolysis bullosa, junctional, localisata variant; Cytochrome c oxidase i deficiency; Kindler syndrome; Myosclerosis, autosomal recessive; Truncus arteriosus; Duane syndrome type 2; ADULT syndrome; Zellweger syndrome spectrum; Leukoencephalopathy with ataxia, with Brainstem and Spinal Cord Involvement and Lactate Elevation, with vanishing white matter, and progressive, with ovarian failure; Antithrombin III deficiency; Holoprosencephaly 7; Roberts-SC phocomelia syndrome; Mitochondrial DNA-depletion syndrome 3 and 7, hepatocerebral types, and 13 (encephalomyopathic type); Porencephaly 2; Microcephaly, normal intelligence and immunodeficiency; Giant axonal neuropathy; Sturge-Weber syndrome, Capillary malformations, congenital, 1; Fabry disease and Fabry disease, cardiac variant; Glutamate formiminotransferase deficiency; Fanconi-Bickel syndrome; Acromicric dysplasia; Epilepsy, idiopathic generalized, susceptibility to, 12; Basal ganglia calcification, idiopathic, 4; Polyglucosan body myopathy 1 with or without immunodeficiency; Malignant tumor of prostate; Congenital ectodermal dysplasia of face; Congenital heart disease; Age-related macular degeneration 3, 6, 11, and 12; Congenital myotonia, autosomal dominant and recessive forms; Hypomagnesemia 1, intestinal; Sulfite oxidase deficiency, isolated; Pick disease; Plasminogen deficiency, type I; Syndactyly type 3; Cone-rod dystrophy amelogenesis imperfecta; Pseudoprimary hyperaldosteronism; Terminal osseous dysplasia; Bartter syndrome antenatal type 2; Congenital muscular dystrophy-dystroglycanopathy with mental retardation, types B2, B3, B5, and B15; Familial infantile myasthenia; Lymphoproliferative syndrome 1, 1 (X-linked), and 2; Hypercholesterolaemia and Hypercholesterolemia, autosomal recessive; Neoplasm of ovary; Infantile GM1 gangliosidosis; Syndromic X-linked mental retardation 16; Deficiency of ribose-5-phosphate isomerase; Alzheimer disease, types, 1, 3, and 4; Andersen Tawil syndrome; Multiple synostoses syndrome 3; Chilbain lupus 1; Hemophagocytic lymphohistiocytosis, familial, 2; Axenfeld-Rieger syndrome type 3; Myopathy, congenital with cores; Osteoarthritis with mild chondrodysplasia; Peroxisome biogenesis disorders; Severe congenital neutropenia; Hereditary neuralgic amyotrophy; Palmoplantar keratoderma, nonepidermolytic, focal or diffuse; Dysplasminogenemia; Familial colorectal cancer; Spastic ataxia 5, autosomal recessive, Charlevoix-Saguenay type, 1, 10, or 11, autosomal recessive; Frontometaphyseal dysplasia land 3; Hereditary factors II, IX, VIII deficiency disease; Spondylocheirodysplasia, Ehlers-Danlos syndrome-like, with immune dysregulation, Aggrecan type, with congenital joint dislocations, short limb-hand type, Sedaghatian type, with cone-rod dystrophy, and Kozlowski type; Ichthyosis prematurity syndrome; Stickler syndrome type 1; Focal segmental glomerulosclerosis 5; 5-Oxoprolinase deficiency; Microphthalmia syndromic 5, 7, and 9; Juvenile polyposis/hereditary hemorrhagic telangiectasia syndrome; Deficiency of butyryl-CoA dehydrogenase; Maturity-onset diabetes of the young, type 2; Mental retardation, syndromic, Claes-Jensen type, X-linked; Deafness, cochlear, with myopia and intellectual impairment, without vestibular involvement, autosomal dominant, X-linked 2; Spondylocarpotarsal synostosis syndrome; Sting-associated vasculopathy, infantile-onset; Neutral lipid storage disease with myopathy; Immune dysfunction with T-cell inactivation due to calcium entry defect 2; Cardiofaciocutaneous syndrome; Corticosterone methyloxidase type 2 deficiency; Hereditary myopathy with early respiratory failure; Interstitial nephritis, karyomegalic; Trimethylaminuria; Hyperimmunoglobulin D with periodic fever; Malignant hyperthermia susceptibility type 1; Trichomegaly with mental retardation, dwarfism and pigmentary degeneration of retina; Breast adenocarcinoma; Complement factor B deficiency; Ullrich congenital muscular dystrophy; Left ventricular noncompaction cardiomyopathy; Fish-eye disease; Finnish congenital nephrotic syndrome; Limb-girdle muscular dystrophy, type IB, 2A, 2B, 2D, C1, C5, C9, C14; Idiopathic fibrosing alveolitis, chronic form; Primary familial hypertrophic cardiomyopathy; Angiotensin i-converting enzyme, benign serum increase; Cd8 deficiency, familial; Proteus syndrome; Glucose-6-phosphate transport defect; Borjeson-Forssman-Lehmann syndrome; Zellweger syndrome; Spinal muscular atrophy, type II; Prostate cancer, hereditary, 2; Thrombocytopenia, platelet dysfunction, hemolysis, and imbalanced globin synthesis; Congenital disorder of glycosylation types IB, ID, 1G, 1H, 1 J, IK, IN, IP, 2C, 2J, 2K, Ilm; Junctional epidermolysis bullosa gravis of Herlitz; Generalized epilepsy with febrile seizures plus 3, type 1, type 2; Schizophrenia 4; Coronary artery disease, autosomal dominant 2; Dyskeratosis congenita, autosomal dominant, 2 and 5; Subcortical laminar heterotopia, X-linked; Adenylate kinase deficiency; X-linked severe combined immunodeficiency; Coproporphyria; Amyloid Cardiomyopathy, Transthyretin-related; Hypocalcemia, autosomal dominant 1; Brugada syndrome; Congenital myasthenic syndrome, acetazolamide-responsive; Primary hypomagnesemia; Sclerosteosis; Frontotemporal dementia and/or amyotrophic lateral sclerosis 3 and 4; Mevalonic aciduria; Schwannomatosis 2; Hereditary motor and sensory neuropathy with optic atrophy; *Porphyria cutanea* tarda; Osteochondritis dissecans; Seizures, benign familial neonatal, 1, and/or myokymia; Long QT syndrome, LQT1 subtype; Mental retardation, anterior maxillary protrusion, and strabismus; Idiopathic hypercalcemia of infancy; Hypogonadotropic hypogonadism 11 with or without anosmia; Polycystic lipomembranous osteodysplasia with sclerosing leukoencephalopathy; Primary autosomal recessive microcephaly 10, 2, 3, and 5; Interrupted aortic arch; Congenital amegakaryocytic thrombocytopenia; Hermansky-Pudlak syndrome 1, 3, 4, and 6; Long QT syndrome 1, 2, 2/9, 2/5, (digenic), 3, 5 and 5, acquired, susceptibility to; Andermann syndrome; Retinal cone dystrophy 3B; Erythropoietic protoporphyria; Sepiapterin reductase deficiency; Very long chain acyl-CoA dehydrogenase deficiency; Hyperferritinemia cataract syndrome; Silver spastic paraplegia syndrome; Charcot-Marie-Tooth disease; Atrial septal defect 2; Carnevale syndrome; Hereditary insensitivity to pain with anhidrosis; Catecholaminergic polymorphic ventricular tachycardia; Hypokalemic periodic paralysis 1 and 2; Sudden infant death syndrome; Hypochromic microcytic anemia with iron overload; GLUT1 deficiency syndrome 2; Leukodystrophy, Hypomyelinating, 11 and 6; Cone monochromatism; Osteopetrosis autosomal dominant type 1 and 2, recessive 4, recessive 1, recessive 6; Severe congenital neutropenia 3, autosomal recessive or dominant; Methionine adenosyltransferase deficiency, autosomal dominant; Paroxysmal familial ventricular fibrillation; Pyruvate kinase deficiency of red cells; Schneckenbecken dysplasia; Torsades de pointes; Distal myopathy Markesbery-Griggs type; Deficiency of UDPglucose-hexose-1-phosphate uridylyltransferase; Sudden cardiac death; Neu-Laxova syndrome 1; Atransferrinemia; Hyperparathyroidism 1 and 2; Cutaneous malignant melanoma 1; Symphalangism, proximal, lb; Progressive pseudorheumatoid dysplasia; Werdnig-Hoffmann disease; Achondrogenesis type 2; Holoprosencephaly 2, 3, 7, and 9; Schindler disease, type 1; Cerebroretinal microangiopathy with calcifications and cysts; Heterotaxy, visceral, X-linked; Tuberous sclerosis syndrome; Kartagener syndrome; Thyroid hormone resistance, generalized, autosomal dominant; Bestrophinopathy, autosomal recessive; Nail disorder, nonsyndromic congenital, 8; Mohr-Tranebjaerg syndrome; Cone-rod dystrophy 12; Hearing impairment; Ovarioleukodystrophy; Renal tubular acidosis, proximal, with ocular abnormalities and mental retardation; Dihydropteridine reductase deficiency; Focal epilepsy with speech disorder with or without mental retardation; Ataxia-telangiectasia syndrome; Brown-Vialetto-Van laere syndrome and Brown-Vialetto-Van Laere syndrome 2; Cardiomyopathy; Peripheral demyelinating neuropathy, central dysmyelination; Comeal dystrophy, Fuchs endothelial, 4; Cowden syndrome 3; Dystonia 2 (torsion, autosomal recessive), 3 (torsion, X-linked), 5 (Dopa-responsive type), 10, 12, 16, 25, 26 (Myoclonic); Epiphyseal dysplasia, multiple, with myopia and conductive deafness; Cardiac conduction defect, nonspecific; Branchiootic syndromes 2 and 3; Peroxisome biogenesis disorder 14B, 2A, 4A, 5B, 6A, 7A, and 7B; Familial renal glucosuria; Candidiasis, familial, 2, 5, 6, and 8; Autoimmune disease, multisystem, infantile-onset; Early infantile epileptic encephalopathy 2, 4, 7, 9, 10, 11, 13, and 14; Segawa syndrome, autosomal recessive; Deafness, autosomal dominant 3a, 4, 12, 13, 15, autosomal dominant nonsyndromic sensorineural 17, 20, and 65; Congenital dyserythropoietic anemia, type I and II; Enhanced s-cone syndrome; Adult neuronal ceroid lipofuscinosis; Atrial fibrillation, familial, 11, 12, 13, and 16; Norum disease; Osteosarcoma; Partial albinism; Biotinidase deficiency; Combined cellular and humoral immune defects with granulomas; Alpers encephalopathy; Holocarboxylase synthetase deficiency; Maturity-onset diabetes of the young, type 1, type 2, type 11, type 3, and type 9; Variegate porphyria; Infantile cortical hyperostosis; Testosterone 17-beta-dehydrogenase deficiency; L-2-hydroxyglutaric aciduria; Tyrosinase-negative oculocutaneous albinism; Primary ciliary dyskinesia 24; Pontocerebellar hypoplasia type 4; Ciliary dyskinesia, primary, 7, 11, 15, 20 and 22; Idiopathic basal ganglia calcification 5; Brain atrophy; Craniosynostosis 1 and 4; Keratoconus 1; Rasopathy; Congenital adrenal hyperplasia and Congenital adrenal hypoplasia, X-linked; Mitochondrial DNA depletion syndrome 11, 12 (cardiomyopathie type), 2, 4B (MNGIE type), 8B (MNGIE type); Brachydactyly with hypertension; Cornea plana 2; Aarskog syndrome; Multiple epiphyseal dysplasia 5 or Dominant; Comeal endothelial dystrophy type 2; Aminoacylase 1 deficiency; Delayed speech and language development; Nicolaides-Baraitser syndrome; Enterokinase deficiency; Ectrodactyly, ectodermal dysplasia, and cleft lip/palate syndrome 3; Arthrogryposis multiplex congenita, distal, X-linked; Perrault syndrome 4; Jervell and Lange-Nielsen syndrome 2; Hereditary Nonpolyposis Colorectal Neoplasms; Robinow syndrome, autosomal recessive, autosomal recessive, with brachy-syn-polydactyly; Neurofibrosarcoma; Cytochrome-c oxidase deficiency; Vesicoureteral reflux 8; Dopamine beta hydroxylase deficiency; Carbohydrate-deficient glycoprotein syndrome type I and II; Progressive familial intrahepatic cholestasis 3; Benign familial neonatal-infantile seizures; Pancreatitis, chronic, susceptibility to; Rhizomelic chondrodysplasia punctata type 2 and type 3; Disordered steroidogenesis due to cytochrome p450 oxidoreductase deficiency; Deafness with labyrinthine aplasia microtia and microdontia (FAMM); Rothmund-Thomson syndrome; Cortical dysplasia, complex, with other brain malformations 5 and 6; Myasthenia, familial infantile, 1; Trichorhinophalangeal dysplasia type I; Worth disease; Splenic hypoplasia; Molybdenum cofactor deficiency, complementation group A; Sebastian syndrome; Progressive familial intrahepatic cholestasis 2 and 3; Weill-Marchesani syndrome 1 and 3; Microcephalic osteodysplastic primordial dwarfism type 2; Surfactant metabolism dysfunction, pulmonary, 2 and 3; Severe X-linked myotubular myopathy; Pancreatic cancer 3; Platelet-type bleeding disorder 15 and 8; Tyrosinase-positive oculocutaneous albinism; Borrone Di Rocco Crovato syndrome; ATR-X syndrome; Sucrase-isomaltase deficiency; Complement component 4, partial deficiency of, due to dysfunctional c1 inhibitor; Congenital central hypoventilation; Infantile hypophosphatasia; Plasminogen activator inhibitor type 1 deficiency; Malignant lymphoma, non-Hodgkin; Hyperornithinemia-hyperammonemia-homocitrullinuria syndrome; Schwartz Jampel syndrome type 1; Fetal hemoglobin quantitative trait locus 1; Myopathy, distal, with anterior tibial onset; Noonan syndrome 1 and 4, LEOPARD syndrome 1; Glaucoma 1, open angle, e, F, and G; Kenny-Caffey syndrome type 2; PTEN hamartoma tumor syndrome; Duchenne muscular dystrophy; Insulin-resistant diabetes mellitus and acanthosis nigricans; Microphthalmia, isolated 3, 5, 6, 8, and with coloboma 6; Raine syndrome; Premature ovarian failure 4, 5, 7, and 9; Allan-Hemdon-Dudley syndrome; Citrullinemia type I; Alzheimer disease, familial, 3, with spastic paraparesis and apraxia; Familial hemiplegic migraine types 1 and 2; Ventriculomegaly with cystic kidney disease; Pseudoxanthoma elasticum; Homocysteinemia due to MTHFR deficiency, CBS deficiency, and Homocystinuria, pyridoxine-responsive; Dilated cardiomyopathy 1A, 1AA, 1C, 1G, IBB, IDD, IFF, 1HH, II, IKK, IN, IS, 1Y, and 3B; Muscle AMP guanine oxidase deficiency; Familial cancer of breast; Hereditary sideroblastic anemia; Myoglobinuria, acute recurrent, autosomal recessive; Neuroferritinopathy; Cardiac arrhythmia; Glucose transporter type 1 deficiency syndrome; Holoprosencephaly sequence; Angiopathy, hereditary, with nephropathy, aneurysms, and muscle cramps; Isovaleryl-CoA dehydrogenase deficiency; Kallmann syndrome 1, 2, and 6; Permanent neonatal diabetes mellitus; Acrocallosal syndrome, Schinzel type; Gordon syndrome; MYH9 related disorders; Donnai Barrow syndrome; Severe congenital neutropenia and 6, autosomal recessive; Charcot-Marie-Tooth disease, types ID and IVF; Coffin-Lowry syndrome; mitochondrial 3-hydroxy-3-methylglutaryl-CoA synthase deficiency; Hypomagnesemia, seizures, and mental retardation; Ischiopatellar dysplasia; Multiple congenital anomalies-hypotonia-seizures syndrome 3; Spastic paraplegia 50, autosomal recessive; Short stature with nonspecific skeletal abnormalities; Severe myoclonic epilepsy in infancy; Propionic academia; Adolescent nephronophthisis; Macrocephaly, macrosomia, facial dysmorphism syndrome; Stargardt disease 4; Ehlers-Danlos syndrome type 7 (autosomal recessive), classic type, type 2 (progeroid), hydroxylysine-deficient, type 4, type 4 variant, and due to tenascin-X deficiency; Myopia 6; Coxa plana; Familial cold autoinflammatory syndrome 2; Malformation of the heart and great vessels; von Willebrand disease type 2M and type 3; Deficiency of galactokinase; Brugada syndrome 1; X-linked ichthyosis with steryl-sulfatase deficiency; Congenital ocular coloboma; Histiocytosis-lymphadenopathy plus syndrome; Aniridia, cerebellar ataxia, and mental retardation; Left ventricular noncompaction 3; Amyotrophic lateral sclerosis types 1, 6, 15 (with or without frontotemporal dementia), 22 (with or without frontotemporal dementia), and 10; Osteogenesis imperfecta type 12, type 5, type 7, type 8, type I, type III, with normal sclerae, dominant form, recessive perinatal lethal; Hematologic neoplasm; Favism, susceptibility to; Pulmonary Fibrosis And/Or Bone Marrow Failure, Telomere-Related, 1 and 3; Dominant hereditary optic atrophy; Dominant dystrophic epidermolysis bullosa with absence of skin; Muscular dystrophy, congenital, megaconial type; Multiple gastrointestinal atresias; McCune-Albright syndrome; Nail-patella syndrome; McLeod neuroacanthocytosis syndrome; Common variable immunodeficiency 9; Partial hypoxanthine-guanine phosphoribosyltransferase deficiency; Pseudohypoaldosteronism type 1 autosomal dominant and recessive and type 2; Urocanate hydratase deficiency; Heterotopia; Meckel syndrome type 7; Ch\xc3\xa9diak-Higashi syndrome, Chediak-Higashi syndrome, adult type; Severe combined immunodeficiency due to ADA deficiency, with microcephaly, growth retardation, and sensitivity to ionizing radiation, atypical, autosomal recessive, T cell-negative, B cell-positive, NK cell-negative of NK-positive; Insulin resistance; Deficiency of steroid 11-beta-monooxygenase; Popliteal pterygium syndrome; Pulmonary arterial hypertension related to hereditary hemorrhagic telangiectasia; Deafness, autosomal recessive 1A, 2, 3, 6, 8, 9, 12, 15, 16, 18b, 22, 28, 31, 44, 49, 63, 77, 86, and 89; Primary hyperoxaluria, type I, type, and type III; Paramyotonia congenita of von Eulenburg; Desbuquois syndrome; Carnitine palmitoyltransferase I, II, II (late onset), and II (infantile) deficiency; Secondary hypothyroidism; Mandibulofacial dysostosis, Treacher Collins type, autosomal recessive; Cowden syndrome 1; Li-Fraumeni syndrome 1; Asparagine synthetase deficiency; Malattia leventinese; Optic atrophy 9; Infantile convulsions and paroxysmal choreoathetosis, familial; Ataxia with vitamin E deficiency; Islet cell hyperplasia; Miyoshi muscular dystrophy 1; Thrombophilia, hereditary, due to protein C deficiency, autosomal dominant and recessive; Fechtner syndrome; Properdin deficiency, X-linked; Mental retardation, stereotypic movements, epilepsy, and/or cerebral malformations; Creatine deficiency, X-linked; Pilomatrixoma; Cyanosis, transient neonatal and atypical nephropathic; Adult onset ataxia with oculomotor apraxia; Hemangioma, capillary infantile; PC-K6a; Generalized dominant dystrophic epidermolysis bullosa; Pelizaeus-Merzbacher disease; Myopathy, centronuclear, 1, congenital, with excess of muscle spindles, distal, 1, lactic acidosis, and sideroblastic anemia 1, mitochondrial progressive with congenital cataract, hearing loss, and developmental delay, and tubular aggregate, 2; Benign familial neonatal seizures 1 and 2; Primary pulmonary hypertension; Lymphedema, primary, with myelodysplasia; Congenital long QT syndrome; Familial exudative vitreoretinopathy, X-linked; Autosomal dominant hypohidrotic ectodermal dysplasia; Primordial dwarfism; Familial pulmonary capillary hemangiomatosis; Carnitine acylcamitine translocase deficiency; Visceral myopathy; Familial Mediterranean fever and Familial mediterranean fever, autosomal dominant; Combined partial and complete 17-alpha-hydroxylase/17, 20-lyase deficiency; Oto-palato-digital syndrome, type I; Nephrolithiasis/osteoporosis, hypophosphatemic, 2; Familial type 1 and 3 hyperlipoproteinemia; Phenotypes; CHARGE association; Fuhrmann syndrome; Hypotrichosis-lymphedema-telangiectasia syndrome; Chondrodysplasia Blomstrand type; Acroerythrokeratoderma; Slowed nerve conduction velocity, autosomal dominant; Hereditary cancer-predisposing syndrome; Craniodiaphyseal dysplasia, autosomal dominant; Spinocerebellar ataxia autosomal recessive 1 and 16; Proprotein convertase 1/3 deficiency; D-2-hydroxyglutaric aciduria 2; Hyperekplexia 2 and Hyperekplexia hereditary; Central core disease; Opitz G/BBB syndrome; Cystic fibrosis; Thiel-Behnke comeal dystrophy; Deficiency of bisphosphoglycerate mutase; Mitochondrial short-chain Enoyl-CoA Hydratase 1 deficiency; Ectodermal dysplasia skin fragility syndrome; Wolfram-like syndrome, autosomal dominant; Microcytic anemia; Pyruvate carboxylase deficiency; Leukocyte adhesion deficiency type I and III; Multiple endocrine neoplasia, types land 4; Transient bullous dermolysis of the newborn; Primrose syndrome; Non-small cell lung cancer; Congenital muscular dystrophy; Lipase deficiency combined; COLE-CARPENTER SYNDROME 2; Atrioventricular septal defect and common atrioventricular junction; Deficiency of xanthine oxidase; Waardenburg syndrome type 1, 4C, and 2E (with neurologic involvement); Stickler syndrome, types 1 (nonsyndromic ocular) and 4; Comeal fragility keratoglobus, blue sclerae and joint hypermobility; Microspherophakia; Chudley-Mccullough syndrome; Epidermolysa bullosa simplex and limb girdle muscular dystrophy, simplex with mottled pigmentation, simplex with pyloric atresia, simplex, autosomal recessive, and with pyloric atresia; Rett disorder; Abnormality of neuronal migration; Growth hormone deficiency with pituitary anomalies; Leigh disease; Keratosis palmoplantaris striata 1; Weissenbacher-Zweymuller syndrome; Medium-chain acyl-coenzyme A dehydrogenase deficiency; UDPglucose-4-epimerase deficiency; susceptibility to Autism, X-linked 3; Rhegmatogenous retinal detachment, autosomal dominant; Familial febrile seizures 8; Ulna and fibula absence of with severe limb deficiency; Left ventricular noncompaction 6; Centromeric instability of chromosomes 1, 9 and 16 and immunodeficiency; Hereditary diffuse leukoencephalopathy with spheroids; Cushing syndrome; Dopamine receptor d2, reduced brain density of; C-like syndrome; Renal dysplasia, retinal pigmentary dystrophy, cerebellar ataxia and skeletal dysplasia; Ovarian dysgenesis 1; Pierson syndrome; Polyneuropathy, hearing loss, ataxia, retinitis pigmentosa, and cataract; Progressive intrahepatic cholestasis; autosomal dominant, autosomal recessive, and X-linked recessive Alport syndromes; Angelman syndrome; Amish infantile epilepsy syndrome; Autoimmune lymphoproliferative syndrome, type 1a; Hydrocephalus; Marfanoid habitus; Bare lymphocyte syndrome type 2, complementation group E; Recessive dystrophic epidermolysis bullosa; Factor H, VII, X, v and factor viii, combined deficiency of 2, xiii, a subunit, deficiency; Zonular pulverulent cataract 3; Warts, hypogammaglobulinemia, infections, and myelokathexis; Benign hereditary chorea; Deficiency of hyaluronoglucosaminidase; Microcephaly, hiatal hernia and nephrotic syndrome; Growth and mental retardation, mandibulofacial dysostosis, microcephaly, and cleft palate; Lymphedema, hereditary, id; Delayed puberty; Apparent mineralocorticoid excess; Generalized arterial calcification of infancy 2; METHYLMALONIC ACIDURIA, mut(0) TYPE; Congenital heart disease, multiple types, 2; Familial hypoplastic, glomerulocystic kidney; Cerebrooculofacioskeletal syndrome 2; Stargardt disease 1; Mental retardation, autosomal recessive 15, 44, 46, and 5; Prolidase deficiency; Methylmalonic aciduria cblB type; Oguchi disease; Endocrine-cerebroosteodysplasia; Lissencephaly 1, 2 (X-linked), 3, 6 (with microcephaly), X-linked; Somatotroph adenoma; Gamstorp-Wohlfart syndrome; Lipid proteinosis; Inclusion body myopathy 2 and 3; Enlarged vestibular aqueduct syndrome; Osteoporosis with pseudoglioma; Acquired long QT syandrome; Phenylketonuria; CHOPS syndrome; Global developmental delay; Bietti crystalline corneoretinal dystrophy; Noonan syndrome-like disorder with or without juvenile myelomonocytic leukemia; Congenital erythropoietic porphyria; Atrophia bulborum hereditaria; Paragangliomas 3; Van der Woude syndrome; Aromatase deficiency; Birk Barel mental retardation dysmorphism syndrome; Amyotrophic lateral sclerosis type 5; Methemoglobinemia types I 1 and 2; Congenital stationary night blindness, type 1A, IB, 1C, IE, IF, and 2A; Seizures; Thyroid cancer, follicular; Lethal congenital contracture syndrome 6; Distal hereditary motor neuronopathy type 2B; Sex cord-stromal tumor; Epileptic encephalopathy, childhood-onset, early infantile, 1, 19, 23, 25, 30, and 32; Myofibrillar myopathy 1 and ZASP-related; Cerebellar ataxia infantile with progressive external ophthalmoplegia; Purine-nucleoside phosphorylase deficiency; Forebrain defects; Epileptic encephalopathy Lennox-Gastaut type; Obesity; 4, Left ventricular noncompaction 10; Verheij syndrome; Mowat-Wilson syndrome; Odontotrichomelic syndrome; Patterned dystrophy of retinal pigment epithelium; Lig4 syndrome; Barakat syndrome; IRAK4 deficiency; Somatotroph adenoma; Branched-chain ketoacid dehydrogenase kinase deficiency; Cystinuria; Familial aplasia of the vermis; Succinyl-CoA acetoacetate transferase deficiency; Scapuloperoneal spinal muscular atrophy; Pigmentary retinal dystrophy; Glanzmann thrombasthenia; Primary open angle glaucoma juvenile onset 1; Aicardi Goutieres syndromes 1, 4, and 5; Renal dysplasia; Intrauterine growth retardation, metaphyseal dysplasia, adrenal hypoplasia congenita, and genital anomalies; Beaded hair; Short stature, onychodysplasia, facial dysmorphism, and hypotrichosis; Metachromatic leukodystrophy; Cholestanol storage disease; Three M syndrome 2; Leber congenital amaurosis 11, 12, 13, 16, 4, 7, and 9; Mandibuloacral dysplasia with type A or B lipodystrophy, atypical; Meier-Gorlin syndromes land 4; Hypotrichosis 8 and 12; Short QT syndrome 3; Ectodermal dysplasia 1 ib; Anonychia; Pseudohypoparathyroidism type 1A, Pseudopseudohypoparathyroidism; Leber optic atrophy; Bainbridge-Ropers syndrome; Weaver syndrome; Short stature, auditory canal atresia, mandibular hypoplasia, skeletal abnormalities; Deficiency of alpha-mannosidase; Macular dystrophy, vitelliform, adult-onset; Glutaric aciduria, type 1; Gangliosidosis GM1 typeI (with cardiac involvement) 3; Mandibuloacral dysostosis; Hereditary lymphedema type I; Atrial standstill 2; Kabuki make-up syndrome; Bethlem myopathy and Bethlem myopathy 2; Myeloperoxidase deficiency; Fleck corneal dystrophy; Hereditary acrodermatitis enteropathica; Hypobetalipoproteinemia, familial, associated with apob32; Cockayne syndrome type A; Hyperparathyroidism, neonatal severe; Ataxia-telangiectasia-like disorder; Pendred syndrome; I blood group system; Familial benign pemphigus; Visceral heterotaxy 5, autosomal; Nephrogenic diabetes insipidus, Nephrogenic diabetes insipidus, X-linked; Minicore myopathy with external ophthalmoplegia; Perry syndrome; hypohidrotic/hair/tooth type, autosomal recessive; Hereditary pancreatitis; Mental retardation and microcephaly with pontine and cerebellar hypoplasia; Glycogen storage disease 0 (muscle), II (adult form), IXa2, IXc, type 1A; Osteopathia *striata* with cranial sclerosis; Gluthathione synthetase deficiency; Brugada syndrome and Brugada syndrome 4; Endometrial carcinoma; Hypohidrotic ectodermal dysplasia with immune deficiency; Cholestasis, intrahepatic, of pregnancy 3; Bemard-Soulier syndrome, types A1 and A2 (autosomal dominant); Salla disease; Ornithine aminotransferase deficiency; PTEN hamartoma tumor syndrome; Distichiasis-lymphedema syndrome; Corticosteroid-binding globulin deficiency; Adult neuronal ceroid lipofuscinosis; Dejerine-Sottas disease; Tetraamelia, autosomal recessive; Senior-Loken syndrome 4 and 5; Glutaric acidemia IIA and IIB; Aortic aneurysm, familial thoracic 4, 6, and 9; Hyperphosphatasia with mental retardation syndrome 2, 3, and 4; Dyskeratosis congenita X-linked; Arthrogryposis, renal dysfunction, and cholestasis 2; Bannayan-Riley-Ruvalcaba syndrome; 3-Methylglutaconic aciduria; Isolated 17,20-lyase deficiency; Gorlin syndrome; Hand foot uterus syndrome; Tay-Sachs disease, B1 variant, Gm2-gangliosidosis (adult), Gm2-gangliosidosis (adult-onset); Dowling-degos disease 4; Parkinson disease 14, 15, 19 (juvenile-onset), 2, 20 (early-onset), 6, (autosomal recessive early-onset, and 9; Ataxia, sensory, autosomal dominant; Congenital microvillous atrophy; Myoclonic-Atonic Epilepsy; Tangier disease; 2-methyl-3-hydroxybutyric aciduria; Familial renal hypouricemia; Schizencephaly; Mitochondrial DNA depletion syndrome 4B, MNGIE type; Feingold syndrome 1; Renal carnitine transport defect; Familial hypercholesterolemia; Townes-Brocks-branchiootorenal-like syndrome; Griscelli syndrome type 3; Meckel-Gruber syndrome; Bullous ichthyosiform erythroderma; Neutrophil immunodeficiency syndrome; Myasthenic Syndrome, Congenital, 17, 2A (slow-channel), 4B (fast-channel), and without tubular aggregates; Microvascular complications of diabetes 7; McKusick Kaufman syndrome; Chronic granulomatous disease, autosomal recessive cytochrome b-positive, types 1 and 2; Arginino succinate lyase deficiency; Mitochondrial phosphate carrier and pyruvate carrier deficiency; Lattice corneal dystrophy Type III; Ectodermal dysplasia-syndactyly syndrome 1; Hypomyelinating leukodystrophy 7; Mental retardation, autosomal dominant 12, 13, 15, 24, 3, 30, 4, 5, 6, and 9; Generalized epilepsy with febrile seizures plus, types 1 and 2; Psoriasis susceptibility 2; Frank Ter Haar syndrome; Thoracic aortic aneurysms and aortic dissections; Crouzon syndrome; Granulosa cell tumor of the ovary; Epidermolytic palmoplantar keratoderma; Leri Weill dyschondrosteosis; 3 beta-Hydroxysteroid dehydrogenase deficiency; Familial restrictive cardiomyopathy 1; Autosomal dominant progressive external ophthalmoplegia with mitochondrial DNA deletions 1 and 3; Antley-Bixler syndrome with genital anomalies and disordered steroidogenesis; Hajdu-Cheney syndrome; Pigmented nodular adrenocortical disease, primary, 1; Episodic pain syndrome, familial, 3; Dejerine-Sottas syndrome, autosomal dominant; FG syndrome and FG syndrome 4; Dendritic cell, monocyte, B lymphocyte, and natural killer lymphocyte deficiency; Hypothyroidism, congenital, nongoitrous, 1; Miller syndrome; Nemaline myopathy 3 and 9; Oligodontia-colorectal cancer syndrome; Cold-induced sweating syndrome 1; Van Buchem disease type 2; Glaucoma 3, primary congenital, d; Citrullinemia type I and II; Nonaka myopathy; Congenital muscular dystrophy due to partial LAMA2 deficiency; Myoneural gastrointestinal encephalopathy syndrome; Leigh syndrome due to mitochondrial complex I deficiency; Medulloblastoma; Pyruvate dehydrogenase E1-alpha deficiency; Carcinoma of colon; Nance-Horan syndrome; Sandhoff disease, adult and infantil types; Arthrogryposis renal dysfunction cholestasis syndrome; Autosomal recessive hypophosphatemic bone disease; Doyne honeycomb retinal dystrophy; Spinocerebellar ataxia 14, 21, 35, 40, and 6; Lewy body dementia; RRM2B-related mitochondrial disease; Brody myopathy; Megalencephaly-polymicrogyria-polydactyly-hydrocephalus syndrome 2; Usher syndrome, types 1, IB, ID, 1G, 2A, 2C, and 2D; hypocalcification type and hypomaturation type, IIA1 Amelogenesis imperfecta; Pituitary hormone deficiency, combined 1, 2, 3, and 4; Cushing symphalangism; Renal tubular acidosis, distal, autosomal recessive, with late-onset sensorineural hearing loss, or with hemolytic anemia; Infantile nephronophthisis; Juvenile polyposis syndrome; Sensory ataxic neuropathy, dysarthria, and ophthalmoparesis; Deficiency of 3-hydroxyacyl-CoA dehydrogenase; Parathyroid carcinoma; X-linked agammaglobulinemia; Megaloblastic anemia, thiamine-responsive, with diabetes mellitus and sensorineural deafness; Multiple sulfatase deficiency; Neurodegeneration with brain iron accumulation 4 and 6; Cholesterol monooxygenase (side-chain cleaving) deficiency; hemolytic anemia due to Adenylosuccinate lyase deficiency; Myoclonus with epilepsy with ragged red fibers; Pitt-Hopkins syndrome; Multiple pterygium syndrome Escobar type; Homocystinuria-Megaloblastic anemia due to defect in cobalamin metabolism, cblE complementation type; Cholecystitis; Spherocytosis types 4 and 5; Multiple congenital anomalies; Xeroderma pigmentosum, complementation group b, group D, group E, and group G; Leiner disease; Groenouw corneal dystrophy type I; Coenzyme Q10 deficiency, primary 1, 4, and 7; Distal spinal muscular atrophy, congenital nonprogressive; Warburg micro syndrome 2 and 4; Bile acid synthesis defect, congenital, 3; Acth-independent macronodular adrenal hyperplasia 2; Acrocapitofemoral dysplasia; Paget disease of bone, familial; Severe neonatal-onset encephalopathy with microcephaly; Zimmermann-Laband syndrome and Zimmermann-Laband syndrome 2; Reifenstein syndrome; Familial hypokalemia-hypomagnesemia; Photosensitive trichothiodystrophy; Adult junctional epidermolysis bullosa; Lung cancer; Freeman-Sheldon syndrome; Hyperinsulinism-hyperammonemia syndrome; Posterior polar cataract type 2; Sclerocornea, autosomal recessive; Juvenile GM>1<gangliosidosis; Cohen syndrome, Hereditary Paraganglioma-Pheochromocytoma Syndromes; Neonatal insulin-dependent diabetes mellitus; Hypochondrogenesis; Floating-Harbor syndrome; Cutis *laxa* with osteodystrophy and with severe pulmonary, gastrointestinal, and urinary abnormalities; Congenital contractures of the limbs and face, hypotonia, and developmental delay; Dyskeratosis congenita autosomal dominant and autosomal dominant, 3; Histiocytic medullary reticulosis; Costello syndrome; Immunodeficiency 15, 16, 19, 30, 31C, 38, 40, 8, due to defect in cd3-zeta, with hyper IgM type 1 and 2, and X-Linked, with magnesium defect, Epstein-Barr vims infection, and neoplasia; Atrial septal defects 2, 4, and 7 (with or without atrioventricular conduction defects); GTP cyclohydrolase I deficiency; Talipes equinovarus; Phosphoglycerate kinase 1 deficiency; Tuberous sclerosis 1 and 2; Autosomal recessive congenital ichthyosis 1, 2, 3, 4A, and 4B; and Familial hypertrophic cardiomyopathy 1, 2, 3, 4, 7, 10, 23 and 24.

Indications by Tissue

Additional suitable diseases and disorders that can be treated by the systems and methods provided herein include, without limitation, diseases of the central nervous system (CNS) (see exemplary diseases and affected genes in Table 13), diseases of the eye (see exemplary diseases and affected genes in Table 14), diseases of the heart (see exemplary diseases and affected genes in Table 15), diseases of the hematopoietic stem cells (HSC) (see exemplary diseases and affected genes in Table 16), diseases of the kidney (see exemplary diseases and affected genes in Table 17), diseases of the liver (see exemplary diseases and affected genes in Table 18), diseases of the lung (see exemplary diseases and affected genes in Table 19), diseases of the skeletal muscle (see exemplary diseases and affected genes in Table 20), and diseases of the skin (see exemplary diseases and affected genes in Table 21). Table 22 provides exemplary protective mutations that reduce risks of the indicated diseases. In some embodiments, a Gene Writer system described herein is used to treat an indication of any of Tables 13-21. In some embodiments, the GeneWriter system modifies a target site in genomic DNA in a cell, wherein the target site is in a gene of any of Tables 13-21, e.g., in a subject having the corresponding indication listed in any of Tables 13-21. In some embodiments, the GeneWriter corrects a mutation in the gene. In some embodiments, the GeneWriter inserts a sequence that had been deleted from the gene (e.g., through a disease-causing mutation). In some embodiments, the GeneWriter deletes a sequence that had been duplicated in the gene (e.g., through a disease-causing mutation). In some embodiments, the GeneWriter replaces a mutation (e.g., a disease-causing mutation) with the corresponding wild-type sequence. In some embodiments, the mutation is a substitution, insertion, deletion, or inversion.

TABLE 13

CNS diseases and genes affected.

| Disease | Gene Affected |
| --- | --- |
| Alpha-mannosidosis | MAN2B1 |
| Ataxia-telangiectasia | ATM |
| CADASIL | NOTCH3 |
| Canavan disease | ASPA |
| Carbamoyl-phosphate synthetase 1 deficiency | CPS1 |
| CLN1 disease | PPT1 |
| CLN2 Disease | TPP1 |
| CLN3 Disease (Juvenile neuronal ceroid lipofuscinosis, Batten Disease) | CLN3 |
| Coffin-Lowry syndrome | RPS6KA3 |
| Congenital myasthenic syndrome 5 | COLQ |
| Cornelia de Lange syndrome (NIPBL) | NIPBL |
| Cornelia de Lange syndrome (SMC1A) | SMC1A |
| Dravet syndrome (SCN1A) | SCN1A |
| Glycine encephalopathy (GLDC) | GLDC |
| GM1 gangliosidosis | GLB1 |
| Huntington's Disease | HTT |
| Hydrocephalus with stenosis of the aqueduct of Sylvius | L1CAM |
| Leigh Syndrome | SURF1 |
| Metachromatic leukodystrophy (ARSA) | ARSA |
| MPS type 2 | IDS |
| MPS type 3 | Type 3a: SGSH<br>Type 3b: NAGLU |
| Mucolipidosis IV | MCOLN1 |
| Neurofibromatosis Type 1 | NF1 |
| Neurofibromatosis type 2 | NF2 |
| Pantothenate kinase-associated neurodegeneration | PANK2 |
| Pyridoxine-dependent epilepsy | ALDH7A1 |
| Rett syndrome (MECP2) | MECP2 |
| Sandhoff disease | HEXB |
| Semantic dementia (Frontotemporal dementia) | MAPT |
| Spinocerebellar ataxia with axonal neuropathy (Ataxia with Oculomotor Apraxia) | SETX |
| Tay-Sachs disease | HEXA |
| X-linked Adrenoleukodystrophy | ABCD1 |

TABLE 14

Eye diseases and genes affected.

| Disease | Gene Affected |
| --- | --- |
| Achromatopsia | CNGB3 |
| Amaurosis Congenita (LCA1) | GUCY2D |
| Amaurosis Congenita (LCA10) | CEP290 |
| Amaurosis Congenita (LCA2) | RPE65 |
| Amaurosis Congenita (LCA8) | CRB1 |
| Choroideremia | CHM |
| Cone Rod Dystrophy (ABCA4) | ABCA4 |
| Cone Rod Dystrophy (CRX) | CRX |
| Cone Rod Dystrophy (GUCY2D) | GUCY2D |
| Cystinosis, Ocular Nonnephropathic | CTNS |
| Lattice corneal dystrophy type I | TGFBI |
| Macular Corneal Dystrophy (MCD) | CHST6 |
| Optic Atrophy | OPA1 |
| Retinitis Pigmentosa (AR) | USH2A |
| Retinitis Rigmentosa (AD) | RHO |
| Stargardt Disease | ABCA4 |
| Vitelliform Macular Dystrophy | BEST1; PRPH2 |

TABLE 15

Heart diseases and genes affected.

| Disease | Gene Affected |
| --- | --- |
| Arrhythmogenic right ventricular cardiomyopathy (ARVC) | PKP2 |
| Barth syndrome | TAZ |
| Becker muscular dystrophy | DMD |
| Brugada syndrome | SCN5A |
| Catecholaminergic polymorphic ventricular tachycardia (RYR2) | |
| Dilated cardiomyopathy (LMNA) | LMNA |
| Dilated cardiomyopathy (TTN) | TTN |
| Duchenne muscular dystrophy | DMD |
| Emery-Dreifuss Muscular Dystrophy Type I | EMD |
| Familial hypertrophic cardiomyopathy | MYH7 |
| Familial hypertrophic cardiomyopathy | MYBPC3 |
| Jervell Lange-Nielsen syndrome | KCNQ1 |
| LCHAD deficiency | HADHA |
| Limb-girdle muscular dystrophy type 1B (Emery-Dreifuss EDMD2) | LMNA |
| Limb-girdle muscular dystrophy, type 2D | SGCA |
| Long QT syndrome 1 (Romano Ward) | KCNQ1 |

TABLE 16

HSC diseases and genes affected.

| Disease | Gene Affected |
| --- | --- |
| ADA-SCID | ADA |
| Adrenoleukodystrophy (CALD) | ABCD1 |
| Alpha-mannosidosis | MAN2B1 |
| Chronic granulomatous disease | CYBB; CYBA; NCF1; NCF2; NCF4 |
| Common variable immunodeficiency | TNFRSF13B |
| Fanconi anemia | FANCA; FANCC; FANCG |
| Gaucher disease | GBA |
| Globoid cell leukodystrophy (Krabbe disease) | GALC |

TABLE 16-continued

HSC diseases and genes affected.

| Disease | Gene Affected |
|---|---|
| Hemophagocytic lymphohistiocytosis | PRF1; STX11; STXBP2; UNC13D |
| IL-7R SCID | IL7R |
| JAK-3 SCID | JAK3 |
| Malignant infantile osteopetrosis-autosomal recessive osteopetrosis | TCIRG1; Many genes implicated |
| Metachromatic leukodystrophy | ARSA; PSAP |
| MPS 1S (Scheie syndrome) | IDUA |
| MPS2 | IDS |
| MPS7 | GUSB |
| Mucolipidosis II | GNPTAB |
| Niemann-Pick disease A and B | SMPD1 |
| Niemann-Pick disease C | NPC1 |
| Paroxysmal Nocturnal Hemoglobinuria | PIGA |
| Pompe disease | GAA |
| Pyruvate kinase deficiency (PKD) | PKLR |
| RAG ½ Deficiency (SCID with granulomas) | RAG1/RAG2 |
| Severe Congenital Neutropenia | ELANE; HAX1 |
| Sickle cell disease (SCD) | HBB |
| Tay Sachs | HEXA |
| Thalassemia | HBB |
| Wiskott-Aldrich Syndrome | WAS |
| X-linked agammaglobulinemia | BTK |
| X-linked SCID | IL2RG |

TABLE 17

Kidney diseases and genes affected.

| Disease | Gene Affected |
|---|---|
| Alport syndrome | COL4A5 |
| Autosomal dominant polycystic kidney disease (PKD1) | PKD1 |
| Autosomal dominant polycystic kidney disease (PKD2) | PDK2 |
| Autosomal dominant tubulointerstitial kidney disease (MUC1) | MUC1 |
| Autosomal dominant tubulointerstitial kidney disease (UMOD) | UMOD |
| Autosomal recessive polycystic kidney disease | PKHD1 |
| Congenital nephrotic syndrome | NPHS2 |
| Cystinosis | CTNS |

TABLE 18

Liver diseases and genes affected.

| Disease | Gene Affected |
|---|---|
| Acute intermittent porphyria | HMBS |
| Alagille syndrome | JAG1 |
| Alpha-1-antitrypsin deficiency | SERPINA1 |
| Carbamoyl phosphate synthetase I deficiency | CPS1 |
| Citrullinemia I | ASS1 |
| Crigler-Najjar | UGT1A1 |
| Fabry | LPL |
| Familial chylomicronemia syndrome | GLA |
| Gaucher | GBE1 |
| GSD IV | GBA |
| Heme A | F8 |
| Heme B | F9 |
| Hereditary amyloidosis (hTTR) | TTR |
| Hereditary angioedema | SERPING1 (KLKB1 for CRISPR) |
| HoFH | LDLRAP1 |
| Hypercholesterolemia | PCSK9 |
| Methylmalonic acidemia | MMUT |
| MPS II | IDS |
| MPS III | Type IIIa: SGSH |
|  | Type IIIb: NAGLU |
|  | Type IIIc: HGSNAT |
|  | Type IIId: GNS |
| MPS IV | Type IVA: GALNS |
|  | Type IVB: GLB1 |
| MPS VI | ARSB |
| MSUD | Type Ia: BCKDHA |
|  | Type Ib: BCKDHB |
|  | Type II: DBT |
| OTC Deficiency | OTC |
| Polycystic Liver Disease | PRKCSH |
| Pompe | GAA |
| Primary Hyperoxaluria 1 | AGXT (HAO1 or LDHA for CRISPR) |
| Progressive familial intrahepatic cholestasis type 1 | ATP8B1 |
| Progressive familial intrahepatic cholestasis type 2 | ABCB11 |
| Progressive familial intrahepatic cholestasis type 3 | ABCB4 |
| Propionic acidemia | PCCB; PCCA |
| Wilson's Disease | ATP7B |
| Glycogen storage disease, Type Ia | G6PC |
| Glycogen storage disease, Type IIIb | AGL |
| Isovaleric acidemia | IVD |
| Wolman disease | LIPA |

TABLE 19

Lung diseases and genes affected.

| Disease | Gene Affected |
|---|---|
| Alpha-1 antitrypsin deficiency | SERPINA1 |
| Cystic fibrosis | CFTR |
| Primary ciliary dyskinesia | DNAI1 |
| Primary ciliary dyskinesia | DNAH5 |
| Primary pulmonary hypertension I | BMPR2 |
| Surfactant Protein B (SP-B) Deficiency (pulmonary surfactant metabolism dysfunction 1) | SFTPB |

TABLE 20

Skeletal muscle diseases and genes affected.

| Disease | Gene Affected |
|---|---|
| Becker muscular dystrophy | DMD |
| Becker myotonia | CLCN1 |
| Bethlem myopathy | COL6A2 |
| Centronuclear myopathy, X-linked (myotubular) | MTM1 |
| Congenital myasthenic syndrome | CHRNE |
| Duchenne muscular dystrophy | DMD |
| Emery-Dreifuss muscular dystrophy, AD | LMNA |
| Facioscapulohumeral Muscular Dystrophy | DUX4-D4Z4 chromosomal region |
| Hyperkalemic periodic paralysis | SCN4A |
| Hypokalemic periodic paralysis | CACNA1S |
| Limb-girdle muscular dystrophy 2A | CAPN3 |
| Limb-girdle muscular dystrophy 2B | DYSF |
| Limb-girdle muscular dystrophy, type 2D | SGCA |
| Miyoshi muscular dystrophy 1 | DYSF |
| Paramyotonia congenita | SCN4A |
| Thomsen myotonia | CLCN1 |
| VCP myopathy (IBMPFD) 1 | VCP |

TABLE 21

Skin diseases and genes affected.

| Disease | Gene Affected |
|---|---|
| Epidermolysis Bullosa Dystrophica Dominant | COL7A1 |
| Epidermolysis Bullosa Dystrophica Recessive (Hallopeau-Siemens) | COL7A1 |
| Epidermolysis Bullosa Junctional | LAMB3 |
| Epidermolysis Bullosa Simplex | KRT5; KRT14 |
| Epidermolytic Ichthyosis | KRT1; KRT10 |
| Hailey-Hailey Disease | ATP2C1 |
| Lamellar Ichthyosis/Nonbullous Congenital Ichthyosiform Erythroderma (ARCI) | TGM1 |
| Netherton Syndrome | SPINK5 |

TABLE 22

Exemplary protective mutations that reduce disease risk.

| Disease | Gene | Exemplary Protective Mutation |
|---|---|---|
| Alzheimer's | APP | A673T |
| Parkinson's | SGK1 | |
| Diabetes (Type II) | SLC30A8 | p.Arg138X; p.Lys34SerfsX50 |
| Cardiovascular Disease | PCSK9 | R46L |
| Cardiovascular Disease | ASGR1 | NM_001671.4, c.284-36_283+33delCTGGGGCTGGGG (SEQ ID NO: 1619); NP_001662.1, p.W158X |
| Cardiovascular Disease | NPC1L1 | p.Arg406X |
| Cardiovascular Disease | APOC3 | R19X; IVS2+1G→A; A43T |
| Cardiovascular Disease | LPA | |
| Cardiovascular Disease | ANGPTL4 | E40K |
| Cardiovascular Disease | ANGPTL3 | p.Ser17Ter; p.Asn121fs; p.Asn147fs; c.495+6T→C |
| HIV infection | CCR5 | CCR5-delta32 |

Pathogenic Mutations

In some embodiments, the systems or methods provided herein can be used to correct a pathogenic mutation. The pathogenic mutation can be a genetic mutation that increases an individual's susceptibility or predisposition to a certain disease or disorder. In some embodiments, the pathogenic mutation is a disease-causing mutation in a gene associated with a disease or disorder. In some embodiments, the systems or methods provided herein can be used to revert the pathogenic mutation to its wild-type counterpart. In some embodiments, the systems or methods provided herein can be used to change the pathogenic mutation to a sequence not causing the disease or disorder.

Table 23 provides exemplary indications (column 1), underlying genes (column 2), and pathogenic mutations that can be corrected using the systems or methods described herein (column 3).

TABLE 23

Indications, genes, and causitive pathogenic mutations.

| Disease | Gene | Pathogenic Mutation[#] |
|---|---|---|
| Achromatopsia | CNGB3 | 1148delC |
| Alpha-1 Antitrypsin Deficiency | SERPINAI | E342K |
| Alpha-1 Antitrypsin Deficiency | SERPINAI | E342K |
| Alpha-1 Antitrypsin Deficiency | SERPINAI | R48C (R79C) |
| Amaurosis Congenita (LCA10) | CEP290 | 2991 + 1655A > G |
| Andersen-Tawil syndrome | KCNJ2 | R218W |
| Arrhythmogenic right ventricular cardiomyopathy (ARVC) | PKP2 | c.235C > T |
| associated with congenital factor XI deficiency | F11 | E117* |
| associated with congenital factor XI deficiency | F11 | F283L |
| ATTR amyloidosis | TTR | V50M/N30M |
| autosomal dominant deafness | COCH | G88E |
| autosomal dominant deafness | TECTA | Y1870C |
| autosomal dominant Parkinson's disease | SNCA | A53T |
| autosomal dominant Parkinson's disease | SNCA | A30P |

TABLE 23-continued

Indications, genes, and causitive pathogenic mutations.

| Disease | Gene | Pathogenic Mutation# |
|---|---|---|
| Autosomal dominant rickets | FGF23 | R176Q |
| autosomal recessive deafness | CX30 | T5M |
| autosomal recessive deafness | DFNB59 | R183W |
| autosomal recessive deafness | TMC1 | Y182C |
| autosomal recessive hypercholesterolemia | ARH | Q136* |
| Blackfan-Diamond anemia | RPS19 | R62Q |
| blue-cone monochromatism | OPN1LW | C203R |
| Brugada syndrome | SCN5A | E1784K |
| CADASIL syndrome | NOTCH3 gene | R90C |
| CADASIL syndrome | NOTCH3 gene | R141C |
| Canavan disease | ASPA | E285A |
| Canavan disease | ASPA | Y231X |
| Canavan disease | ASPA | A305E |
| carnitine palmitoyltransferase II deficiency | CPT2 | S113L |
| choroideremia | CHM | R293* |
| choroideremia | CHM | R270* |
| choroideremia | CHM | A117A |
| Citrullinemia Type I | ASS | G390R |
| classic galactosemia | GALT | Q188R |
| classic homocysteinuria | CBS | T191M |
| classic homocysteinuria | CBS | G307S |
| CLN2 Disease | TPP1 | c.509-1 G > C |
| CLN2 Disease | TPP1 | c.622 C > T |
| CLN2 Disease | TPP1 | c.851 G > T |
| cone-rod dystrophy | GUCY2D | R838C |
| congenital factor V deficiency | F5 | R506Q |
| congenital factor V deficiency | F5 | R534Q |
| congenital factor VII deficiency | F7 | A294V |
| congenital factor VII deficiency | F7 | C310F |
| congenital factor VII deficiency | F7 | R304Q |
| congenital factor VII deficiency | F7 | QI00R |
| Creutzfeldt-Jakob disease (CJD) | PRNP | E200K |
| Creutzfeldt-Jakob disease (CJD) | PRNP | M129V |
| Creutzfeldt-Jakob disease (CJD) | PRNP | P102L |
| Creutzfeldt-Jakob disease (CJD) | PRNP | D178N |
| cystic fibrosis | CFTR | G551D |
| cystic fibrosis | CFTR | W1282* |
| cystic fibrosis | CFTR | R553* |
| cystic fibrosis | CFTR | R117H |
| cystic fibrosis | CFTR | delta F508 |
| cystinosis | CTNS | W138* |
| Darier disease | ATP2A2 | N767S |
| Darier disease | ATP2A2 | N767S |
| Darier disease | ATP2A2 | N767S |
| Epidermolysis Bullosa Junctional | LAMB3 | R42X |
| Epidermolysis Bullosa Junctional | LAMB3 | R635X |
| familial amyotrophic lateral sclerosis (ALS) | SOD1 | A4V |
| familial amyotrophic lateral sclerosis (ALS) | SOD1 | H46R |
| familial amyotrophic lateral sclerosis (ALS) | SOD1 | G37R |
| Gaucher disease | GBA | N370S |
| Gaucher disease | GBA | N370S |
| Gaucher disease | GBA | L444P |
| Gaucher disease | GBA | L444P |
| Gaucher disease | GBA | L483P |
| glutaryl-CoA dehydrogenase deficiency | GCDH | R138G |
| glutaryl-CoA dehydrogenase deficiency | GCDH | M263V |
| glutaryl-CoA dehydrogenase deficiency | GCDH | R402W |
| glycine encephalopathy | GLDC | A389V |
| glycine encephalopathy | GLDC | G771R |
| glycine encephalopathy | GLDC | T269M |
| hemophilia A | F8 | R2178C |
| hemophilia A | F8 | R550C |
| hemophilia A | F8 | R2169H |
| hemophilia A | F8 | R1985Q |
| hemophilia B | F9 | T342M |
| hemophilia B | F9 | R294Q |
| hemophilia B | F9 | R43Q |
| hemophilia B | F9 | R191H |
| hemophilia B | F9 | G106S |
| hemophilia B | F9 | A279T |
| hemophilia B | F9 | R75* |
| hemophilia B | F9 | R294* |
| hemophilia B | F9 | R379Q |
| Hereditary antithrombin deficiency type I | SERPINCI | R48C (R79C) |
| hereditary chronic pancreatitis | PRSS1 | R122H |
| Hunter syndrome | IDS | R88C |

TABLE 23-continued

Indications, genes, and causitive pathogenic mutations.

| Disease | Gene | Pathogenic Mutation# |
|---|---|---|
| Hunter syndrome | IDS | G374G |
| Hurler syndrome (MPS1) | IDUA | Q70* |
| Hurler syndrome (MPS1) | IDUA | W402* |
| Hyperkalemic periodic paralysis | SCN4A | T704M |
| Hyperkalemic periodic paralysis | SCN4A | M1592V |
| Hyperkalemic periodic paralysis | CACNA1S | p.Arg528X |
| Hyperkalemic periodic paralysis | CACNA1S | p.Arg1239 |
| intermittent porphyria | HMBS | R173W |
| isolated agammaglobulinemia | E47 | E555K |
| Lattice corneal dystrophy type I | TGFBI | Arg124Cys |
| LCHAD deficiency | HADHA | Glu474Gln |
| Leber congenital amaurosis 2 | RPE65 | R44* |
| Leber congenital amaurosis 2 | RPE65 | IVS1 |
| Leber congenital amaurosis 2 | RPE65 | G-A, +5 |
| Lesch-Nyhan syndrome | HPRTI | R51* |
| Lesch-Nyhan syndrome | HPRTI | R170* |
| Limb-girdle muscular dystrophy, type 2D | SGCA | Arg77Cys |
| Marteauz-Lamy Syndrome (MSPVI) | ARSB | Y210C |
| Mediterranean G6PD deficiency | G6PD | S188D |
| medium-chain acyl-CoA dehydrogenase deficiency | ACADM | K329E |
| medium-chain acyl-CoA dehydrogenase deficiency | ACADM | K329E |
| medium-chain acyl-CoA dehydrogenase deficiency | ACADM | K329E |
| Meesmann epithelial corneal dystrophy | KRT12 | L132P |
| metachromatic leukodystrophy | ARSA | P426L |
| metachromatic leukodystrophy | ARSA | c.459 + 1G > A |
| Morquio Syndrome (MPSIVA) | GALNS | R386C |
| Mucolipidosis IV | MCOLN1 | 406-2A > G |
| Mucolipidosis IV | MCOLN1 | 511_6943del |
| Neimann-Pick disease type A | SMPDI | L302P |
| Neuronal ceroid lipofuscinosis (NCL) | CLN2 | R208* |
| neuronal ceroid lipofuscinosis 1 | PPT1 | R151* |
| Parkinson's disease | LRRK2 | G2019S |
| Pendred syndrome | PDS | T461P |
| Pendred syndrome | PDS | L236P |
| Pendred syndrome | PDS | c.1001 + 1G > A |
| Pendred syndrome | PDS | IVS8, + 1 G > A, |
| phenylketonuria | PAH | R408W |
| phenylketonuria | PAH | I65T |
| phenylketonuria | PAH | R261Q |
| phenylketonuria | PAH | IVS10-11G > A |
| phenylketonuria | PCDH15 | R245* |
| phenylketonuria | PCDH15 | R245* |
| Pompe disease | GAA | c .-32-13T > G |
| Primary ciliary dyskinesia | DNAI1 | IVS1+2_3insT |
| Primary ciliary dyskinesia | DNAH5 | 10815delT |
| primary hypoxaluria | AGXT | G170R |
| Progressive familial intrahepatic cholestasis type 2 | ABCB11 | D482G (c.1445A > G) |
| Progressive familial intrahepatic cholestasis type 2 | ABCB11 | E297G |
| Propionic acidemia | PCCB; PCCA | c.1218_1231del14ins12 |
| pseudoxanthoma elasticum | ABCC6 | R1141* |
| Pyruvate kinase deficiency (PKD) | PKLR | c.1456c- > T |
| retinitis pigmentos | USH2a | C759F |
| retinitis pigmentosa | IMPDHI | D226N |
| retinitis pigmentosa | PDE6A | V685M |
| retinitis pigmentosa | PDE6A | D670G |
| retinitis pigmentosa | PRPF3 | T494M |
| retinitis pigmentosa | PRPF8 | H2309R |
| retinitis pigmentosa | RHO | P23H |
| retinitis pigmentosa | RHO | P347L |
| retinitis pigmentosa | RHO | P347L |
| retinitis pigmentosa | RHO | D190N |
| retinitis pigmentosa | RPI | R667* |
| retinitis pigmentosa/Usher syndrome type 1C | USH1C | V72V |
| Rett syndrome | MECP2 | R106W |
| Rett syndrome | MECP2 | R133C |
| Rett syndrome | MECP2 | R306C |
| Rett syndrome | MECP2 | R168* |
| Rett syndrome | MECP2 | R255* |
| Sanfilippo syndrome A (MPSIIIA) | SGSH | R74C |
| Sanfilippo syndrome A (MPSIIIA) | SGSH | R245H |
| Sanfilippo syndrome B (MPSIIIB) | NAGLU | R297* |

TABLE 23-continued

Indications, genes, and causitive pathogenic mutations.

| Disease | Gene | Pathogenic Mutation[#] |
|---|---|---|
| Sanfilippo syndrome B (MPSIIIB) | NAGLU | Y140C |
| severe combined immunodeficiency | ADA | G216R |
| severe combined immunodeficiency | ADA | G216R |
| severe combined immunodeficiency | ADA | Q3* |
| sickle cell disease | HBB | E6V |
| sickle cell disease | HBB | E6V |
| sickle cell disease | HBB | E6V |
| sickle cell disease | HBB | E26K |
| sickle cell disease | HBB | E26K |
| sickle cell disease | HBB | E7K |
| sickle cell disease | HBB | c.−138C > T |
| sickle cell disease | HBB | IVS2 |
| sickle cell disease | HBB | 654 C > T |
| Sly Syndrome (MPSVII) | GUSB | L175F |
| Stargardt disease | ABCA4 | A1038V |
| Stargardt disease | ABCA4 | A1038V |
| Stargardt disease | ABCA4 | L541P |
| Stargardt disease | ABCA4 | G1961E |
| Stargardt disease | ABCA4 | G1961E |
| Stargardt disease | ABCA4 | G1961E |
| Stargardt disease | ABCA4 | G1961E |
| Stargardt disease | ABCA4 | c.2588G > C |
| Stargardt disease | ABCA4 | c.5461-10 T > C |
| Stargardt disease | ABCA4 | c.5714 + 5G > A |
| Tay Sachs | HEXA | InsTATC1278 |
| tyrosinemia type 1 | FAH | P261L |
| Usher syndrome type 1F | PCDH15 | R245* |
| variegate porphyria | PPOX | R59W |
| VCP myopathy (IBMPFD) 1 | VCP | R1555X |
| von Gierke disease | G6PC | Q347* |
| von Gierke disease | G6PC | Q347* |
| von Gierke disease | G6PC | Q347* |
| von Gierke disease | G6PC | R83C |
| Wilson's Disease | ATP7B | E297G |
| X-linked myotubular myopathy | MTMI | c.1261-10A > G |
| X-linked retinoschisis | RS1 | R102W |
| X-linked retinoschisis | RS1 | R141C |

[#]See J T den Dunnen and S E Antonarakis, Hum Mutat. 2000;15(1):7-12, herein incorporated by reference in its entirety, for details of the nomenclatures of gene mutations.
*means a stop codon.

Compensatory Edits

In some embodiments, the systems or methods provided herein can be used to introduce a compensatory edit. In some embodiments, the compensatory edit is at a position of a gene associated with a disease or disorder, which is different from the position of a disease-causing mutation. In some embodiments, the compensatory mutation is not in the gene containing the causitive mutation. In some embodiments, the compensatory edit can negate or compensate for a disease-causing mutation. In some embodiments, the compensatory edit can be introduced by the systems or methods provided herein to suppress or reverse the mutant effect of a disease-causing mutation.

Table 24 provides exemplary indications (column 1), genes (column 2), and compensatory edits that can be introduced using the systems or methods described herein (column 3). In some embodiments, the compensatory edits provided in Table 24 can be introduced to suppress or reverse the mutant effect of a disease-causing mutation.

TABLE 24

Indications, genes, compensatory edits, and exemplary design features.

| Disease | Gene | Nucleotide Change[#] |
|---|---|---|
| Alpha-1 Antitrypsin Deficiency | SERPINAI | F51L |
| Alpha-1 Antitrypsin Deficiency | SERPINAI | M374I |
| Alpha-1 Antitrypsin Deficiency | SERPINAI | A348V/A347V |
| Alpha-1 Antitrypsin Deficiency | SERPINAI | K387R |
| Alpha-1 Antitrypsin Deficiency | SERPINAI | T59A |
| Alpha-1 Antitrypsin Deficiency | SERPINAI | T68A |
| ATTR amyloidosis | TTR | A108V |
| ATTR amyloidosis | TTR | R104H |
| ATTR amyloidosis | TTR | T119M |
| Cystic fibrosis | CFTR | R555K |
| Cystic fibrosis | CFTR | F409L |
| Cystic fibrosis | CFTR | F433L |
| Cystic fibrosis | CFTR | H667R |
| Cystic fibrosis | CFTR | R1070W |
| Cystic fibrosis | CFTR | R29K |
| Cystic fibrosis | CFTR | R553Q |
| Cystic fibrosis | CFTR | 1539T |
| Cystic fibrosis | CFTR | G550E |
| Cystic fibrosis | CFTR | F429S |
| Cystic fibrosis | CFTR | Q637R |
| Sickle cell disease | HBB | A70T |
| Sickle cell disease | HBB | A70V |
| Sickle cell disease | HBB | L88P |
| Sickle cell disease | HBB | F85L and/or F85P |
| Sickle cell disease | HBB | E22G |
| Sickle cell disease | HBB | G16D and/or G16N |

[#]See J T den Dunnen and S E Antonarakis, Hum Mutat. 2000;15(1):7-12, herein incorporated by reference in its entirety, for details of the nomenclatures of gene mutations.

Regulatory Edits

In some embodiments, the systems or methods provided herein can be used to introduce a regulatory edit. In some embodiments, the regulatory edit is introduced to a regulatory sequence of a gene, for example, a gene promoter, gene enhancer, gene repressor, or a sequence that regulates gene splicing. In some embodiments, the regulatory edit increases or decreases the expression level of a target gene. In some embodiments, the target gene is the same as the gene containing a disease-causing mutation. In some embodiment, the target gene is different from the gene containing a disease-causing mutation. For example, the systems or methods provided herein can be used to upregulate the expression of fetal hemoglobin by introducing a regulatory edit at the promoter of bcl11a, thereby treating sickle cell disease.

Table 25 provides exemplary indications (column 1), genes (column 2), and regulatory edits that can be introduced using the systems or methods described herein (column 3).

TABLE 25

Indications, genes, and compensatory regulatory edits.

| Disease | Gene | Nucleotide Change[#] |
|---|---|---|
| homozygous familial hypercholesterolaemia | LDLR | c.81C > T |
| Porphyrias | ALAS1 | c.3G > A |
| Porphyrias | ALAS1 | c.2T > C |
| Porphyrias | ALAS1 | c.46C > T |
| Porphyrias | ALAS1 | c.91C > T |
| Porphyrias | ALAS1 | c.91C > T |
| Porphyrias | ALAS1 | c.226C > T |
| Porphyrias | ALAS1 | c.226C > T |
| Porphyrias | ALAS1 | c.226C > T |
| Porphyrias | ALAS1 | c.229C > T |
| Porphyrias | ALAS1 | c.247C > T |
| Porphyrias | ALAS1 | c.247C > T |
| Porphyrias | ALAS1 | c.250C > T |
| Porphyrias | ALAS1 | c.250C > T |
| Porphyrias | ALAS1 | c.340C > T |
| Porphyrias | ALAS1 | c.340C > T |
| Porphyrias | ALAS1 | c.340C > T |
| Porphyrias | ALAS1 | c.349C > T |
| Porphyrias | ALAS1 | c.391C > T |
| Porphyrias | ALAS1 | c.391C > T |
| Porphyrias | ALAS1 | c.403C > T |
| Porphyrias | ALAS1 | c.403C > T |
| Porphyrias | ALAS1 | c.199 + 1G > A |
| Porphyrias | ALAS1 | c.199 + 1G > A |
| Porphyrias | ALAS1 | c.199 + 1G > A |
| Porphyrias | ALAS1 | c.199 + 1G > A |
| Porphyrias | ALAS1 | c.199 + 2T > C |
| Porphyrias | ALAS1 | c. 199 + 2T > C |
| Porphyrias | ALAS1 | c.199 + 2T > C |
| Porphyrias | ALAS1 | c.199 + 2T > C |
| Porphyrias | ALAS1 | c.200-2A > G |
| Porphyrias | ALAS1 | c.427 + 1G > A |
| Porphyrias | ALAS1 | c.427 + 2T > C |
| Porphyrias | ALAS1 | c.1165 + 1G > A |

TABLE 25-continued

Indications, genes, and compensatory regulatory edits.

| Disease | Gene | Nucleotide Change[#] |
|---|---|---|
| Porphyrias | ALAS1 | c. 1165 + 2T > C |
| Porphyrias | ALAS1 | c.1166-1A > G |
| Porphyrias | ALAS1 | c.133 1-2A > G |
| sickle cell disease | BCL11A | c.386-24278G > A |
| sickle cell disease | BCL11A | c.386-24983T > C |
| sickle cell disease | HBG1 | c .-167C > T |
| sickle cell disease | HBG1 | c .-170G > A |
| sickle cell disease | HBG1 | c .-249C > T |
| sickle cell disease | HBG2 | c .-211C > T |
| sickle cell disease | HBG2 | c .-228T > C |
| sickle cell disease | HBG1/2 | C.-198 T > C |
| sickle cell disease | HBG1/2 | C.-198 T > C |
| sickle cell disease | HBG1/2 | C.-198 T > C |
| sickle cell disease | HBG1/2 | C.-198 T > C |
| sickle cell disease | HBG1/2 | C.-198 T > C |
| sickle cell disease | HBG1/2 | C.-198 T > C |
| sickle cell disease | HBG1/2 | C.-198 T > C |
| sickle cell disease | HBG1/2 | C.-175 T > C |
| sickle cell disease | HBG1/2 | C.-175 T > C |
| sickle cell disease | HBG1/2 | C.-175 T > C |
| sickle cell disease | HBG1/2 | C.-175 T > C |
| sickle cell disease | HBG1/2 | C. -175 T > C |
| sickle cell disease | HBG1/2 | C. –114~–102 deletion |
| sickle cell disease | HBG1/2 | C. –114~–102 deletion |
| sickle cell disease | HBG1/2 | C.–114~–102 deletion |
| sickle cell disease | HBG1/2 | C.–114~–102 deletion |
| sickle cell disease | HBG1/2 | C.–114~–102 deletion |
| sickle cell disease | HBG1/2 | C.–114~ –102 deletion |
| sickle cell disease | HBG1/2 | C.–114~–102 deletion |
| sickle cell disease | HBG1/2 | C.–114~–102 deletion |
| sickle cell disease | HBG1/2 | C.–114~–102 deletion |
| sickle cell disease | HBG1/2 | C.–114~–102 deletion |
| sickle cell disease | HBG1/2 | C.–114~–102 deletion |
| sickle cell disease | HBG1/2 | c.–90 BCLIIA Binding |
| sickle cell disease | HBG1/2 | c.–90 BCLIIA Binding |
| sickle cell disease | HBG1/2 | C.-202 C > T, -201 C > T, -198 T > C, -197 C > T, -196 C > T, -195 C > G |
| sickle cell disease | HBG1/2 | C. -197 C > T, -196 C > T, -195 C > G |

[#]See J T den Dunnen and S E Antonarakis, Hum Mutat. 2000; 15(1): 7-12, herein incorporated by reference in its entirety, for details of the nomenclatures of gene mutations.

Repeat Expansion Diseases

In some embodiments, the systems or methods provided herein can be used to a repeat expansion disease, for example, a repeat expansion disease provided in Table 26. Table 26 provides the indication (column 1), the gene (column 2), minimal repeat sequence of the repeat that is expanded in the condition (column 3), and the location of the repeat relative to the listed gene for each indication (column 4). In some embodiments, the systems or methods provided herein, for example, those comprising Gene Writers, can be used to treat repeat expansion 10 diseases by resetting the number of repeats at the locus according to a customized RNA template (see, e.g., Example 24).

TABLE 26

Exemplary repeat expansion diseases, genes, causal repeats, and repeat locations.

| Disease | Gene | Causal repeat | Repeat location |
|---|---|---|---|
| myotonic dystrophy 1 | DMPK/DM1 | CTG | 3' UTR |
| myotonic dystrophy 2 | ZNF9/CNBP | CCTG | Intron 1 |
| dentatorubral-pallidoluysian atrophy | ATN1 | CAG | Coding |

TABLE 26-continued

Exemplary repeat expansion diseases, genes, causal repeats, and repeat locations.

| Disease | Gene | Causal repeat | Repeat location |
| --- | --- | --- | --- |
| fragile X mental retardation syndrome | FMR1 | CGG | 5' UTR |
| fragile X E mental retardation | FMR2 | GCC | 5' UTR |
| Friedreich's ataxia | FXN | GAA | Intron |
| fragile X tremor ataxia syndrome | FMR1 | CGG | 5' UTR |
| Huntington's disease | HTT | CAG | Coding |
| Huntington's disease-like 2 | JPH3 | CTG | 3' UTR, coding |
| myoclonic epilepsy of Unverricht and Lundborg | CSTB | CCCCGCCCCGCG (SEQ ID NO: 1620) | Promoter |
| oculopharyngeal muscular dystrophy | PABPN1 | GCG | Coding |
| spinal and bulbar muscular atrophy | AR | CAG | Coding |
| spinocerebellar ataxia 1 | ATXN1 | CAG | Coding |
| spinocerebellar ataxia 2 | ATXN2 | CAG | Coding |
| spinocerebellar ataxia 3 | ATXN3 | CAG | Coding |
| spinocerebellar ataxia 6 | CACNA1A | CAG | Coding |
| spinocerebellar ataxia 7 | ATXN7 | CAG | Coding |
| spinocerebellar ataxia 8 | ATXN8 | CTG/CAG | CTG/CAG (ATXN8) |
| spinocerebellar ataxia 10 | ATXN10 | ATTCT | Intron |
| spinocerebellar ataxia 12 | PPP2R2B | CAG | Promoter, 5' UTR? |
| spinocerebellar ataxia 17 | TBP | CAG | Coding |
| Syndromic/non-syndromic X-linked mental retardation | ARX | GCG | Coding |

Exemplary Templates

In some embodiments, the systems or methods provided herein use the template sequences listed in Table 27. Table 27 provides exemplary template RNA sequences (column 5) and optional second-nick gRNA sequences (column 6) designed to be paired with a Gene Writing polypeptide to correct the indicated pathogenic mutations (column 4). All the templates in Table 27 are meant to exemplify the total sequence of: (1) targeting gRNA for first strand nick, (2) polypeptide binding domain, (3) heterologous object sequence, and (4) target homology domain for setting up TPRT at first strand nick.

TABLE 27

Exemplary diseases, tissues, genes, pathogenic mutations, template RNA sequences, and second nick gRNA sequences.

| Disease | Tissue | Gene | Mutation | Template RNA | Second nick gRNA |
| --- | --- | --- | --- | --- | --- |
| Alpha-1 antitrypsin | Liver | SERPINA1 | PiZ | TCCCCTCCAGGCCGTGCATAGTT TTAGAGCTAGAAATAGCAAGTT AAAATAAGGCTAGTCCGTTATCA ACTTGAAAAAGTGGGACCGAGT CGGTCCTcGTCGATGGTCAGCAC AGCCTTATGCACGGCCTGGA (SEQ ID NO: 1621) | TTTGTT GAACT TGACC TCGG (SEQ ID NO: 1622) |

TABLE 27-continued

Exemplary diseases, tissues, genes, pathogenic mutations, template RNA sequences, and second nick gRNA sequences.

| Disease | Tissue | Gene | Mutation | Template RNA | Second nick gRNA |
|---|---|---|---|---|---|
| Cystic fibrosis | Lung | CFTR | deltaF508 | ACCATTAAAGAAAATATCATGTT TTAGAGCTAGAAATAGCAAGTT AAAATAAGGCTAGTCCGTTATCA ACTTGAAAAAGTGGGACCGAGT CGGTCCACCAaagATGATATTTC TTTA (SEQ ID NO: 1623) | AaagAT GATAT TTTCTT TAA (SEQ ID NO: 1624) |
| Sickle cell | HSC | HBB | HbS | GTAACGGCAGACTTCTCCACGTT TTAGAGCTAGAAATAGCAAGTT AAAATAAGGCTAGTCCGTTATCA ACTTGAAAAAGTGGGACCGAGT CGGTCCGACTCCTGaGGAGAAGT CTGCC (SEQ ID NO: 1625) | TGGTG AGGCC CTGGG CAGGT (SEQ ID NO: 1626) |
| Wilson's Disease | Liver | ATP7B | H1069Q | TTGGTGACTGCCACGCCCAAGTT TTAGAGCTAGAAATAGCAAGTT AAAATAAGGCTAGTCCGTTATCA ACTTGAAAAAGTGGGACCGAGT CGGTCCACAcCCCTTGGGCGTGG CAGTC (SEQ ID NO: 1627) | GGCCA GCAGT GAACA CCCCT (SEQ ID NO: 1628) |
| ARVC | Heart | PKP2 | 235C > T | ACTCAGGAACACTGCTGGTTGTT TTAGAGCTAGAAATAGCAAGTT AAAATAAGGCTAGTCCGTTATCA ACTTGAAAAAGTGGGACCGAGT CGGTCCTTCACtGAACCAGCAGT GTTCC (SEQ ID NO: 1629) | TTGGT TGAAA ATGAT TTTGT (SEQ ID NO: 1630) |
| Long QT syndrome 1 | Heart | KCNQ1 | P343S | CCAGGGAAAACGCACCCACGGT TTTAGAGCTAGAAATAGCAAGTT AAAATAAGGCTAGTCCGTTATCA ACTTGAAAAAGTGGGACCGAGT CGGTCCTCcCAGCGGTAGGTGCC CCGTGGGTGCGTTTTC (SEQ ID NO: 1631) | CTCCT TCTTT GCGCT CcCAG (SEQ ID NO: 1632) |
| Mucolipidosis IV | CNS | MCOLN1 | 406-2A > G | GCCCTCCCCTTCTCTGCCCAGTT TTAGAGCTAGAAATAGCAAGTT AAAATAAGGCTAGTCCGTTATCA ACTTGAAAAAGTGGGACCGAGT CGGTCCGGTACIGTGGGCAGAGA AGGGG (SEQ ID NO: 1633) | TCAGG CAACG CCAGG TACtG (SEQ ID NO: 1634) |

In some embodiments, the systems or methods provided herein use the template sequences listed in Table 35. Table 35 provides exemplary template RNA sequences (column 5) and optional second-nick gRNA sequences (column 6) designed to be paired with a Gene Writing polypeptide to correct the indicated pathogenic mutations (column 4). All the templates in Table 35 are meant to exemplify the total sequence of: (1) targeting gRNA for first strand nick, (2) polypeptide binding domain, (3) heterologous object sequence, and (4) target homology domain for setting up TPRT at first strand nick.

TABLE 35

Exemplary Gene Writing templates and second nick gRNA sequences for the correction of exemplary repeat expansion diseases. The region of the template spanning the repeat(s) is indicated in lowercase.

| Disease | Gene | Reference Accession | Repeat | Location | Template RNA | Second-nick gRNA |
|---|---|---|---|---|---|---|
| myotonic dystrophy 1 | DMPK | NC_000019.10 (45769709 . . . 45782490, complement) | CTG | 3' UTR | CTCGAAGGGTC CTTGTAGCCGTT TTAGAGCTAGA AATAGCAAGTT | ATCA CAGG ACTG GAGC |

TABLE 35-continued

Exemplary Gene Writing templates and second nick gRNA sequences for the correction of exemplary repeat expansion diseases. The region of the template spanning the repeat(s) is indicated in lowercase.

| Disease | Gene | Reference Accession | Repeat | Location | Template RNA | Second-nick gRNA |
|---|---|---|---|---|---|---|
| | | | | | AAAATAAGGCT AGTCCGTTATCA ACTTGAAAAAG TGGGACCGAGT CGGTCCGTGAT CCCCCcagcagcagc agcagcagcagcagcag cagcagcagcagcagca gcagcagcagcagcag CATTCCCGGCTA CAAGGACCCT (SEQ ID NO: 1635) | TGGG (SEQ ID NO: 1636) |
| myotonic dystrophy 2 | CNBP | NC_000003.12 (129167827 ... 129183896, complement) | CCTG | Intron 1 | ACCACTGCACT CCAGCCTAGGT TTTAGAGCTAG AAATAGCAAGT TAAAATAAGGC TAGTCCGTTATC AACTTGAAAAA GTGGGACCGAG TCGGTCCGTGTC TGTCTGTCTGTC TGTCTGTCTGTC TGTCTGTCTGTC TGcctgcctgcctgcctg cctgcctgcctgcctggct gcctgtctgcctgtctgcct gcctgcctgcctgcctgcc tgcctgTCTGTCTC ACTTTGTCCCCT AGGCTGGAGTG CA (SEQ ID NO: 1637) | GCCT CAGC CTCC TGAG TAGC (SEQ ID NO: 1638) |
| fragile X mental retardation syndrome | FMR1 | NC_000023.11 (147911919 ... 147951127) | CGG | 5' UTR | GGGGGCGTGCG GCAGCGCGGGT TTTAGAGCTAG AAATAGCAAGT TAAAATAAGGC TAGTCCGTTATC AACTTGAAAAA GTGGGACCGAG TCGGTCCTGCG GGCGCTCGAGG CCCAGccgccgccgc cgccgccgccgccgccg cctccgccgccgccgcc gccgccgccgccgccg CGCTGCCGCAC G (SEQ ID NO: 1639) | GCTC AGAG GCGG CCCT CCAC (SEQ ID NO: 1640) |
| Friedreich's ataxia | FXN | NC_000009.12 (69035752 ... 69079076) | GAA | Intron | CAGGCGCGCGA CACCACGCCGT TTTAGAGCTAG AAATAGCAAGT TAAAATAAGGC TAGTCCGTTATC AACTTGAAAAA GTGGGACCGAG TCGGTCCAACC CAGTATCTACTA AAAAATACAAA AAAAAAAAAA AAgaagaagaagaaga agaaAATAAGA AAAGTTAGCCG GGCGTGGTGTC GCGC (SEQ ID NO: 1641) | CGCT TGAG CCCG GGAG GCAG (SEQ ID NO: 1642) |

TABLE 35-continued

Exemplary Gene Writing templates and second nick gRNA sequences for the correction of exemplary repeat expansion diseases.
The region of the template spanning the repeat(s) is indicated in lowercase.

| Disease | Gene | Reference Accession | Repeat | Location | Template RNA | Second-nick gRNA |
|---|---|---|---|---|---|---|
| Huntington disease | HTT | NC_000004.12 (3074681 . . . 3243960) | CAG | Coding | GGCGGCTGAGG AAGCTGAGGGT TTTAGAGCTAG AAATAGCAAGT TAAAATAAGGC TAGTCCGTTATC AACTTGAAAAA GTGGGACCGAG TCGGTCCAGTCC CTCAAGTCCTTC cagcagcagcagcagca gcagcagcagcagcagc agcagcagcagcagcag cagcagcaacagccgcc accgccgccgccgccgc cgccgcctcctCAGCT TCCTCAG (SEQ ID NO: 1643) | CGCT GCAC CGAC CGTG AGTT (SEQ ID NO: 1644) |
| spinocerebellar ataxia 1 | ATXN1 | NC_000006.12 (16299112 . . . 16761490, complement) | CAG | Coding | TGAGCCCCGGA GCCCTGCTGGTT TTAGAGCTAGA AATAGCAAGTT AAAATAAGGCT AGTCCGTTATCA ACTTGAAAAAG TGGGACCGAGT CGGTCCACAAG GCTGAGcagcagca gcagcagcagcagcagc agcagcagcagcatcag catcagcagcagcagca gcagcagcagcagcagc agcagcagcagCACC TCAGCAGGGCT CCGGG (SEQ ID NO: 1645) | TCCA GTTC TCCG CAGA ACAC (SEQ ID NO: 1646) |

Exemplary Heterologous Object Sequences

In some embodiments, the systems or methods provided herein comprise a heterologous object sequence, wherein the heterologous object sequence or a reverse complementary sequence thereof, encodes a protein (e.g., an antibody) or peptide. In some embodiments, the therapy is one approved by a regulatory agency such as FDA.

In some embodiments, the protein or peptide is a protein or peptide from the THPdb database (Usmani et al. PLOS One 12(7):e0181748 (2017), herein incorporated by reference in its entirety. In some embodiments, the protein or peptide is a protein or peptide disclosed in Table 28. In some embodiments, the systems or methods disclosed herein, for example, those comprising Gene Writers, may be used to integrate an expression cassette for a protein or peptide from Table 28 into a host cell to enable the expression of the protein or peptide in the host. In some embodiments, the sequences of the protein or peptide in the first column of Table 28 can be found in the patents or applications provided in the third column of Table 28, incorporated by reference in their entireties.

In some embodiments, the protein or peptide is an antibody disclosed in Table 1 of Lu et al. J Biomed Sci 27(1):1 (2020), herein incorporated by reference in its entirety. In some embodiments, the protein or peptide is an antibody disclosed in Table 29. In some embodiments, the systems or methods disclosed herein, for example, those comprising Gene Writers, may be used to integrate an expression cassette for an antibody from Table 29 into a host cell to enable the expression of the antibody in the host. In some embodiments, a system or method described herein is used to express an agent that binds a target of column 2 of Table 29 (e.g., a monoclonal antibody of column 1 of Table 29) in a subject having an indication of column 3 of Table 29.

TABLE 28

Exemplary protein and peptide therapeutics.

| Therapeutic peptide | Category | Patent Number |
|---|---|---|
| Lepirudin | Antithrombins and Fibrinolytic Agents | CA1339104 |
| Cetuximab | Antineoplastic Agents | CA1340417 |

TABLE 28-continued

Exemplary protein and peptide therapeutics.

| Therapeutic peptide | Category | Patent Number |
|---|---|---|
| Dornase alpha | Enzymes | CA2184581 |
| Denileukin diftitox | Antineoplastic Agents | |
| Etanercept | Immunosuppressive Agents | CA2476934 |
| Bivalirudin | Antithrombins | U.S. Pat. No. 7,582,727 |
| Leuprolide | Antineoplastic Agents | |
| Peginterferon alpha-2a | Immunosuppressive Agents | CA2203480 |
| Alteplase | Thrombolytic Agents | |
| Interferon alpha-n1 | Antiviral Agents | |
| Darbepoetin alpha | Anti-anemic Agents | CA2165694 |
| Reteplase | Fibrinolytic Agents | CA2107476 |
| Epoetin alpha | Hematinics | CA1339047 |
| Salmon Calcitonin | Bone Density Conservation Agents | U.S. Pat. No. 6,440,392 |
| Interferon alpha-n3 | Immunosuppressive Agents | |
| Pegfilgrastim | Immunosuppressive Agents | CA1341537 |
| Sargramostim | Immunosuppressive Agents | CA1341150 |
| Secretin | Diagnostic Agents | |
| Peginterferon alpha-2b | Immunosuppressive Agents | CA1341567 |
| Asparagi se | Antineoplastic Agents | |
| Thyrotropin alpha | Diagnostic Agents | U.S. Pat. No. 5,840,566 |
| Antihemophilic Factor | Coagulants and Thrombotic agents | CA2124690 |
| Anakinra | Antirheumatic Agents | CA2141953 |
| Gramicidin D | Anti-Bacterial Agents | |
| Intravenous Immunoglobulin | Immunologic Factors | |
| Anistreplase | Fibrinolytic Agents | |
| Insulin Regular | Antidiabetic Agents | |
| Tenecteplase | Fibrinolytic Agents | CA2129660 |
| Menotropins | Fertility Agents | |
| Interferon gamma-1b | Immunosuppressive Agents | U.S. Pat. No. 6,936,695 |
| Interferon alpha-2a, Recombinant | | CA2172664 |
| Coagulation factor VIIa | Coagulants | |
| Oprelvekin | Antineoplastic Agents | |
| Palifermin | Anti-Mucositis Agents | |
| Glucagon recombi nt | Hypoglycemic Agents | |
| Aldesleukin | Antineoplastic Agents | |
| Botulinum Toxin Type B | Antidystonic Agents | |
| Omalizumab | Anti-Allergic Agents | CA2113813 |
| Lutropin alpha | Fertility Agents | U.S. Pat. No. 5,767,251 |
| Insulin Lispro | Hypoglycemic Agents | U.S. Pat. No. 5,474,978 |
| Insulin Glargine | Hypoglycemic Agents | U.S. Pat. No. 7,476,652 |
| Collagenase | | |
| Rasburicase | Gout Suppressants | CA2175971 |
| Adalimumab | Antirheumatic Agents | CA2243459 |
| Imiglucerase | Enzyme Replacement Agents | U.S. Pat. No. 5,549,892 |
| Abciximab | Anticoagulants | CA1341357 |
| Alpha-1-proteinase inhibitor | Serine Proteinase Inhibitors | |
| Pegaspargase | Antineoplastic Agents | |
| Interferon beta-1a | Antineoplastic Agents | CA1341604 |
| Pegademase bovine | Enzyme Replacement Agents | |
| Human Serum Albumin | Serum substitutes | U.S. Pat. No. 6,723,303 |
| Eptifibatide | Platelet Aggregation Inhibitors | U.S. Pat. No. 6,706,681 |
| Serum albumin iodo ted | Diagnostic Agents | |
| Infliximab | Antirheumatic Agents, Anti-Inflammatory Agents, Non-Steroidal, Dermatologic Agents, Gastrointestinal Agents and Immunosuppressive Agents | CA2106299 |
| Follitropin beta | Fertility Agents | U.S. Pat. No. 7,741,268 |
| Vasopressin | Antidiuretic Agents | |
| Interferon beta-1b | Adjuvants, Immunologic and Immunosuppressive Agents | CA1340861 |
| Interferon alphacon-1 | Antiviral Agents and Immunosuppressive Agents | CA1341567 |
| Hyaluronidase | Adjuvants, Anesthesia and Permeabilizing Agents | |
| Insulin, porcine | Hypoglycemic Agents | |
| Trastuzumab | Antineoplastic Agents | CA2103059 |
| Rituximab | Antineoplastic Agents, Immunologic Factors and Antirheumatic Agents | CA2149329 |
| Basiliximab | Immunosuppressive Agents | CA2038279 |
| Muromonab | Immunologic Factors and Immunosuppressive Agents | |

TABLE 28-continued

Exemplary protein and peptide therapeutics.

| Therapeutic peptide | Category | Patent Number |
|---|---|---|
| Digoxin Immune Fab (Ovine) | Antidotes | |
| Ibritumomab | | CA2149329 |
| Daptomycin | | U.S. Pat. No. 6,468,967 |
| Tositumomab | | |
| Pegvisomant | Hormone Replacement Agents | U.S. Pat. No. 5,849,535 |
| Botulinum Toxin Type A | Neuromuscular Blocking Agents, Anti-Wrinkle Agents and Antidystonic Agents | CA2280565 |
| Pancrelipase | Gastrointestinal Agents and Enzyme Replacement Agents | |
| Streptokinase | Fibrinolytic Agents and Thrombolytic Agents | |
| Alemtuzumab | | CA1339198 |
| Alglucerase | Enzyme Replacement Agents | |
| Capromab | Indicators, Reagents and Diagnostic Agents | |
| Laronidase | Enzyme Replacement Agents | |
| Urofollitropin | Fertility Agents | U.S. Pat. No. 5,767,067 |
| Efalizumab | Immunosuppressive Agents | |
| Serum albumin | Serum substitutes | U.S. Pat. No. 6,723,303 |
| Choriogo dotropin alpha | Fertility Agents and Gonadotropins | U.S. Pat. No. 6,706,681 |
| Antithymocyte globulin | Immunologic Factors and Immunosuppressive Agents | |
| Filgrastim | Immunosuppressive Agents, Antineutropenic Agents and Hematopoietic Agents | CA1341537 |
| Coagulation factor ix | Coagulants and Thrombotic Agents | |
| Becaplermin | Angiogenesis Inducing Agents | CA1340846 |
| Agalsidase beta | Enzyme Replacement Agents | CA2265464 |
| Interferon alpha-2b | Immunosuppressive Agents | CA1341567 |
| Oxytocin | Oxytocics, Anti-tocolytic Agents and Labor Induction Agents | |
| Enfuvirtide | HIV Fusion Inhibitors | U.S. Pat. No. 6,475,491 |
| Palivizumab | Antiviral Agents | CA2197684 |
| Daclizumab | Immunosuppressive Agents | |
| Bevacizumab | Angiogenesis Inhibitors | CA2286330 |
| Arcitumomab | Diagnostic Agents | U.S. Pat. No. 8,420,081 |
| Arcitumomab | Diagnostic Agents | U.S. Pat. No. 7,790,142 |
| Eculizumab | | CA2189015 |
| Panitumumab | | |
| Ranibizumab | Ophthalmics | CA2286330 |
| Idursulfase | Enzyme Replacement Agents | |
| Alglucosidase alpha | Enzyme Replacement Agents | CA2416492 |
| Exenatide | Hypoglycemic Agents | U.S. Pat. No. 6,872,700 |
| Mecasermin | | U.S. Pat. No. 5,681,814 |
| Pramlintide | | U.S. Pat. No. 5,686,411 |
| Galsulfase | Enzyme Replacement Agents | |
| Abatacept | Antirheumatic Agents and Immunosuppressive Agents | CA2110518 |
| Cosyntropin | Hormones and Diagnostic Agents | |
| Corticotropin | | |
| Insulin aspart | Hypoglycemic Agents and Antidiabetic Agents | U.S. Pat. No. 5,866,538 |
| Insulin detemir | Antidiabetic Agents | U.S. Pat. No. 5,750,497 |
| Insulin glulisine | Antidiabetic Agents | U.S. Pat. No. 6,960,561 |
| Pegaptanib | Intended for the prevention of respiratory distress syndrome (RDS) in premature infants at high risk for RDS. | |
| Nesiritide | | |
| Thymalphasin | | |
| Defibrotide | Antithrombins | |
| tural alpha interferon OR multiferon | | |
| Glatiramer acetate | | |
| Preotact | | |
| Teicoplanin | Anti-Bacterial Agents | |
| Canakinumab | Anti-Inflammatory Agents and Monoclonal antibodies | |
| Ipilimumab | Antineoplastic Agents and Monoclonal antibodies | CA2381770 |
| Sulodexide | Antithrombins and Fibrinolytic Agents and Hypoglycemic Agents | |

TABLE 28-continued

Exemplary protein and peptide therapeutics.

| Therapeutic peptide | Category | Patent Number |
|---|---|---|
| | and Anticoagulants and Hypolipidemic Agents | |
| Tocilizumab | | CA2201781 |
| Teriparatide | Bone Density Conservation Agents | U.S. Pat. No. 6,977,077 |
| Pertuzumab | Monoclonal antibodies | CA2376596 |
| Rilo cept | Immunosuppressive Agents | U.S. Pat. No. 5,844,099 |
| Denosumab | Bone Density Conservation Agents and Monoclo 1 antibodies | CA2257247 |
| Liraglutide | | U.S. Pat. No. 6,268,343 |
| Golimumab | Antipsoriatic Agents and Monoclonal antibodies and TNF inhibitor | |
| Belatacept | Antirheumatic Agents and Immunosuppressive Agents | |
| Buserelin | | |
| Velaglucerase alpha | Enzymes | U.S. Pat. No. 7,138,262 |
| Tesamorelin | | U.S. Pat. No. 5,861,379 |
| Brentuximab vedotin | | |
| Taliglucerase alpha | Enzymes | |
| Belimumab | Monoclonal antibodies | |
| Aflibercept | Antineoplastic Agents and Ophthalmics | U.S. Pat. No. 7,306,799 |
| Asparagi se erwinia chrysanthemi | Enzymes | |
| Ocriplasmin | Ophthalmics | |
| Glucarpidase | Enzymes | |
| Teduglutide | | U.S. Pat. No. 5,789,379 |
| Raxibacumab | Anti-Infective Agents and Monoclonal antibodies | |
| Certolizumab pegol | TNF inhibitor | CA2380298 |
| Insulin, isophane | Hypoglycemic Agents and Antidiabetic Agents | |
| Epoetin zeta | | |
| Obinutuzumab | Antineoplastic Agents | |
| Fibrinolysin aka plasmin | | U.S. Pat. No. 3,234,106 |
| Follitropin alpha | | |
| Romiplostim | Colony-Stimulating Factors and Thrombopoietic Agents | |
| Luci ctant | Pulmonary surfactants | U.S. Pat. No. 5,407,914 |
| talizumab | Immunosuppressive agents | |
| Aliskiren | Renin inhibitor | |
| Ragweed Pollen Extract | | |
| Secukinumab | Inhibitor | US20130202610 |
| Somatotropin Recombi nt | Hormone Replacement Agents | CA1326439 |
| Drotrecogin alpha | Antisepsis | CA2036894 |
| Alefacept | Dermatologic and Immunosupressive agents | |
| OspA lipoprotein | Vaccines | |
| Uroki se | | U.S. Pat. No. 4,258,030 |
| Abarelix | Anti-Testosterone Agents | U.S. Pat. No. 5,968,895 |
| Sermorelin | Hormone Replacement Agents | |
| Aprotinin | | U.S. Pat. No. 5,198,534 |
| Gemtuzumab ozogamicin | Antineoplastic agents and Immunotoxins | U.S. Pat. No. 5,585,089 |
| Satumomab Pendetide | Diagnostic Agents | |
| Albiglutide | Drugs used in diabetes; alimentary tract and metabolism; blood glucose lowering drugs, excl. insulins. | |
| Alirocumab | | |
| Ancestim | | |
| Antithrombin alpha | | |
| Antithrombin III human | | |
| Asfotase alpha | Enzymes Alimentary Tract and Metabolism | |
| Atezolizumab | | |
| Autologous cultured chondrocytes | | |
| Beractant | | |
| Blinatumomab | Antineoplastic Agents Immunosuppressive Agents Monoclonal antibodies Antineoplastic and Immunomodulating Agents | US20120328618 |
| C1 Esterase Inhibitor (Human) | | |

TABLE 28-continued

Exemplary protein and peptide therapeutics.

| Therapeutic peptide | Category | Patent Number |
|---|---|---|
| Coagulation Factor XIII A-Subunit (Recombinant) | | |
| Conestat alpha | | |
| Daratumumab | Antineoplastic Agents | |
| Desirudin | | |
| Dulaglutide | Hypoglycemic Agents; Drugs Used in Diabetes; Alimentary Tract and Metabolism; Blood Glucose Lowering Drugs, Excl. Insulins | |
| Elosulfase alpha | Enzymes; Alimentary Tract and Metabolism | |
| Elotuzumab | | US2014055370 |
| Evolocumab | Lipid Modifying Agents, Plain; Cardiovascular System | |
| Fibrinogen Concentrate (Human) | | |
| Filgrastim-sndz | | |
| Gastric intrinsic factor | | |
| Hepatitis B immune globulin | | |
| Human calcitonin | | |
| Human clostridium tetani toxoid immune globulin | | |
| Human rabies virus immune globulin | | |
| Human Rho(D) immune globulin | | |
| Hyaluronidase (Human Recombinant) | | U.S. Pat. No. 7,767,429 |
| Idarucizumab | Anticoagulant | |
| Immune Globulin Human | Immunologic Factors; Immunosuppressive Agents; Anti-Infective Agents | |
| Vedolizumab | Immunosupressive agent, Antineoplastic agent | US2012151248 |
| Ustekinumab | Deramtologic agent, Immunosuppressive agent, antineoplastic agent | |
| Turoctocog alpha | | |
| Tuberculin Purified Protein Derivative | | |
| Simoctocog alpha | Antihaemorrhagics: blood coagulation factor VIII | |
| Siltuximab | Antineoplastic and Immunomodulating Agents, Immunosuppressive Agents | U.S. Pat. No. 7,612,182 |
| Sebelipase alpha | Enzymes | |
| Sacrosidase | Enzymes | |
| Ramucirumab | Antineoplastic and Immunomodulating Agents | US2013067098 |
| Prothrombin complex concentrate | | |
| Poractant alpha | Pulmonary Surfactants | |
| Pembrolizumab | Antineoplastic and Immunomodulating Agents | US2012135408 |
| Peginterferon beta-la | | |
| Ofatumumab | Antineoplastic and Immunomodulating Agents | U.S. Pat. No. 8,337,847 |
| Obiltoxaximab | | |
| Nivolumab | Antineoplastic and Immunomodulating Agents | US2013173223 |
| Necitumumab | | |
| Metreleptin | | US20070099836 |
| Methoxy polyethylene glycol-epoetin beta | | |
| Mepolizumab | Antineoplastic and Immunomodulating Agents, Immunosuppressive Agents, Interleukin Inhibitors | US2008134721 |
| Ixekizumab | | |
| Insulin Pork | Hypoglycemic Agents, Antidiabetic Agents | |
| Insulin Degludec | | |
| Insulin Beef | | |
| Thyroglobulin | Hormone therapy | U.S. Pat. No. 5,099,001 |

TABLE 28-continued

Exemplary protein and peptide therapeutics.

| Therapeutic peptide | Category | Patent Number |
|---|---|---|
| Anthrax immune globulin human | Plasma derivative | |
| Anti-inhibitor coagulant complex | Blood Coagulation Factors, Antihemophilic Agent | |
| Anti-thymocyte Globulin (Equine) | Antibody | |
| Anti-thymocyte Globulin (Rabbit) | Antibody | |
| Brodalumab | Antineoplastic and Immunomodulating Agents | |
| C1 Esterase Inhibitor (Recombinant) | Blood and Blood Forming Organs | |
| Canakinumab | Antineoplastic and Immunomodulating Agents | |
| Chorionic Go dotropin (Human) | Hormones | U.S. Pat. No. 6,706,681 |
| Chorionic Go dotropin (Recombinant) | Hormones | U.S. Pat. No. 5,767,251 |
| Coagulation factor X human | Blood Coagulation Factors | |
| Dinutuximab | Antibody, Immunosuppresive agent, Antineoplastic agent | US20140170155 |
| Efmoroctocog alpha | Antihemophilic Factor | |
| Factor IX Complex (Human) | Antihemophilic agent | |
| Hepatitis A Vaccine | Vaccine | |
| Human Varicella-Zoster Immune Globulin | Antibody | |
| Ibritumomab tiuxetan | Antibody, Immunosuppressive Agents | CA2149329 |
| Lenograstim | Antineoplastic and Immunomodulating Agents | |
| Pegloticase | Enzymes | |
| Protamine sulfate | Heparin Antagonists, Hematologic Agents | |
| Protein S human | Anticoagulant plasma protein | |
| Sipuleucel-T | Antineoplastic and Immunomodulating Agents | U.S. Pat. No. 8,153,120 |
| Somatropin recombi nt | Hormones, Hormone Substitutes, and Hormone Antagonists | CA1326439, CA2252535, U.S. Pat. No. 5,288,703, U.S. Pat. No. 5,849,700, U.S. Pat. No. 5,849,704, U.S. Pat. No. 5,898,030, U.S. Pat. No. 6,004,297, U.S. Pat. No. 6,152,897, U.S. Pat. No. 6,235,004, U.S. Pat. No. 6,899,699 |
| Susoctocog alpha | Blood coagulation factors, Antihaemorrhagics | |
| Thrombomodulin alpha | Anticoagulant agent, Antiplatelet agent | |

TABLE 29

Exemplary monoclonal antibody therapies.

| mAb | Target | Indication |
|---|---|---|
| Muromonab-CD3 | CD3 | Kidney transplant rejection |
| Abciximab | GPIIb/IIIa | Prevention of blood clots in angioplasty |
| Rituximab | CD20 | Non-Hodgkin lymphoma |
| Palivizumab | RSV | Prevention of respiratory syncytial virus infection |
| Infliximab | TNFα | Crohn's disease |
| Trastuzumab | HER2 | Breast cancer |
| Alemtuzumab | CD52 | Chronic myeloid leukemia |
| Adalimumab | TNFα | Rheumatoid arthritis |
| tuxetan | | |
| Ibritumomab tiuxetan | CD20 | Non-Hodgkin lymphoma |
| Omalizumab | IgE | Asthma |
| Cetuximab | EGFR | Colorectal cancer |
| Bevacizumab | VEGF-A | Colorectal cancer |
| Natalizumab | ITGA4 | Multiple sclerosis |
| Panitumumab | EGFR | Colorectal cancer |
| Ranibizumab | VEGF-A | Macular degeneration |
| Eculizumab | C5 | Paroxysmal nocturnal hemoglobinuria |
| Certolizumab pegol | TNFα | Crohn's disease |
| Ustekinumab | IL-12/23 | Psoriasis |
| Canakinumab | IL-1β | Muckle-Wells syndrome |
| Golimumab | TNFα | Rheumatoid and psoriatic arthritis, ankylosing spondylitis |
| Ofatumumab | CD20 | Chronic lymphocytic leukemia |
| Tocilizumab | IL-6R | Rheumatoid arthritis |
| Denosumab | RANKL | Bone loss |
| Belimumab | BLyS | Systemic lupus erythematosus |
| Ipilimumab | CTLA-4 | Metastatic melanoma |
| Brentuximab vedotin | CD30 | Hodgkin lymphoma, systemic anaplastic large cell lymphoma |
| Pertuzumab | HER2 | Breast Cancer |

TABLE 29-continued

Exemplary monoclonal antibody therapies.

| mAb | Target | Indication |
|---|---|---|
| Trastuzumab emtansine | HER2 | Breast cancer |
| Raxibacumab | *B. anthrasis* PA | Anthrax infection |
| Obinutuzumab | CD20 | Chronic lymphocytic leukemia |
| Siltuximab | IL-6 | Castleman disease |
| Ramucirumab | VEGFR2 | Gastric cancer |
| Vedolizumab | α4β7 integrin | Ulcerative colitis, Crohn disease |
| Blinatumomab | CD19, CD3 | Acute lymphoblastic leukemia |
| Nivolumab | PD-1 | Melanoma, non-small cell lung cancer |
| Pembrolizumab | PD-1 | Melanoma |
| Idarucizumab | Dabigatran | Reversal of dabigatran-induced anticoagulation |
| Necitumumab | EGFR | Non-small cell lung cancer |
| Dinutuximab | GD2 | Neuroblastoma |
| Secukinumab | IL-17α | Psoriasis |
| Mepolizumab | IL-5 | Severe eosinophilic asthma |
| Alirocumab | PCSK9 | High cholesterol |
| Evolocumab | PCSK9 | High cholesterol |
| Daratumumab | CD38 | Multiple myeloma |
| Elotuzumab | SLAMF7 | Multiple myeloma |
| Ixekizumab | IL-17α | Psoriasis |
| Reslizumab | IL-5 | Asthma |
| Olaratumab | PDGFRα | Soft tissue sarcoma |
| Bezlotoxumab | *Clostridium difficile* enterotoxin B | Prevention of *Clostridium difficile* infection recurrence |
| Atezolizumab | PD-L1 | Bladder cancer |
| Obiltoxaximab | *B. anthrasis* PA | Prevention of inhalational anthrax |
| Inotuzumab ozogamicin | CD22 | Acute lymphoblastic leukemia |
| Brodalumab | IL-17R | Plaque psoriasis |
| Guselkumab | IL-23 p19 | Plaque psoriasis |
| Dupilumab | IL-4Rα | Atopic dermatitis |
| Sarilumab | IL-6R | Rheumatoid arthritis |
| Avelumab | PD-L1 | Merkel cell carcinoma |
| Ocrelizumab | CD20 | Multiple sclerosis |
| Emicizumab | Factor IXa, X | Hemophilia A |
| Benralizumab | IL-5Rα | Asthma |
| Gemtuzumab ozogamicin | CD33 | Acute myeloid leukemia |
| Durvalumab | PD-L1 | Bladder cancer |
| Burosumab | FGF23 | X-linked hypophosphatemia |
| Lanadelumab | Plasma kallikrein | Hereditary angioedema attacks |
| Mogamulizumab | CCR4 | Mycosis fungoides or Sézary syndrome |
| Erenumab | CGRPR | Migraine prevention |
| Galcanezumab | CGRP | Migraine prevention |
| Tildrakizumab | IL-23 p19 | Plaque psoriasis |
| Cemiplimab | PD-1 | Cutaneous squamous cell carcinoma |
| Emapalumab | IFNγ | Primary hemophagocytic lymphohistiocytosis |
| Fremanezumab | CGRP | Migraine prevention |
| Ibalizumab | CD4 | HIV infection |
| Moxetumomab pasudodox | CD22 | Hairy cell leukemia |
| Ravulizumab | C5 | Paroxysmal nocturnal hemoglobinuria |
| Caplacizumab | von Willebrand factor | Acquired thrombotic thrombocytopenia purpura |
| Romosozumab | Sclerostin | Osteoporosis in postmenopausal women at increased risk of fracture |
| Risankizumab | IL-23 p19 | Plaque psoriasis |
| Polatuzumab vedotin | CD79β | Diffuse large B-cell lymphoma |
| Brolucizumab | VEGF-A | Macular degeneration |
| Crizanlizumab | P-selectin | Sickle cell disease |

Plant-Modification Methods

Gene Writer systems described herein may be used to modify a plant or a plant part (e.g., leaves, roots, flowers, fruits, or seeds), e.g., to increase the fitness of a plant.

A. Delivery to a Plant

Provided herein are methods of delivering a Gene Writer system described herein to a plant. Included are methods for delivering a Gene Writer system to a plant by contacting the plant, or part thereof, with a Gene Writer system. The methods are useful for modifying the plant to, e.g., increase the fitness of a plant.

More specifically, in some embodiments, a nucleic acid described herein (e.g., a nucleic acid encoding a GeneWriter) may be encoded in a vector, e.g., inserted adjacent to a plant promoter, e.g., a maize ubiquitin promoter (ZmUBI) in a plant vector (e.g., pHUC411). In some embodiments, the nucleic acids described herein are introduced into a plant (e.g., japonica rice) or part of a plant (e.g., a callus of a plant) via agrobacteria. In some embodiments, the systems and methods described herein can be used in plants by replacing a plant gene (e.g., hygromycin phosphotransferase (HPT)) with a null allele (e.g., containing a base substitution at the start codon). Systems and methods for modifying a plant genome are described in Xu et. al. Development of plant prime-editing systems for precise genome editing, 2020, Plant Communications.

In one aspect, provided herein is a method of increasing the fitness of a plant, the method including delivering to the plant the Gene Writer system described herein (e.g., in an effective amount and duration) to increase the fitness of the plant relative to an untreated plant (e.g., a plant that has not been delivered the Gene Writer system).

An increase in the fitness of the plant as a consequence of delivery of a Gene Writer system can manifest in a number of ways, e.g., thereby resulting in a better production of the plant, for example, an improved yield, improved vigor of the plant or quality of the harvested product from the plant, an improvement in pre- or post-harvest traits deemed desirable for agriculture or horticulture (e.g., taste, appearance, shelf life), or for an improvement of traits that otherwise benefit humans (e.g., decreased allergen production). An improved yield of a plant relates to an increase in the yield of a product (e.g., as measured by plant biomass, grain, seed or fruit yield, protein content, carbohydrate or oil content or leaf area) of the plant by a measurable amount over the yield of the same product of the plant produced under the same conditions, but without the application of the instant compositions or compared with application of conventional plant-modifying agents. For example, yield can be increased by at least about 0.5%, about 1%, about 2%, about 3%, about 4%, about 5%, about 10%, about 20%, about 30%, about 40%, about 50%, about 60%, about 70%, about 80%, about 90%, about 100%, or more than 100%. In some instances, the method is effective to increase yield by about 2×-fold, 5×-fold, 10×-fold, 25×-fold, 50×-fold, 75×-fold, 100×-fold, or more than 100×-fold relative to an untreated plant. Yield can be expressed in terms of an amount by weight or volume of the plant or a product of the plant on some basis. The basis can be expressed in terms of time, growing area, weight of plants produced, or amount of a raw material used. For example, such methods may increase the yield of plant tissues including, but not limited to: seeds, fruits, kernels, bolls, tubers, roots, and leaves.

An increase in the fitness of a plant as a consequence of delivery of a Gene Writer system can also be measured by other means, such as an increase or improvement of the vigor rating, the stand (the number of plants per unit of area), plant height, stalk circumference, stalk length, leaf number, leaf size, plant canopy, visual appearance (such as greener leaf color), root rating, emergence, protein content, increased tillering, bigger leaves, more leaves, less dead basal leaves, stronger tillers, less fertilizer needed, less seeds needed, more productive tillers, carlier flowering, early grain or seed maturity, less plant verse (lodging), increased shoot growth, earlier germination, or any combination of these factors, by a measurable or noticeable amount over the same factor of the plant produced under the same conditions, but without the administration of the instant compositions or with application of conventional plant-modifying agents (e.g., plant-modifying agents delivered without PMPs).

Accordingly, provided herein is a method of modifying a plant, the method including delivering to the plant an effective amount of any of the Gene Writer systems provided herein, wherein the method modifies the plant and thereby introduces or increases a beneficial trait in the plant (e.g., by about 1%, 2%, 5%, 10%, 20%, 30%, 40%, 50%, 60%, 70%, 80%, 90%, 100%, or more than 100%) relative to an untreated plant. In particular, the method may increase the fitness of the plant (e.g., by about 1%, 2%, 5%, 10%, 20%, 30%, 40%, 50%, 60%, 70%, 80%, 90%, 100%, or more than 100%) relative to an untreated plant.

In some instances, the increase in plant fitness is an increase (e.g., by about 1%, 2%, 5%, 10%, 20%, 30%, 40%, 50%, 60%, 70%, 80%, 90%, 100%, or more than 100%) in discase resistance, drought tolerance, heat tolerance, cold tolerance, salt tolerance, metal tolerance, herbicide tolerance, chemical tolerance, water use efficiency, nitrogen utilization, resistance to nitrogen stress, nitrogen fixation, pest resistance, herbivore resistance, pathogen resistance, yield, yield under water-limited conditions, vigor, growth, photosynthetic capability, nutrition, protein content, carbohydrate content, oil content, biomass, shoot length, root length, root architecture, seed weight, or amount of harvestable produce.

In some instances, the increase in fitness is an increase (e.g., by about 1%, 2%, 5%, 10%, 20%, 30%, 40%, 50%, 60%, 70%, 80%, 90%, 100%, or more than 100%) in development, growth, yield, resistance to abiotic stressors, or resistance to biotic stressors. An abiotic stress refers to an environmental stress condition that a plant or a plant part is subjected to that includes, e.g., drought stress, salt stress, heat stress, cold stress, and low nutrient stress. A biotic stress refers to an environmental stress condition that a plant or plant part is subjected to that includes, e.g. nematode stress, insect herbivory stress, fungal pathogen stress, bacterial pathogen stress, or viral pathogen stress. The stress may be temporary, e.g. several hours, several days, several months, or permanent, e.g. for the life of the plant.

In some instances, the increase in plant fitness is an increase (e.g., by about 1%, 2%, 5%, 10%, 20%, 30%, 40%, 50%, 60%, 70%, 80%, 90%, 100%, or more than 100%) in quality of products harvested from the plant. For example, the increase in plant fitness may be an improvement in commercially favorable features (e.g., taste or appearance) of a product harvested from the plant. In other instances, the increase in plant fitness is an increase in shelf-life of a product harvested from the plant (e.g., by about 1%, 2%, 5%, 10%, 20%, 30%, 40%, 50%, 60%, 70%, 80%, 90%, 100%, or more than 100%).

Alternatively, the increase in fitness may be an alteration of a trait that is beneficial to human or animal health, such as a reduction in allergen production. For example, the increase in fitness may be a decrease (e.g., by about 1%, 2%, 5%, 10%, 20%, 30%, 40%, 50%, 60%, 70%, 80%, 90%, 100%, or more than 100%) in production of an allergen (e.g., pollen) that stimulates an immune response in an animal (e.g., human).

The modification of the plant (e.g., increase in fitness) may arise from modification of one or more plant parts. For example, the plant can be modified by contacting leaf, seed, pollen, root, fruit, shoot, flower, cells, protoplasts, or tissue (e.g., meristematic tissue) of the plant. As such, in another aspect, provided herein is a method of increasing the fitness of a plant, the method including contacting pollen of the plant with an effective amount of any of the plant-modifying compositions herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

In yet another aspect, provided herein is a method of increasing the fitness of a plant, the method including contacting a seed of the plant with an effective amount of any of the Gene Writer systems disclosed herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

In another aspect, provided herein is a method including contacting a protoplast of the plant with an effective amount of any of the Gene Writer systems described herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

In a further aspect, provided herein is a method of increasing the fitness of a plant, the method including contacting a plant cell of the plant with an effective amount of any of the Gene Writer system described herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

In another aspect, provided herein is a method of increasing the fitness of a plant, the method including contacting meristematic tissue of the plant with an effective amount of any of the plant-modifying compositions herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

In another aspect, provided herein is a method of increasing the fitness of a plant, the method including contacting an embryo of the plant with an effective amount of any of the plant-modifying compositions herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

B. Application Methods

A plant described herein can be exposed to any of the Gene Writer system compositions described herein in any suitable manner that permits delivering or administering the composition to the plant. The Gene Writer system may be delivered either alone or in combination with other active (e.g., fertilizing agents) or inactive substances and may be applied by, for example, spraying, injection (e.g. microinjection), through plants, pouring, dipping, in the form of concentrated liquids, gels, solutions, suspensions, sprays, powders, pellets, briquettes, bricks and the like, formulated to deliver an effective concentration of the plant-modifying composition. Amounts and locations for application of the compositions described herein are generally determined by the habitat of the plant, the lifecycle stage at which the plant can be targeted by the plant-modifying composition, the site where the application is to be made, and the physical and functional characteristics of the plant-modifying composition.

In some instances, the composition is sprayed directly onto a plant, e.g., crops, by e.g., backpack spraying, aerial spraying, crop spraying/dusting etc. In instances where the Gene Writer system is delivered to a plant, the plant receiving the Gene Writer system may be at any stage of plant growth. For example, formulated plant-modifying compositions can be applied as a seed-coating or root treatment in early stages of plant growth or as a total plant treatment at later stages of the crop cycle. In some instances, the plant-modifying composition may be applied as a topical agent to a plant.

Further, the Gene Writer system may be applied (e.g., in the soil in which a plant grows, or in the water that is used to water the plant) as a systemic agent that is absorbed and distributed through the tissues of a plant. In some instances, plants or food organisms may be genetically transformed to express the Gene Writer system.

Delayed or continuous release can also be accomplished by coating the Gene Writer system or a composition with the plant-modifying composition(s) with a dissolvable or biocrodable coating layer, such as gelatin, which coating dissolves or erodes in the environment of use, to then make the plant-modifying com Gene Writer system position available, or by dispersing the agent in a dissolvable or erodable matrix. Such continuous release and/or dispensing means devices may be advantageously employed to consistently maintain an effective concentration of one or more of the plant-modifying compositions described herein.

In some instances, the Gene Writer system is delivered to a part of the plant, e.g., a leaf, seed, pollen, root, fruit, shoot, or flower, or a tissue, cell, or protoplast thereof. In some instances, the Gene Writer system is delivered to a cell of the plant. In some instances, the Gene Writer system is delivered to a protoplast of the plant. In some instances, the Gene Writer system is delivered to a tissue of the plant. For example, the composition may be delivered to meristematic tissue of the plant (e.g., apical meristem, lateral meristem, or intercalary meristem). In some instances, the composition is delivered to permanent tissue of the plant (e.g., simple tissues (e.g., parenchyma, collenchyma, or sclerenchyma) or complex permanent tissue (e.g., xylem or phloem)). In some instances, the Gene Writer system is delivered to a plant embryo.

C. Plants

A variety of plants can be delivered to or treated with a Gene Writer system described herein. Plants that can be delivered a Gene Writer system (i.e., "treated") in accordance with the present methods include whole plants and parts thereof, including, but not limited to, shoot vegetative organs/structures (e.g., leaves, stems and tubers), roots, flowers and floral organs/structures (e.g., bracts, sepals, petals, stamens, carpels, anthers and ovules), seed (including embryo, endosperm, cotyledons, and seed coat) and fruit (the mature ovary), plant tissue (e.g., vascular tissue, ground tissue, and the like) and cells (e.g., guard cells, egg cells, and the like), and progeny of same. Plant parts can further refer parts of the plant such as the shoot, root, stem, seeds, stipules, leaves, petals, flowers, ovules, bracts, branches, petioles, internodes, bark, pubescence, tillers, rhizomes, fronds, blades, pollen, stamen, and the like.

The class of plants that can be treated in a method disclosed herein includes the class of higher and lower plants, including angiosperms (monocotyledonous and dicotyledonous plants), gymnosperms, ferns, horsetails, psilophytes, lycophytes, bryophytes, and algae (e.g., multicellular or unicellular algae). Plants that can be treated in accordance with the present methods further include any vascular plant, for example monocotyledons or dicotyledons or gymnosperms, including, but not limited to alfalfa, apple, Arabidopsis, banana, barley, canola, castor bean, chrysanthemum, clover, cocoa, coffee, cotton, cottonseed, corn, crambe, cranberry, cucumber, dendrobium, dioscorea, eucalyptus, fescue, flax, gladiolus, liliacea, linseed, millet, muskmelon, mustard, oat, oil palm, oilseed rape, papaya, peanut, pineapple, ornamental plants, Phaseolus, potato, rapeseed, rice, rye, ryegrass, safflower, sesame, sorghum, soybean, sugarbeet, sugarcane, sunflower, strawberry, tobacco, tomato, turfgrass, wheat and vegetable crops such as lettuce, celery, broccoli, cauliflower, cucurbits; fruit and nut trees, such as apple, pear, peach, orange, grapefruit, lemon, lime, almond, pecan, walnut, hazel; vines, such as grapes (e.g., a vineyard), kiwi, hops; fruit shrubs and brambles, such as raspberry, blackberry, gooseberry; forest trees, such as ash, pine, fir, maple, oak, chestnut, popular; with alfalfa, canola, castor bean, corn, cotton, crambe, flax, linseed, mustard, oil palm, oilseed rape, peanut, potato, rice, safflower, sesame, soybean, sugarbeet, sunflower, tobacco, tomato, and wheat. Plants that can be treated in accordance with the methods of the present invention include any crop plant, for example, forage crop, oilseed crop, grain crop, fruit crop, vegetable crop, fiber crop, spice crop, nut crop, turf crop, sugar crop, beverage crop, and forest crop. In certain instances, the crop plant that is treated in the method is a soybean plant. In other certain instances, the crop plant is wheat. In certain instances, the crop plant is corn. In certain instances, the crop plant is cotton. In certain instances, the crop plant is alfalfa. In certain instances, the crop plant is sugarbeet. In certain instances, the crop plant is rice. In certain instances, the crop plant is potato. In certain instances, the crop plant is tomato.

In certain instances, the plant is a crop. Examples of such crop plants include, but are not limited to, monocotyledonous and dicotyledonous plants including, but not limited to, fodder or forage legumes, ornamental plants, food crops, trees, or shrubs selected from Acer spp., *Allium* spp., *Amaranthus* spp., *Ananas comosus, Apium graveolens, Arachis* spp, *Asparagus officinalis, Beta vulgaris, Brassica* spp. (e.g., *Brassica napus, Brassica rapa* ssp. (canola, oilseed rape, turnip rape), *Camellia sinensis, Canna indica, Cannabis saliva, Capsicum* spp., *Castanea* spp., *Cichorium endivia, Citrullus lanatus*, Citrus spp., *Cocos* spp., *Coffea* spp., *Coriandrum sativum, Corylus* spp., *Crataegus* spp., *Cucurbita* spp., *Cucumis* spp., *Daucus carota, Fagus* spp., *Ficus carica*, Fragaria spp., *Ginkgo biloba*, Glycine spp. (e.g., *Glycine max, Soja hispida* or *Soja* max), *Gossypium hirsutum, Helianthus* spp. (e.g., *Helianthus annuus*), Hibiscus spp., *Hordeum* spp. (e.g., *Hordeum vulgare*), *Ipomoea batatas, Juglans* spp., *Lactuca sativa, Linum usitatissimum, Litchi chinensis*, Lotus spp., Luffa *acutangula, Lupinus* spp., *Lycopersicon* spp. (e.g., *Lycopersicon* esculenturn, *Lycopersicon lycopersicum, Lycopersicon pyriforme*), Malus spp., *Medicago sativa*, Mentha spp., *Miscanthus sinensis, Morus nigra*, Musa spp., *Nicotiana* spp., *Olea* spp., *Oryza* spp. (e.g., *Oryza sativa, Oryza latifolia*), *Panicum miliaceum, Panicum virgatum, Passiflora edulis, Petroselinum crispum, Phaseolus* spp., *Pinus* spp., *Pistacia vera, Pisum* spp., *Poa* spp., *Populus* spp., *Prunus* spp., *Pyrus communis, Quercus* spp., *Raphanus sativus, Rheum rhabarbarum, Ribes* spp., *Ricinus communis, Rubus* spp., *Saccharum* spp., Salix sp., *Sambucus* spp., *Secale cereale, Sesamum* spp., *Sinapis* spp., Solanum spp. (e.g., *Solanum tuberosum*, *Solanum integrifolium* or *Solanum lycopersicum*), *Sorghum bicolor*, *Sorghum halepense*, *Spinacia* spp., *Tamarindus indica*, *Theobroma cacao*, *Trifolium* spp., *Triticosecale rimpaui*, *Triticum* spp. (e.g., *Triticum aestivum*, *Triticum durum*, *Triticum turgidum*, *Triticum hybernum*, *Triticum macha*, *Triticum sativum* or *Triticum vulgare*), *Vaccinium* spp., *Vicia* spp., *Vigna* spp., *Viola odorata*, *Vitis* spp., and *Zea mays*. In certain embodiments, the crop plant is rice, oilseed rape, canola, soybean, corn (maize), cotton, sugarcane, alfalfa, sorghum, or wheat.

The plant or plant part for use in the present invention include plants of any stage of plant development. In certain instances, the delivery can occur during the stages of germination, seedling growth, vegetative growth, and reproductive growth. In certain instances, delivery to the plant occurs during vegetative and reproductive growth stages. In some instances, the composition is delivered to pollen of the plant. In some instances, the composition is delivered to a seed of the plant. In some instances, the composition is delivered to a protoplast of the plant. In some instances, the composition is delivered to a tissue of the plant. For example, the composition may be delivered to meristematic tissue of the plant (e.g., apical meristem, lateral meristem, or intercalary meristem). In some instances, the composition is delivered to permanent tissue of the plant (e.g., simple tissues (e.g., parenchyma, collenchyma, or sclerenchyma) or complex permanent tissue (e.g., xylem or phloem)). In some instances, the composition is delivered to a plant embryo. In some instances, the composition is delivered to a plant cell. The stages of vegetative and reproductive growth are also referred to herein as "adult" or "mature" plants.

In instances where the Gene Writer system is delivered to a plant part, the plant part may be modified by the plant-modifying agent. Alternatively, the Gene Writer system may be distributed to other parts of the plant (e.g., by the plant's circulatory system) that are subsequently modified by the plant-modifying agent.

---

Lengthy table referenced here

US12037602-20240716-T00004

Please refer to the end of the specification for access instructions.

---

Lengthy table referenced here

US12037602-20240716-T00005

Please refer to the end of the specification for access instructions.

---

All publications, patent applications, patents, and other publications and references (e.g., sequence database reference numbers) cited herein are incorporated by reference in their entirety. For example, all GenBank, Unigene, and Entrez sequences referred to herein, e.g., in any Table herein, are incorporated by reference. Unless otherwise specified, the sequences specified herein (e.g., by gene name in RepBase or by accession number), including in any Table herein, refer to the database entries current as of Mar. 4, 2020. When one gene or protein references a plurality of sequence accession numbers, all of the sequence variants are encompassed.

EXAMPLES

The invention is further illustrated by the following examples. The examples are provided for illustrative purposes only and are not to be construed as limiting the scope or content of the invention in any way.

Example 1: Delivery of a Gene Writer System to Mammalian Cells

This example describes a Gene Writer genome editing system delivered to a mammalian cell for the insertion of exogenous DNA into a mammalian cell genome. The Gene Writer component parts are derived from a retrotransposon, e.g., a retrotransposon listed in Table X.

In this example, the polypeptide component of the Gene Writer™ system is the Vingi_1_EE retrotransposase from *Erinaceus europaeus* encoded in a plasmid with expression driven by a CMV promoter. The template component comprises a plasmid with a heterologous object sequence between the 5' UTR and 3' UTR from the Vingi_1_EE retrotransposon, all of which is transcribed by a CMV promoter. The heterologous object sequence is an EF1a-driven GFP reporter cassette that is in antisense orientation relative to the CMV-driven template transcript. Additionally, the GFP gene is interrupted by a forward intron, such that splicing of the RNA only occurs when transcribed from the CMV promoter, while the intron remains present when transcribed in the opposite direction from the EF1a promoter. As a result, the GFP ORF is only intact when transcription first occurs from the CMV promoter and the spliced transcript is then reverse transcribed and integrated into the genome, allowing subsequent transcription driven by EF1a to generate an mRNA encoding functional GFP.

U2OS Cells are Nucleofected with the Following Test Agents:
1. DNA coding for the polypeptide described above
2. DNA coding for the polypeptide described above with endonuclease-inactivating mutation
3. DNA coding for the template RNA described above
4. Combination of 1 and 3
5. Combination of 2 and 3

After transfection, U2OS cells are cultured for at least 3 days and then assayed for genomic insertions. For detection of expression, cells are assayed by flow cytometry to measure the levels of GFP, which should only be produced after successful integration events. For a molecular readout, genomic DNA samples isolated from each group of U2OS cells are subjected to unidirectional sequencing to determine the number and identity of insertion sites. To perform unidirectional sequencing, genomic DNA is first extracted and then fragmented. Adapters are ligated to the fragments, and a PCR is performed using an adapter primer and a primer specific to the Gene Writer template. A primer designed to span the intronic junction, which thus binds only to integrated GFP, is used to reduce background reads from the unspliced GFP present in the template plasmid. First round amplicons are then subjected to a second round of PCR to amplify the signal and subsequently analyzed on a MiSeq to determine the genomic locations of successful integration events. Incorporation of unique barcodes into primers permits an estimate of the number of integration events. Retrotransposase-mediated Gene Writing is indicated by the presence of integration events enriched in condition (4) above.

Example 2: Directing a Retrotransposon to a Specific Site in Human Cells

This example describes a Gene Writer genome editing system delivered to a mammalian cell for the insertion of exogenous DNA into a mammalian cell genome at a predetermined site. The Gene Writer component parts are derived from a retrotransposon, e.g., a retrotransposon listed in Table X, and additionally comprise a heterologous DNA binding domain.

In this example, the polypeptide component of the Gene Writer™ system is the Vingi_1_EE retrotransposase from *Erinaceus europaeus* encoded in a plasmid with expression driven by a CMV promoter. The Vingi_1_EE retrotransposase additionally includes an N-terminal dCas9 domain. The Gene Writer polypeptide is directed by the addition of a U6-driven gRNA with 20 nt homology to the AAVS1 site, thus the dCas9 domain in combination with the gRNA provides heterologous DNA binding activity to guide the polypeptide to the AAVS1 site for programmed retrotransposition of the template. The template component comprises a plasmid with a heterologous object sequence between the 5' UTR and 3' UTR from the Vingi_1_EE retrotransposon, all of which is transcribed by a CMV promoter. The heterologous object sequence is an EFla-driven GFP reporter cassette that is in antisense orientation relative to the CMV-driven template transcript. Additionally, the GFP gene is interrupted by a forward intron, such that splicing of the RNA only occurs when transcribed from the CMV promoter, while the intron remains present when transcribed in the opposite direction from the EFla promoter. As a result, the GFP ORF is only intact when transcription first occurs from the CMV promoter and the spliced transcript is then reverse transcribed and integrated into the genome, allowing subsequent transcription driven by EFla to generate an mRNA encoding functional GFP (Figure X).

U2OS Cells are Nucleofected with the Following Test Agents:
1. DNA coding for the polypeptide and gRNA described above
2. DNA coding for the polypeptide and gRNA described above with endonuclease-inactivating mutation
3. DNA coding for the polypeptide described above, but lacking the gRNA
4. DNA coding for the template RNA described above
5. Combination of 1 and 4
6. Combination of 2 and 4
7. Combination of 3 and 4

After transfection, U2OS cells are cultured for at least 3 days and then assayed for genomic insertions. For detection of expression, cells are assayed by flow cytometry to measure the levels of GFP, which should only be produced after successful integration events. For a molecular readout, genomic DNA samples isolated from each group of U2OS cells are subjected to ddPCR to determine the frequency of insertions at the AAVS1 site. A primer annealing to the 3' end of the template is paired with a primer that anneals downstream of the AAVS1 insertion site in the genome and a probe located between the primer pair. Thus, amplification events occur when there is an integration at the AAVS1 site and the primers can anneal on each side of the integration junction. By this design, signal in the ddPCR assay, normalized to a standard RPP30 reference, indicates the copy number of integration events at the AAVS1 site. Retrotransposase-mediated Gene Writing is indicated by enrichment of the integration signal in condition (5) above. As compared to condition (7), where the system lacks a gRNA to drive the targeting specificity of the polypeptide, condition (5) demonstrates at least a five-fold increase in integration efficiency at the AAVS1 site as measured by ddPCR.

Example 3: Gene Writer™ Enabling Nucleotide Substitution in Genomic DNA to Correct Alpha-1 Antitrypsin Deficiency A Gene Writer system can be used to alter a target DNA, e.g., genomic DNA, by insertion, deletion, or substitution of nucleotides. Without wishing to be limited to a single approach, this example describes the use of a Gene Writer™ gene editing system to alter a genomic sequence at a single nucleotide.

In this example, the Gene Writer™ polypeptide and writing template are provided as DNA transfected into HEK293T cells that possess the PiZ genotype (E342L), a common allele associated with alpha-1 antitrypsin deficiency. The Gene Writer™ polypeptide uses a Cas9 nickase for both DNA-binding and endonuclease functions. The writing template is designed to have homology to the target sequence, while incorporating additional nucleotides at the desired position, such that reverse transcription of the template RNA results in the generation of a new DNA strand containing the substitution.

To create the transversion in the affected human SERPINA1 gene that restores the GAG triplet coding for glutamate in healthy patients, the Gene Writer™ polypeptide is used with a specific template, which encodes a spacer for polypeptide homing, target homology domain to set up TPRT, and a template sequence for reverse transcription that includes the G substitution.

After transfection, cells are incubated for three days to allow for expression of the Gene Writing™ system and conversion of the genomic DNA target. After the incubation period, genomic DNA is extracted from cells. Genomic DNA is then subjected to PCR-based amplification using site-specific primers and amplicons are sequenced on an Illumina MiSeq according to manufacturer's protocols. Sequence analysis is then performed to determine the frequency of reads containing the desired edit.

Example 4: Detection of Retrotransposaseon-Mediated Integration in Human Cells

This example describes the identification of retrotransposons demonstrating functionality in human cells. By assaying native or modified retrotransposons for integration activity, this example demonstrates a method for the selection of retrotransposases comprising protein domains that can be used to recreate retrotransposases in their native domain composition or as components of chimeric or synthetic Gene Writers for engineering the genome of human cells. For example, a retrotransposon successfully producing an integration signal is expected to comprise functional DNA binding, endonuclease, reverse transcriptase, and, optionally, second-strand synthesis activities. In some embodiments, a reverse transcriptase domain from a retrotransposon that has been shown to demonstrate activity as described in this example is used to provide the reverse transcriptase activity in a Gene Writer polypeptide, e.g., as the RT of a Cas-RT fusion polypeptide, e.g., as disclosed in Table 9. The screen described here employs the nucleofection of a two-plasmid system comprising a retrotransposon polypeptide and an inactivated reporter template into human cells to characterize the RT-dependent retrotransposition efficiency of computationally selected retrotransposons.

Figure 8:
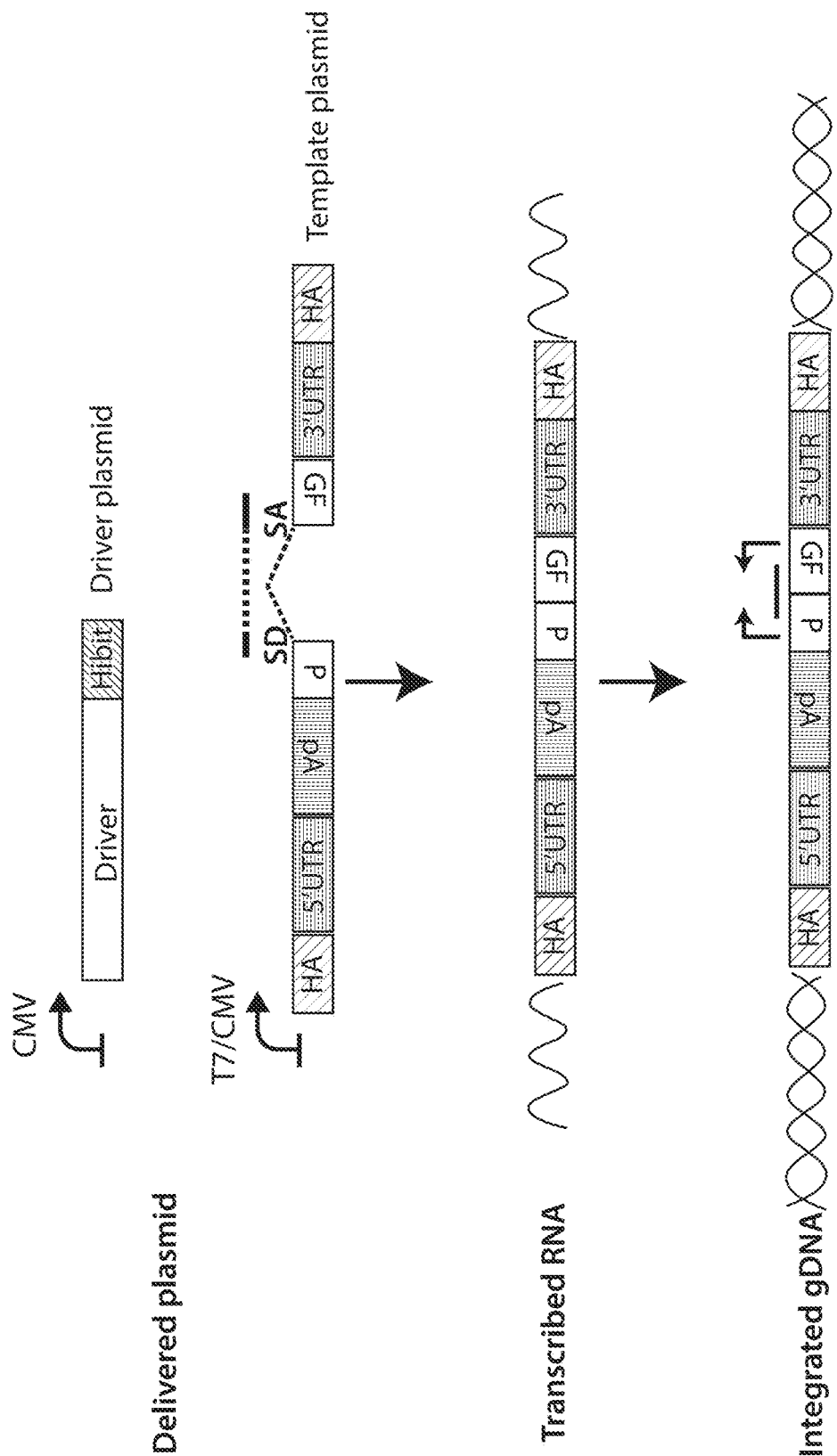
FIG. 8 represents screening construct design for retrotransposon-mediated integration in human cells. A driver plasmid comprising a retrotransposase (Driver) expression cassette is transfected together with a template plasmid comprising a retrotransposon-dependent reporter cassette. Whereas expression from the template plasmid results in a non-functional GFP because of an interrupting antisense intron, transcription of the template molecule from the template plasmid results in the generation of an RNA with the intron removed by splicing that can then be reverse transcribed and integrated by the system. Expression of the reporter cassette will thus only occur from the integrated reporter cassette (Integrated gDNA, bottom) and not from the template plasmid. HA=homology arm, where applicable; CMV=mammalian CMV promoter; HiBit=HiBit tag for quantification of protein expression; T7=T7 RNA polymerase promoter; UTR=untranslated sequence, e.g., native retrotransposon UTRs; pA=poly A signal; SD-SA is used to indicate the splice-donor and splice-acceptor sites of an antisense intron in the GFP coding sequence. HA=homology arm, where applicable (e.g., see Example 6); CMV=mammalian CMV promoter; HiBit=HiBit tag for quantification of protein expression; T7=T7 RNA polymerase promoter; UTR=untranslated sequence, e.g., native retrotransposon UTRs; pA=poly A signal; SD-SA is used to indicate the splice-donor and splice-acceptor sites of an antisense intron in the GFP coding sequence FIG. 9 discloses screening of candidate retrotransposons and identifies 25 candidates that integrate a trans payload in human cells. A total of 163 retrotransposon systems were assayed for activity in human cells as described in Example 4. Integration as measured by ddPCR is shown as copies/genome for each retrotransposon driver/template system. The height of each bar indicates the average value of two replicates. After further optimization in Examples 4 and 5, the constructs with higher activity are further highlighted in FIG. 10.

In this example, a two-plasmid system was employed comprising: 1) a retrotransposon-encoded protein expression driver plasmid, e.g., a plasmid encoding a retrotransposase polypeptide from Table 3B, comprising a human codon-optimized retrotransposase coding sequence fused with a HiBit tag for detection of protein expression and driven by the mammalian CMV promoter, and 2) a template plasmid, e.g., a plasmid comprising (i) a promoter for expression in mammalian cells to drive transcription of the RNA template molecule, e.g., a CMV promoter, with the template molecule further comprising (ii) a reporter cassette that is inactive in the context of plasmid-derived expression, e.g., an EGFP expression cassette with coding sequence disrupted by an intron encoded in the opposite orientation (GFPai) flanked by (iii) the untranslated regions (UTRs) of the native retrotransposon that naturally comprises the retrotransposase of (1) (see FIG. 8). Here, the GFP reporter is encoded in the absence of a promoter to drive its expression to avoid any loss of signal due to GFP toxicity (see FIG. 8).

To deliver the two-plasmid system into U2OS cells, ~400,000 cells were nucleofected with 88.3 ng driver plasmid (1) and 161.7 ng template plasmid (2) using the Lonza SE Cell Line 96-well Nucleofector™ Kit as per manufacturer's instructions. Three days post-nucleofection, integration efficiency was measured using ddPCR to determine the copy number of integrations per genome. Reverse transcription-dependent retrotransposition activity was measured by using a ddPCR approach that utilized the antisense intron as described below. Expression of the driver protein was measured by HiBit-based bioluminescence assay.

When employing an antisense intron reporter containing intronic sequence within the reporter cassette of the template plasmid, e.g., the GFPai system described here, the intron is present in the plasmid but is spliced out during transcription, thus only reporter DNA derived from the transcript by reverse transcription would lack the intron sequence (FIG. 8). To limit detection to only events derived from reverse transcription, a ddPCR Taqman probe was designed to span the splicing junction to hybridize to DNA lacking the intron but not to plasmid DNA still containing the intact intron. The forward and reverse primers were designed upstream and downstream of the probe and within the GFP sequence. This design avoids the possible background from template plasmid directly recombined into the genome without a first transcription step, or from intact template plasmid contaminating the gDNA extraction samples.

Figure 9:
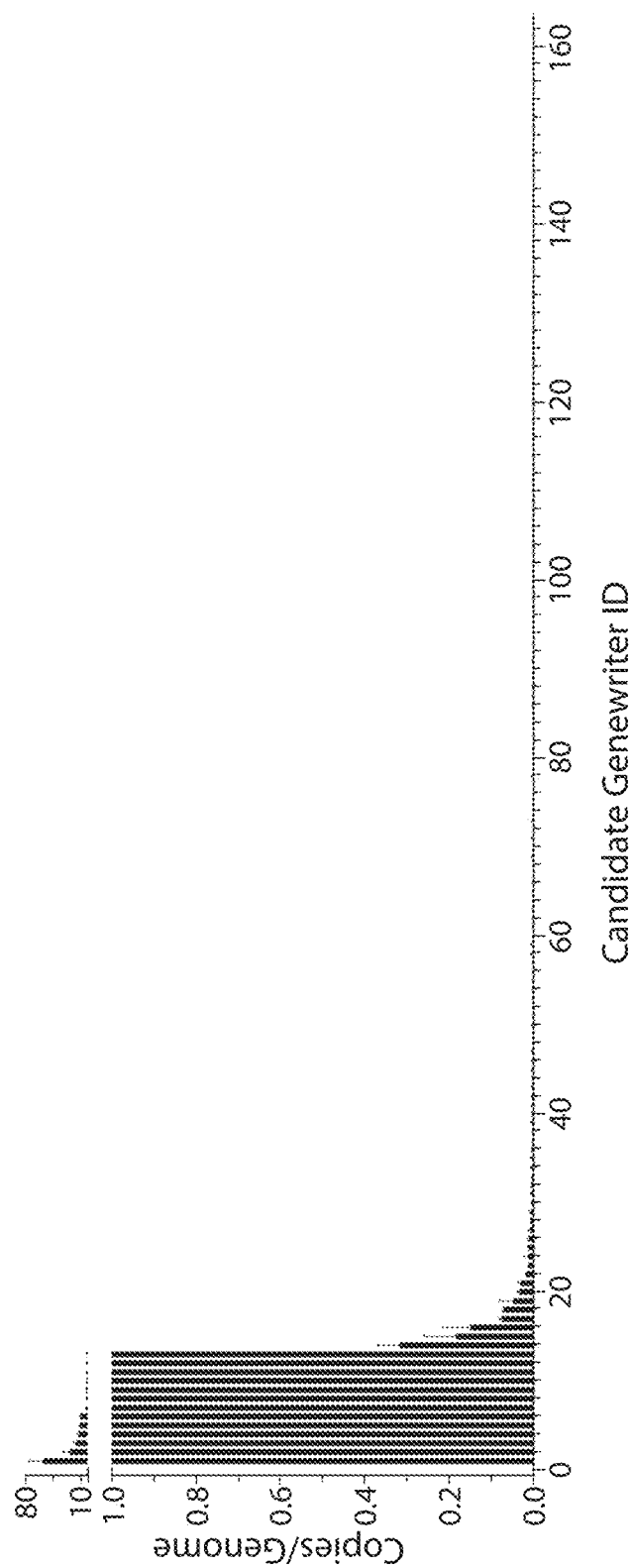

Gene Writing systems derived from retrotransposases in Table 3B were assayed as following this example to determine activity in human cells. Analysis of the integration efficiency of 163 candidate retrotransposon systems by ddPCR is shown in FIG. 9. From the assay described in this example, 25 retrotransposase candidates demonstrated successful trans-integration of the retrotransposon UTR-flanked Template sequence at greater than 0.01 copies/genome on average (see FIG. 10).

In some embodiments, candidate systems are further optimized as described elsewhere in this application. In some embodiments, two driver plasmids are designed for one retrotransposon system based on different consensus approaches (see, e.g., Example 8). In some embodiments, driver plasmids are codon-optimized for human codon preferences. In some embodiments, the RNA template molecule is designed to further comprise sequences flanking the retrotransposon UTRs to facilitate integration, e.g., homology arms comprising sequence identity to the regions upstream and downstream of the retrotransposon in its endogenous genomic context or to a target DNA sequence in the human genome (see, e.g., Example 9).

Example 5: Consensus Genome Mapping for Retrotransposase Amino Acid Sequence with Improved Activity in Human Cells This example describes the use of genome mining consensus approaches to engineer improved retrotransposon activity. Given a retrotransposon may exist in many copies within a genome, a comparison of all copies could be used to reconstruct an ancestral sequence or one expected to have the highest activity within the host.

In this example, retrotransposons from Table 3B were computationally identified in their host genome. Genomic nucleotide sequences were identified that contained high matches to the termini of each retrotransposon and at least 80% overall nucleotide identity to the complete element. The predicted coding sequence of each pairwise alignment to the target retrotransposon was translated and used to generate a consensus amino acid sequence for the corresponding retrotransposase informed by all copies within the host genome.

To generate constructs for the consensus rederived retrotransposases, each amino acid sequence was back-translated and human optimized and cloned into a driver plasmid as in Example 7. Consensus-generated retrotransposases were then compared with the first-generation retrotransposase sequences for integration activity. For each retrotransposon system, the integration efficiencies driven by consensus-generated and original retrotransposases were compared using the two plasmids system described in Example 7. The same template plasmids were co-nucleofected with one of the two drivers into U2OS cells. ~400,000 cells were nucleofected with 88.3 ng driver plasmid and 161.7 ng template plasmid using the Lonza SE Cell Line 96-well Nucleofector Kit as according to manufacturer's protocols. Genomic DNA was extracted 3 days post nucleofection to quantify the integration efficiency by ddPCR as described in Example 7.

Figure 11:
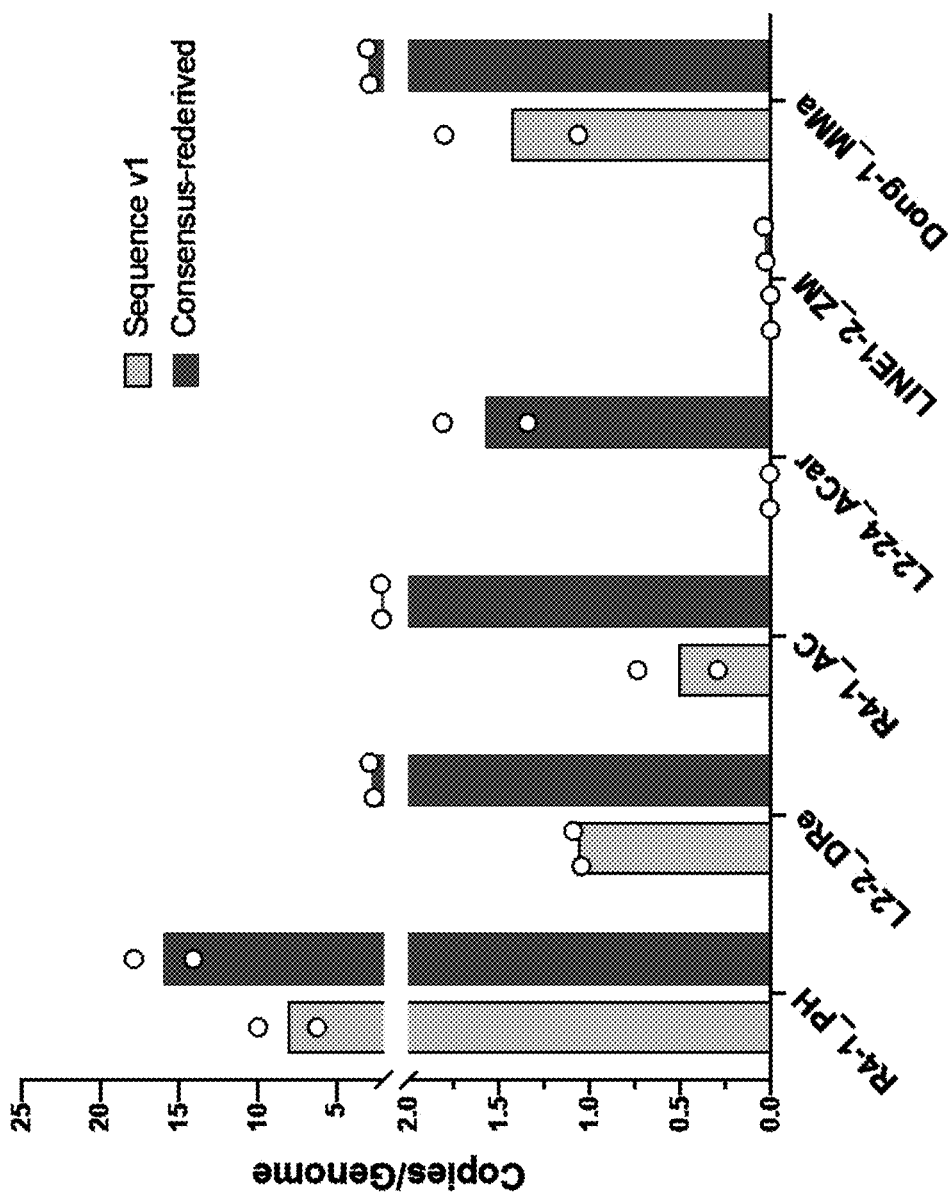
FIG. 11 Retrotransposon consensus sequence can rescue or improve trans integration activity in human cells. Integration efficiency measured by copies/genome via ddPCR as described in Example 5 is shown for each retrotransposon driver/template system. The height of each bar indicates the average value of two replicates. Empty circles indicate each replicate and bars represent the original sequences (light gray) or the novel consensus-generated protein sequence (dark gray).

Several retrotransposons showed rescued or improved activity based on the ddPCR integration readout. Specifically, consensus-generated sequences for CR1-3_IS, CR-10_Ami, CR1-54_AAe, and TART-1_DWi only integrated into human cells with the consensus-generated drivers (FIG. 11). Additionally, L2-18_ACar and RTE-2_LMi showed markedly improved activity using the consensus-generated sequence. Improved sequences are shown in Table 11.

Example 6: Addition of Homology Arms Derived from Endogenous Integration Sites in the Native Host Improves Integration of a Gene Writer Template in Human Cells This example describes the use of genome mining motif approaches to engineer improved Gene Writing activity.

More specifically, retrotransposons from Table 3B were computationally identified in their host genome. Genomic nucleotide sequences were identified that contained high matches to the termini of each native retrotransposon and at least 80% overall nucleotide identity to the complete element. The 3' and 5' neighboring sequences from the host genome were extracted from each identified occurrence of a given element and motifs corresponding to the 3' and 5' ends were generated. Consensus motifs were next aligned to the human genome (assembly hg38) and homology arms were designed with identity to human sequences based on best matches to each motif. Human-specific homology arms used here are indicated in Table 11.

To generate the new template plasmids, the 3' and 5' homology arms, described above, were inserted immediately downstream and upstream of the 3' and 5' retrotransposon UTR sequences, as described in Example 4. Template plasmids comprising or lacking the homology arms were transfected with a matching driver plasmid as described in Example 4 and the performances of the two template versions were compared to characterize any changes in activity. Specifically, ~400,000 U2OS cells were nucleofected with 88.3 ng driver plasmid and 161.7 ng template plasmid using the Lonza SE Cell Line 96-well Nucleofector Kit, as according to manufacturer's protocols. gDNA was extracted 3 days post nucleofection to quantify the integration efficiency of each system by ddPCR, as described in Example 4.

Figure 12:
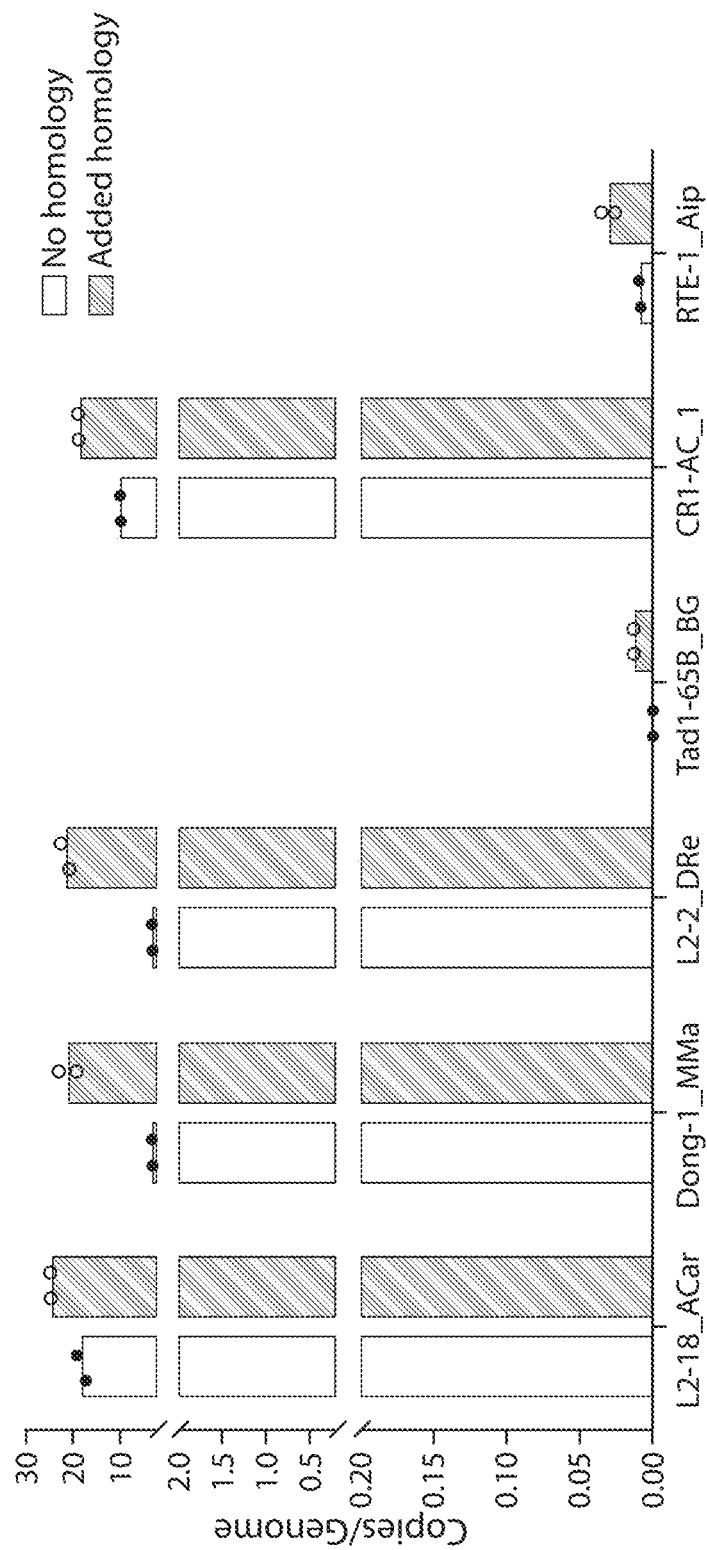
FIG. 12 shows that consensus motif-generated homology arm sequences can rescue or improve retrotransposon trans integration activity in human cells. Integration efficiency as measured by copies/genome via ddPCR (Example 6) is shown for each Gene Writer driver/template system. The height of each bar indicates the average value of two replicates. Filled circles and white bars represent template sequence without homology arms and unfilled circles and hashed bars indicate designs comprising homology arms.

Several Gene Writing templates with added homology arms showed improved or rescued activity based on the ddPCR integration readout. Specifically, homology arm design and addition improved integration for L2-18_ACar, Dong-1_MMa, L2-2_Dre, CR1_AC_1, and RTE-1_Aip (FIG. 12). Homology arm addition rescued integration for Tad1-65B_BG compared to a design lacking the homology arm, in which signal had previously been undetectable.

Example 7: Selection of Lipid Reagents with Reduced Aldehyde Content

In this example, lipids are selected for downstream use in lipid nanoparticle formulations containing Gene Writing component nucleic acid(s), and lipids are selected based at least in part on having an absence or low level of contaminating aldehydes. Reactive aldehyde groups in lipid reagents may cause chemical modifications to component nucleic acid(s), e.g., RNA, e.g., template RNA, during LNP formulation. Thus, in some embodiments, the aldehyde content of lipid reagents is minimized.

Liquid chromatography (LC) coupled with tandem mass spectrometry (MS/MS) can be used to separate, characterize, and quantify the aldehyde content of reagents, e.g., as described in Zurek et al. The Analyst 124(9):1291-1295 (1999), incorporated herein by reference. Here, each lipid reagent is subjected to LC-MS/MS analysis. The LC/MS-MS method first separates the lipid and one or more impurities with a C8 HPLC column and follows with the detection and structural determination of these molecules with the mass spectrometer. If an aldehyde is present in a lipid reagent, it is quantified using a staple-isotope labeled (SIL) standard that is structurally identical to the aldehyde, but is heavier due to C13 and N15 labeling. An appropriate amount of the SIL standard is spiked into the lipid reagent. The mixture is then subjected to LC-MS/MS analysis. The amount of contaminating aldehyde is determined by multiplying the amount of SIL standard and the peak ratio (unknown/SIL). Any identified aldehyde(s) in the lipid reagents is quantified as described. In some embodiments, lipid raw materials selected for LNP formulation are not found to contain any contaminating aldehyde content above a chosen level. In some embodiments, one or more, and optionally all, lipid reagents used for formulation comprise less than 3% total aldehyde content. In some embodiments, one or more, and optionally all, lipid reagents used for formulation comprise less than 0.3% of any single aldehyde species. In some embodiments, one or more, and optionally all, lipid reagents used in formulation comprise less than 0.3% of any single aldehyde species and less than 3% total aldehyde content.

Example 8: Quantification of RNA Modification Caused by Aldehydes During Formulation In this example, the RNA molecules are analyzed post-formulation to determine the extent of any modifications that may have happened during the formulation process, e.g., to detect chemical modifications caused by aldehyde contamination of the lipid reagents (see, e.g., Example 7).

RNA modifications can be detected by analysis of ribonucleosides, e.g., as according to the methods of Su et al. Nature Protocols 9:828-841 (2014), incorporated herein by reference in its entirety. In this process, RNA is digested to a mix of nucleosides, and then subjected to LC-MS/MS analysis. RNA post-formulation is contained in LNPs and must first be separated from lipids by coprecipitating with GlycoBlue in 80% isopropanol. After centrifugation, the pellets containing RNA are carefully transferred to a new Eppendorf tube, to which a cocktail of enzymes (benzonase, Phosphodiesterase type 1, phosphatase) is added to digest the RNA into nucleosides. The Eppendorf tube is placed on a preheated Thermomixer at 37 C for 1 hour. The resulting nucleosides mix is directly analyzed by a LC-MS/MS method that first separates nucleosides and modified nucleosides with a C18 column and then detects them with mass spectrometry.

If aldehyde(s) in lipid reagents have caused chemical modification, data analysis will associate the modified nucleoside(s) with the aldehyde(s). A modified nucleoside can be quantified using a SIL standard which is structurally identical to the native nucleoside except heavier due to C13 and N15 labeling. An appropriate amount of the SIL standard is spiked into the nucleoside digest, which is then subjected to LC-MS/MS analysis. The amount of the modified nucleoside is obtained by multiplying the amount of SIL standard and the peak ratio (unknown/SIL). LC-MS/MS is capable of quantifying all the targeted molecules simultaneously. In some embodiments, the use of lipid reagents with higher contaminating aldehyde content results in higher levels of RNA modification as compared to the use of higher purity lipid reagents as materials during the lipid nanoparticle formulation process. Thus, in preferred embodiments, higher purity lipid reagents are used that result in RNA modification below an acceptable level.

Example 9: Gene Writer™ Enabling Large Insertion into Genomic DNA

This example describes the use of a Gene Writer™ gene editing system to alter a genomic sequence by insertion of a large string of nucleotides.

In this example, the Gene Writer™ polypeptide, gRNA, and writing template are provided as DNA transfected into HEK293T cells. The Gene Writer™ polypeptide uses a Cas9 nickase for both DNA-binding and endonuclease functions. The reverse transcriptase function is derived from the highly processive RT domain of an R2 retrotransposase. The writing template is designed to have homology to the target sequence, while incorporating the genetic payload at the desired position, such that reverse transcription of the template RNA results in the generation of a new DNA strand containing the desired insertion.

To create a large insertion in the human HEK293T cell DNA, the Gene Writer™ polypeptide is used in conjunction with a specific gRNA, which targets the Cas9-containing Gene Writer™ to the target locus, and a template RNA for reverse transcription, which contains an RT-binding motif (3' UTR from an R2 element) for associating with the reverse transcriptase, a region of homology to the target site for priming reverse transcription, and a genetic payload (GFP expression unit). This complex nicks the target site and then performs TPRT on the template, initiating the reaction by using priming regions on the template that are complementary to the sequence immediately adjacent to the site of the nick and copying the GFP payload into the genomic DNA.

After transfection, cells are incubated for three days to allow for expression of the Gene Writing™ system and conversion of the genomic DNA target. After the incubation period, genomic DNA is extracted from cells. Genomic DNA is then subjected to PCR-based amplification using site-specific primers and amplicons are sequenced on an Illumina MiSeq according to manufacturer's protocols. Sequence analysis is then performed to determine the frequency of reads containing the desired edit.

Example 10: Gene Writers can Integrate Genetic Cargo Independently of the Single-Stranded Template Repair Pathway This example describes the use of a Gene Writer system in a human cell wherein the single-stranded template repair (SSTR) pathway is inhibited.

In this example, the SSTR pathway will be inhibited using siRNAs against the core components of the pathway: FANCA, FANCD2, FANCE, USP1. Control siRNAs of a non-target control will also be included. 200 k U2OS cells will be nucleofected with 30 pmols (1.5 µM) siRNAs, as well as R2Tg driver and transgene plasmids (trans configuration). Specifically, 250 ng of Plasmids expressing R2Tg, control R2Tg with a mutation in the RT domain, or control R2Tg with an endonuclease inactivating mutation) are used in conjunction with transgene at a 1:4 molar ratio (driver to transgene). Transfections of U2OS cells is performed in SE buffer using program DN100. After nucleofection, cells are grown in complete medium for 3 days. gDNA is harvested on day 3 and ddPCR is performed to assess integration at the rDNA site. Transgene integration at rDNA is detected in the absence of core SSTR pathway components.

Example 11: Formulation of Lipid Nanoparticles Encapsulating Firefly Luciferase mRNA In this example, a reporter mRNA encoding firefly luciferase was formulated into lipid nanoparticles comprising different ionizable lipids. Lipid nanoparticle (LNP) components (ionizable lipid, helper lipid, sterol, PEG) were dissolved in 100% ethanol with the lipid component. These were then prepared at molar ratios of 50:10:38.5:1.5 using ionizable lipid LIPIDV004 or LIPIDV005 (Table A1), DSPC, cholesterol, and DMG-PEG 2000, respectively. Firefly Luciferase mRNA-LNPs containing the ionizable lipid LIPIDV003 (Table A1) were prepared at a molar ratio of 45:9:44:2 using LIPIDV003, DSPC, cholesterol, and DMG-PEG 2000, respectively. Firefly luciferase mRNA used in these formulations was produced by in vitro transcription and encoded the Firefly Luciferase protein, further comprising a 5' cap, 5' and 3' UTRs, and a polyA tail. The mRNA was synthesized under standard conditions for T7 RNA polymerase in vitro transcription with co-transcriptional capping, but with the nucleotide triphosphate UTP 100% substituted with N1-methyl-pseudouridine triphosphate in the reaction. Purified mRNA was dissolved in 25 mM sodium citrate, pH 4 to a concentration of 0.1 mg/mL.

Firefly Luciferase mRNA was formulated into LNPs with a lipid amine to RNA phosphate (N:P) molar ratio of 6. The LNPs were formed by microfluidic mixing of the lipid and RNA solutions using a Precision Nanosystems NanoAssemblr™ Benchtop Instrument, using the manufacturer's recommended settings. A 3:1 ratio of aqueous to organic solvent was maintained during mixing using differential flow rates. After mixing, the LNPs were collected and dialyzed in 15 mM Tris, 5% sucrose buffer at 4° C. overnight. The Firefly Luciferase mRNA-LNP formulation was concentrated by centrifugation with Amicon 10 kDa centrifugal filters (Millipore). The resulting mixture was then filtered using a 0.2 µm sterile filter. The final LNP was stored at −80° C. until further use.

TABLE A1

Ionizable Lipids used in Example 11 ( Formula (ix), (vii), and (iii))

| LIPID ID | Chemical Name | Molecular Weight | Structure |
|---|---|---|---|
| LIPIDV003 | (9Z,12Z)-3-((4,4-bis(octyloxy)butanoyl)oxy)-2-((((3-(diethylamino)propoxy)carbonyl)oxy)methyl)propyl octadeca-9,12-dienoate | 852.29 | 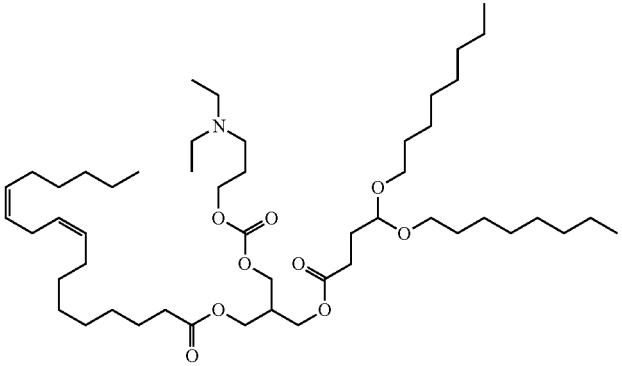 [SMILES: CCCCC/C=C\C/C=C\CCCCCCCC(=O)OCC(COC(=O)CCC(OCCCCCCCC)OCCCCCCCC)COC(=O)OCCCN(CC)CC] |

TABLE A1-continued

Ionizable Lipids used in Example 11 ( Formula (ix), (vii), and (iii))

| LIPID ID | Chemical Name | Molecular Weight | Structure |
|---|---|---|---|
| LIPIDV004 | Heptadecan-9-yl 8-((2-hydroxyethyl)(8-(nonyloxy)-8-oxooctyl)amino)octanoate | 710.18 | 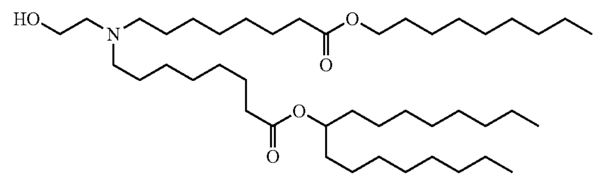 [SMILES: CCCCCCCCCOC(=O)CCCCCCCN(CCO)CCCCCCCC(=O)OC(CCCCCCCC)CCCCCCCC] |
| LIPIDV005 | | 919.56 | 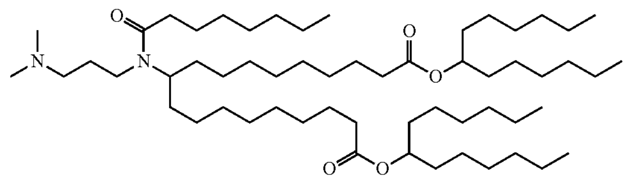 [SMILES: CCCCCCCC(=O)N(CCCN(C)C)C(CCCCCCCCC(=O)OC(CCCCCC)CCCCCC)CCCCCCCCC(=O)OC(CCCCCC)CCCCCC] |

Prepared LNPs were analyzed for size, uniformity, and % RNA encapsulation. The size and uniformity measurements were performed by dynamic light scattering using a Malvern Zetasizer DLS instrument (Malvern Panalytical). LNPs were diluted in PBS prior to being measured by DLS to determine the average particle size (nanometers, nm) and polydispersity index (pdi). The particle sizes of the Firefly Luciferase mRNA-LNPs are shown in Table A2.

TABLE A2

LNP particle size and uniformity

| LNP ID | Ionizable Lipid | Particle Size (nm) | pdi |
|---|---|---|---|
| LNPV019-002 | LIPIDV005 | 77 | 0.04 |
| LNPV006-006 | LIPIDV004 | 71 | 0.08 |
| LNPV011-003 | LIPIDV003 | 87 | 0.08 |

The percent encapsulation of luciferase mRNA was measured by the fluorescence-based RNA quantification assay Ribogreen (ThermoFisher Scientific). LNP samples were diluted in 1× TE buffer and mixed with the Ribogreen reagent per manufacturer's recommendations and measured on a i3 SpectraMax spectrophotomer (Molecular Devices) using 644 nm excitation and 673 nm emission wavelengths. To determine the percent encapsulation, LNPs were measured using the Ribogreen assay with intact LNPs and disrupted LNPs, where the particles were incubated with 1×TE buffer containing 0.2% (w/w) Triton-X100 to disrupt particles to allow encapsulated RNA to interact with the Ribogreen reagent. The samples were again measured on the i3 SpectraMax spectrophotometer to determine the total amount of RNA present. Total RNA was subtracted from the amount of RNA detected when the LNPs were intact to determine the fraction encapsulated. Values were multiplied by 100 to determine the percent encapsulation. The Firefly Luciferase mRNA-LNPs that were measured by Ribogreen and the percent RNA encapsulation is reported in Table A3.

TABLE A3

RNA encapsulation after LNP formulation

| LNP ID | Ionizable Lipid | % mRNA encapsulation |
|---|---|---|
| LNPV019-002 | LIPIDV005 | 98 |
| LNPV006-006 | LIPIDV004 | 92 |
| LNPV011-003 | LIPIDV003 | 97 |

Example 12: In Vitro Activity Testing of mRNA-LNPs in Primary Hepatocytes

In this example, LNPs comprising the luciferase reporter mRNA were used to deliver the RNA cargo into cells in culture. Primary mouse or primary human hepatocytes were thawed and plated in collagen-coated 96-well tissue culture plates at a density of 30,000 or 50,000 cells per well, respectively. The cells were plated in 1× William's Media E with no phenol red and incubated at 37° C. with 5% $CO_2$. After 4 hours, the medium was replaced with maintenance medium (1× William's Media E with no phenol containing Hepatocyte Maintenance Supplement Pack (ThermoFisher Scientific)) and cells were grown overnight at 37° C. with 5% $CO_2$. Firefly Luciferase mRNA-LNPs were thawed at 4° C. and gently mixed. The LNPs were diluted to the appropriate concentration in maintenance media containing 7.5% fetal bovine serum. The LNPs were incubated at 37° C. for 5 minutes prior to being added to the plated primary hepatocytes. To assess delivery of RNA cargo to cells, LNPs were incubated with primary hepatocytes for 24 hours and cells were then harvested and lysed for a Luciferase activity assay. Briefly, medium was aspirated from each well followed by a wash with 1×PBS. The PBS was aspirated from each well and 200 μL passive lysis buffer (PLB) (Promega) was added back to each well and then placed on a plate shaker for 10 minutes. The lysed cells in PLB were frozen and stored at −80° C. until luciferase activity assay was performed.

Figure 13A:
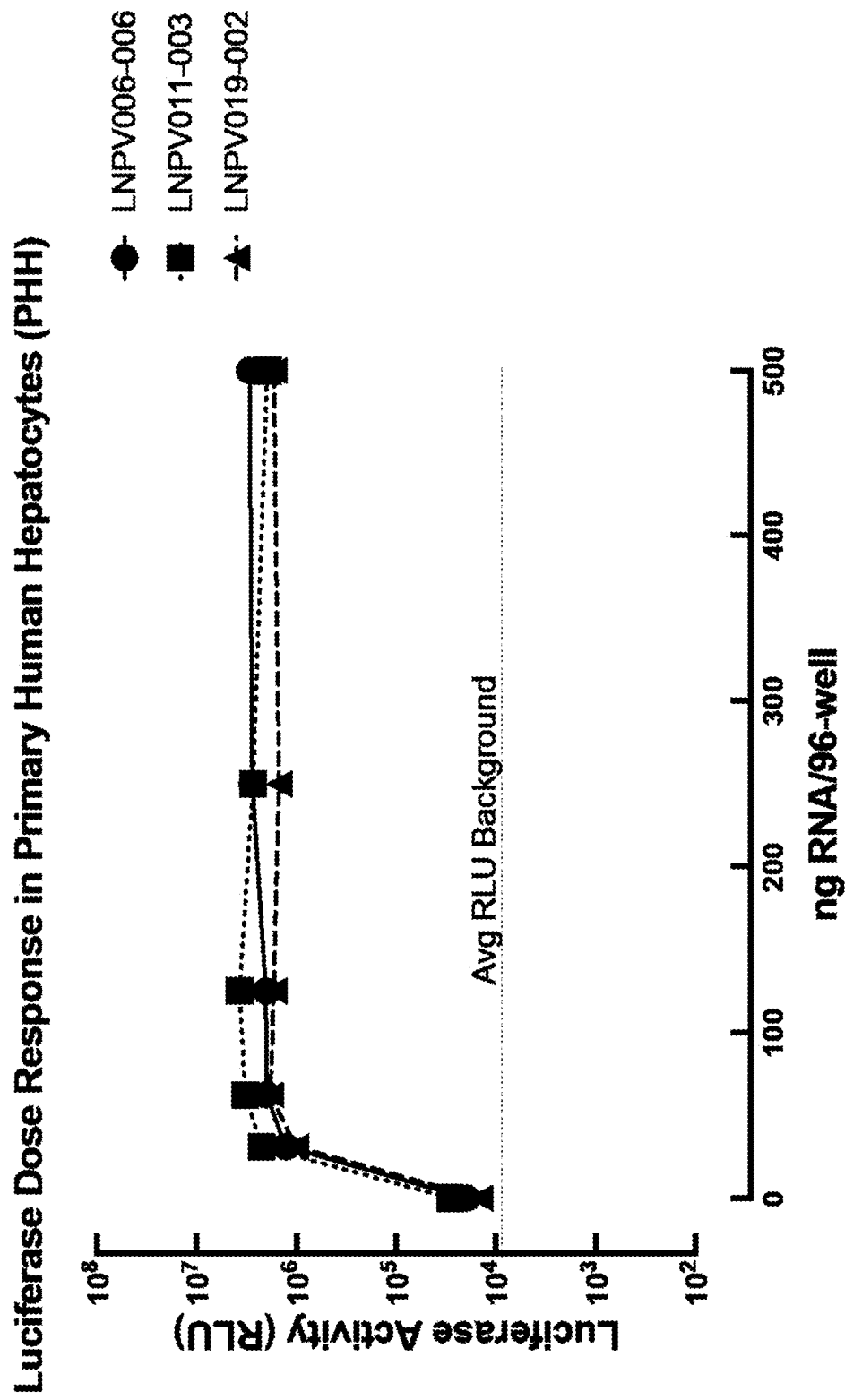
FIGS. 13A and 13B show luciferase activity assay for primary cells. LNPs formulated as according to Example 11 were analyzed for delivery of cargo to primary human (FIG. 13A) and mouse (FIG. 13B) hepatocytes, as according to Example 12. The luciferase assay revealed dose-responsive luciferase activity from cell lysates, indicating successful delivery of RNA to the cells and expression of Firefly luciferase from the mRNA cargo.
Figure 13B:
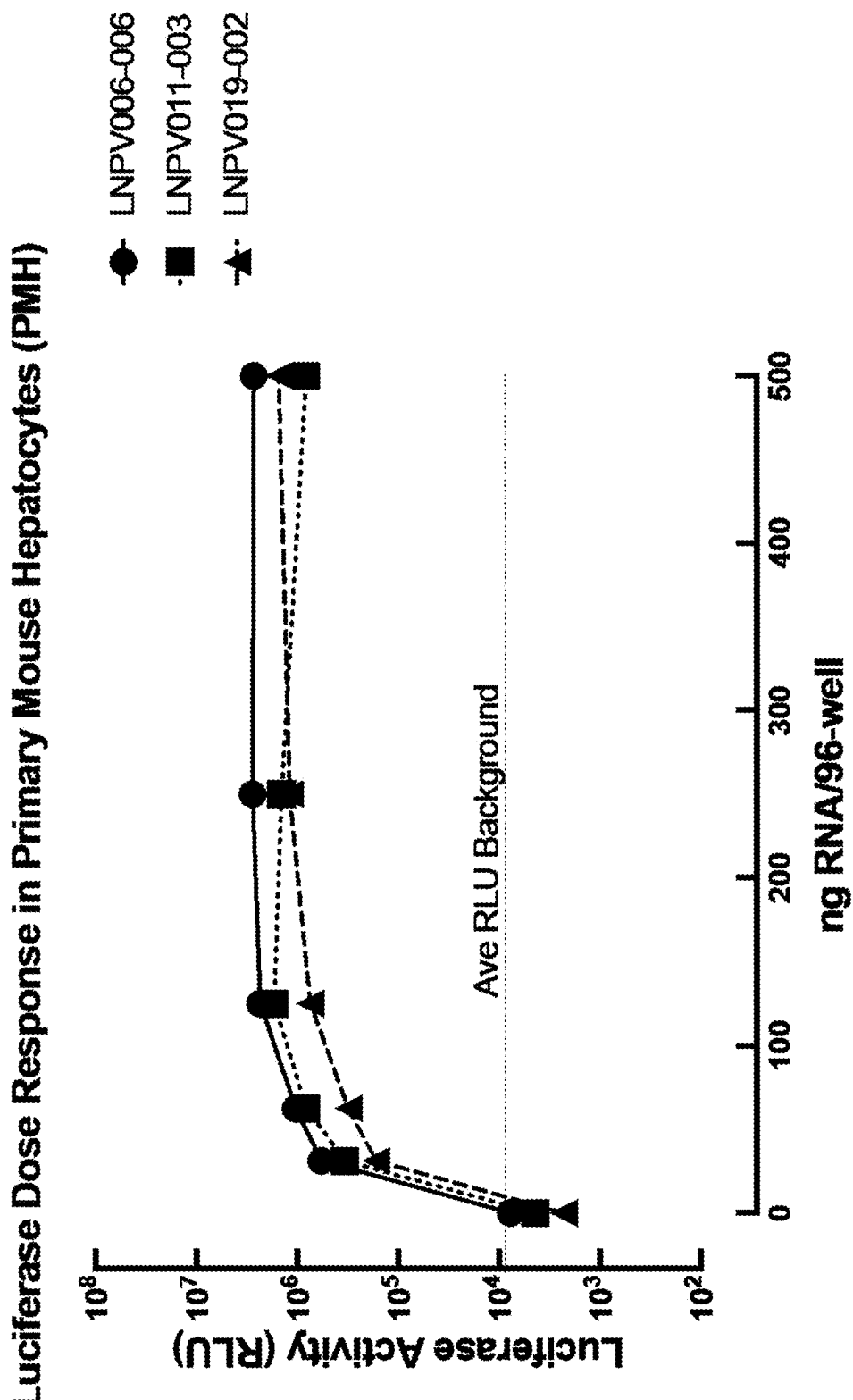

To perform the luciferase activity assay, cellular lysates in passive lysis buffer were thawed, transferred to a round bottom 96-well microtiter plate and spun down at 15,000 g at 4° C. for 3 min to remove cellular debris. The concentration of protein was measured for each sample using the Pierce™ BCA Protein Assay Kit (ThermoFisher Scientific) according to the manufacturer's instructions. Protein concentrations were used to normalize for cell numbers and determine appropriate dilutions of lysates for the luciferase assay. The luciferase activity assay was performed in white-walled 96-well microtiter plates using the luciferase assay reagent (Promega) according to manufacturer's instructions and luminescence was measured using an i3X SpectraMax plate reader (Molecular Devices). The results of the dose-response of Firefly luciferase activity mediated by the Firefly mRNA-LNPs are shown in FIG. 13 and indicate successful LNP-mediated delivery of RNA into primary cells in culture. As shown in FIG. 13A, LNPs formulated as according to Example 11 were analyzed for delivery of cargo to primary human (A) and mouse (B) hepatocytes, as according to Example 12. The luciferase assay revealed dose-responsive luciferase activity from cell lysates, indicating successful delivery of RNA to the cells and expression of Firefly luciferase from the mRNA cargo.

Example 13: LNP-Mediated Delivery of RNA to the Mouse Liver

Figure 14:
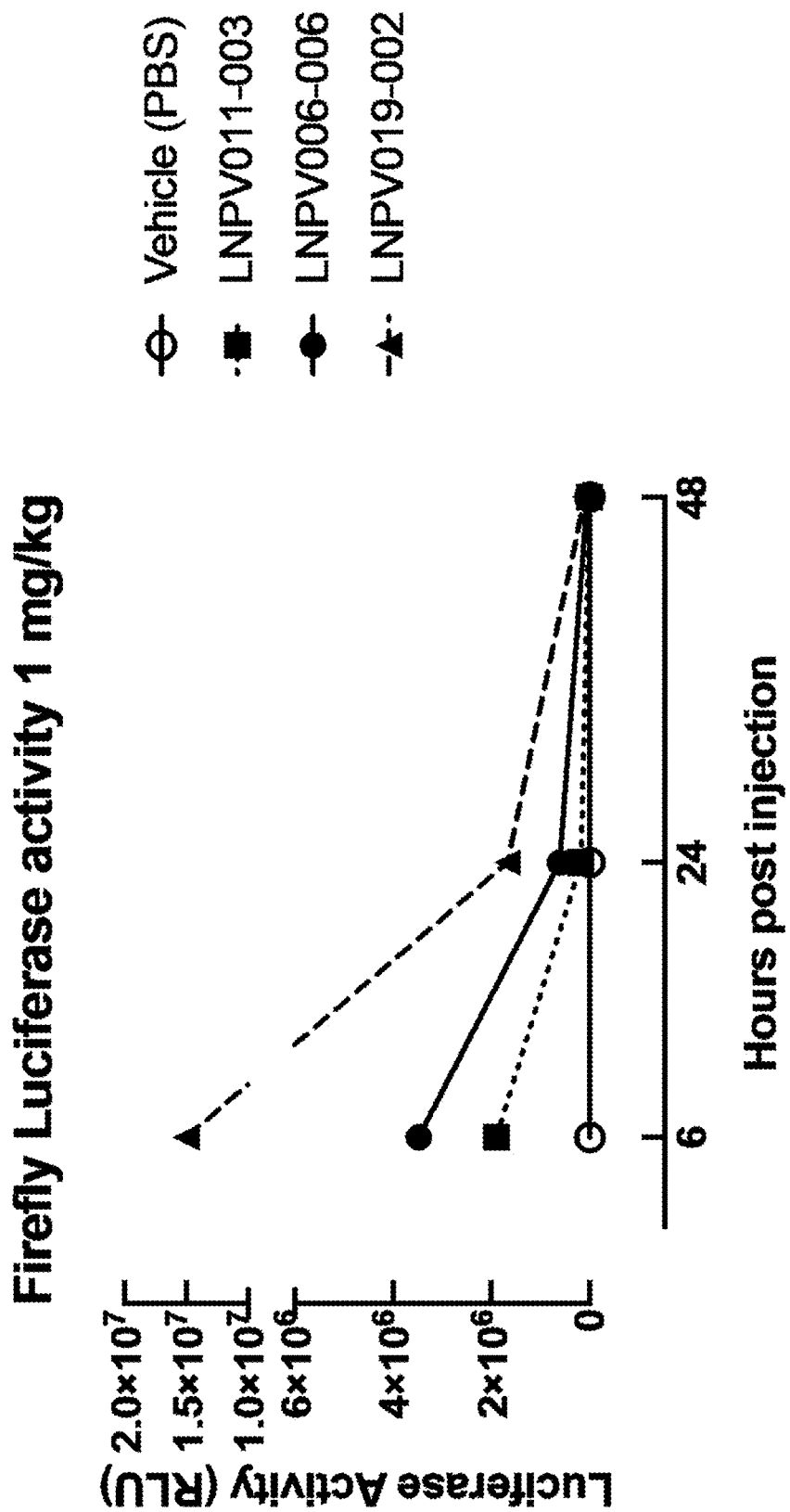
FIG. 14 discloses LNP-mediated delivery of RNA cargo to the murine liver. Firefly luciferase mRNA-containing LNPs were formulated and delivered to mice by iv, and liver samples were harvested and assayed for luciferase activity at 6, 24, and 48 hours post administration. Reporter activity by the various formulations followed the ranking LIPIDV005>LIPIDV004>LIPIDV003. RNA expression was transient and enzyme levels returned near vehicle background by 48 hours. Post-administration.

To measure the effectiveness of LNP-mediated delivery of firefly luciferase containing particles to the liver, LNPs were formulated and characterized as described in Example 11 and tested in vitro prior (Example 12) to administration to mice. C57BL/6 male mice (Charles River Labs) at approximately 8 weeks of age were dosed with LNPs via intravenous (i.v.) route at 1 mg/kg. Vehicle control animals were dosed i.v. with 300 µL phosphate buffered saline. Mice were injected via intraperitoneal route with dexamethasone at 5 mg/kg 30 minutes prior to injection of LNPs. Tissues were collected at necropsy at or 6, 24, 48 hours after LNP administration with a group size of 5 mice per time point. Liver and other tissue samples were collected, snap-frozen in liquid nitrogen, and stored at −80° C. until analysis. Frozen liver samples were pulverized on dry ice and transferred to homogenization tubes containing lysing matrix D beads (MP Biomedical). Ice-cold 1× luciferase cell culture lysis reagent (CCLR) (Promega) was added to each tube and the samples were homogenized in a Fast Prep-24 5G Homogenizer (MP Biomedical) at 6 m/s for 40 seconds. The samples were transferred to a clean microcentrifuge tube and clarified by centrifugation. Prior to luciferase activity assay, the protein concentration of liver homogenates was determined for each sample using the Pierce™ BCA Protein Assay Kit (ThermoFisher Scientific) according to the manufacturer's instructions. Luciferase activity was measured with 200 µg (total protein) of liver homogenate using the luciferase assay reagent (Promega) according to manufacturer's instructions using an i3X SpectraMax plate reader (Molecular Devices). Liver samples revealed successful delivery of mRNA by all lipid formulations, with reporter activity following the ranking LIPIDV005>LIPIDV004>LIPIDV003 (FIG. 14). As shown in FIG. 14, Firefly luciferase mRNA-containing LNPs were formulated and delivered to mice by iv, and liver samples were harvested and assayed for luciferase activity at 6, 24, and 48 hours post administration. Reporter activity by the various formulations followed the ranking LIPIDV005>LIPIDV004>LIPIDV003. RNA expression was transient and enzyme levels returned near vehicle background by 48 hours. Post-administration. This assay validated the use of these ionizable lipids and their respective formulations for RNA systems for delivery to the liver. Without wishing to be limited by example, the lipids and formulations described in this example are support the efficacy for the in vivo delivery of other RNA molecules beyond a reporter mRNA. All-RNA Gene Writing systems can be delivered by the formulations described herein. For example, all-RNA systems employing a Gene Writer polypeptide mRNA, Template RNA, and an optional second-nick gRNA are described for editing the genome in vitro by nucleofection, by using modified nucleotides, by lipofection), and editing cells, e.g., primary T cells. As described in this application, these all-RNA systems have many unique advantages in cellular immunogenicity and toxicity, which is of importance when dealing with more sensitive primary cells, especially immune cells, e.g., T cells, as opposed to immortalized cell culture cell lines. Further, it is contemplated that these all RNA systems could be targeted to alternate tissues and cell types using novel lipid delivery systems as referenced herein, e.g., for delivery to the liver, the lungs, muscle, immune cells, and others, given the function of Gene Writing systems has been validated in multiple cell types in vitro here, and the function of other RNA systems delivered with targeted LNPs is known in the art. The in vivo delivery of Gene Writing systems has potential for great impact in many therapeutic areas, e.g., correcting pathogenic mutations), instilling protective variants, and enhancing cells endogenous to the body, e.g., T cells. Given an appropriate formulation, all-RNA Gene Writing is conceived to enable the manufacture of cell-based therapies in situ in the patient.

LENGTHY TABLES

The patent contains a lengthy table section. A copy of the table is available in electronic form from the USPTO web site (https://seqdata.uspto.gov/?pageRequest=docDetail&DocID=US12037602B2). An electronic copy of the table will also be available from the USPTO upon request and payment of the fee set forth in 37 CFR 1.19(b)(3).

SEQUENCE LISTING (3377 sequences)

SEQ ID NO: 1-1015 - skipped (1015 entries)

SEQ ID NO: 1016 - protein, 1390 aa, synthetic construct
  source 1..1390: note = Description of Artificial Sequence: Synthetic polypeptide
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1017-1022 - skipped (6 entries)

SEQ ID NO: 1023 - protein, 16 aa, synthetic construct
  source 1..16: note = Description of Artificial Sequence: Synthetic peptide
SGSETPGTSESATPES

SEQ ID NO: 1024 - protein, 4 aa, synthetic construct
  source 1..4: note = Description of Artificial Sequence: Synthetic peptide
GGGS

SEQ ID NO: 1025-1139 - skipped (115 entries)

SEQ ID NO: 1140 - DNA, 175 bp, Taeniopygia guttata
  source 1..175: mol_type = unassigned DNA
gtctagttacaactgggcatcgctgcagagatcgcacctcctcgtggtcccgctggtagcccttcgaagggtgactaagtcgatctctgccccaggtacggagccgttgggactcaccagtccaacgtaactcctgcctaaattcggtgaaacaaattcctcggtaaaaagcccc

SEQ ID NO: 1141 - DNA, 91 bp, Geospiza fortis
  source 1..91: mol_type = unassigned DNA
agacttaagtgagtttggttacaactgggcatagctgcagagaccgcgcctcctcgcggccccgctggtaagcccttaacagggtgactaa

SEQ ID NO: 1142 - DNA, 160 bp, Zonotrichia albicollis
  source 1..160: mol_type = unassigned DNA
cgacttgagaaggtctggttacaactgggcatagctgcagagatcgcgcctcctcgtggccccgctggtaagcccttaacagggtgactaagtcgatctctgccccagtccaggagccgctgggtttcaccagcccagcgattccttccaaattcggtga

SEQ ID NO: 1143 - DNA, 152 bp, Danio rerio
  source 1..152: mol_type = unassigned DNA
aatcccccctacccaatccccccgtcgtgacctccaggccaggaatcacgagcgtacgacagtggccatccggcaatgacaatagcgtgactaacgacaatgagtcagatccatgacccttggagtgggttaacctccgcctctttaaaaac

SEQ ID NO: 1144 - DNA, 500 bp, Gasterosteus aculeatus
  source 1..500: mol_type = unassigned DNA
catattggggtctcaggaggagacacagggtctgttgcggctccggtaaacggtaccggagtcggttaagcatcgtttgggcccgcctccacgtggtggtccgcggtaacaccaatagggtggctaagaggcccagtaatttccccgaattgtcttcccccccgcgcgggggggacccccctttagtgtcggagcggtcgcgcctccgcgtttggggtgtcgcaggcgtgagccttcgtccccttaagttcagacggtcccggcttcttgccgggccaacccccggtgcagcgttctcccatgttggatcggcacccagccccgggtgccatgcgagttcagacattttgtttatgtatcgtctgcgtggttgacttgctaagctcatttcctcctctcactgcgtccccccaggtgctgatcggttgaagaggattcgtcgttgacctcggcggtgaatttgggattgtattatacaggtaggtatagagggcgtgcgg

SEQ ID NO: 1145 - DNA, 595 bp, Bombyx mori
  source 1..595: mol_type = unassigned DNA
gggcgatacgcataattttaatttcccgattgaaatccagtcgtcttaatctggtgaccagtggcgcggtcaccagtatagtgcacaggacgtgaatggctccgaggctggcggagtcactcactataagtgtgagagacgatgtcctgtgccaagtatacgtccaaccctaacgggttaagtgaaattagttgctcataacagggacggtgtacctgtttgctcgtggctggctatcgaatggacgggaccaatacacccccctgttagtaatggggtaagagagagcggtctgaaactatggccgaaatcacgacgccccactcctacccataacctgcacgtggtaccgccgcacattgaccgatacgggaggaggggcagcacttgaatcacgtagtcttggtgtagccattgcgggactacagccctcgtaagtgccgccttagaacgcaacggggcaataggtgggccggggcgctagcgggggggagtaatctcccctgttggcgtgcaccgcactgctcccactgggggcagtgtcatccggaaacaggtgggccggggcgccaccaggggggagcaatccctcctg

SEQ ID NO: 1146 - DNA, 337 bp, Hydra vulgaris
  source 1..337: mol_type = unassigned DNA
ttcaagtggatgaagctgggaaggtaatctgtagttggttgagttggttgcagattactgctgtcgattttgctttctattgaaagcctgtctctacgggtcctgaagcttgaattttggtagctatagttttgtgggaggaaagtggaattttgtaccatcttttgtctctcgtatctactatagtaaatccggtcatgcagcctctacgcggcgcaactagaaacttggatcagtgatcaaggctaatgcatgccgggtctcctcagattaggagtataatacaaatctgacttcatcactaagaggctatggggctaacgatcctatagtctcg

SEQ ID NO: 1147 - DNA, 265 bp, Hydra vulgaris
  source 1..265: mol_type = unassigned DNA
cttggggtcactgacacatttttcggtagccatagttttttgagaggaagagtggaagtttttccatgagtcgtctctcgtataaactgtggtaaatccggccatccagcctctacgcggcgcaactagaaacttggatcagtgatcaaggctaatggatgacgggactccatggataaggagatataaagatcttatttgaacgcatcttaaggggttatggggctaacacccccttaattctggtgcacatttattgaccgtt

SEQ ID NO: 1148 - DNA, 569 bp, Adineta vaga
  source 1..569: mol_type = unassigned DNA
gaaatagtttgcaatggtaggtgtatggcgcctctgtgtctctctttcgctggatatagtttgacgattttgtaccaggtatctgtttcttgtgagttcagcaccagtttgaacaggcttagcgatagaccttcgaacttgaaacactgttgtgaagctggctgggcccctgcagattttctcgattagaacgtgagtgttacgtccagaatgacccaccagtggttagttctacgttgccctggaaaggagaaaagttgagctaaaatcgcacggcctagttgtttatcaaataggcacggtgaggaactcttctatgtaccctgactaaagtactcacttgtgcgctgggtttgctccccctcgcattgacttatctgatcgcactacccaccaaacgaaacataaacttagctcgtggtatcagtccacagcgtgtgcagtcggattcaggggagcgtgttagtgacaagcaggataatattaacatagttaatgttaaggcgttcaacattccttatccaattggaagagttgactgtgaagtttgtcatgaagacattggacaa

SEQ ID NO: 1149 - DNA, 265 bp, Oryzias latipes
  source 1..265: mol_type = unassigned DNA
cgcacaggggacacagagcctgcccaagtaccgctcccgagggagcgggaaacgggggggtgactatcccctggggtccggcgagagcgctggtctacggaccaggggtggctgtgggcaggctgctcctcaggccagttgattagttacgcatgggctgtacctccacgtggtcccgctggtaacgacttgtcggctaaatcagcccgcccaccatctgggatatggttgaccgtctaaccccagtactcaggtcacaaacaaa

SEQ ID NO: 1150 - DNA, 840 bp, Limulus polyphemus
  source 1..840: mol_type = unassigned DNA
tgggaggagacccaaactatcctaggatggggcggaaccgaccatatgagccatattaacattgcccacactatcctctggaggtacctcctcgtggtacggctggatataggtaaatcctgtaaccaaatcctccaacccgtgaaggagaacactaaaacccatatagtggcctcgccaaccactatatgtccaacggcaggagaagctatctcccggatgggaaggaaaaccctaaaccgtgatgggaacttaccggccccatcagctattgggtacccggtagggacttgcaaccctaccctgtatttgcattttatagggaaccggtcggccctatatcagagtagaccgtttattaaatatgggtgaaaatattaacagtaaaagctatggtttggcgtccgtgtggtgccagggcggcggccaaacccgagctacttggcaccaactggggatggtagcttccgagcgattccctggcgacgtgggaccgatcgacgatggagtccaaacatccggaatagaggaattgagaaatacctattccaccaccggctcacatacccaaggtgaacccggtgcaactagagtacaacctatctgtggcggtaggtgccgaaccactcaggtgacgggcttgtttattgatgtctccctacgagacacgaattgtgacaaatccactccggtggacaattacccgatctatgaacctgttaccgatattagacaagaaaataaagaactgacaacgcctagagcttcaggcagcatgtctgtaagtatccagtcatcgagcgtgactgagggcgaaattgataataactctgaaactga

SEQ ID NO: 1151 - DNA, 394 bp, Caenorhabditis elegans
  source 1..394: mol_type = unassigned DNA
gctcactttctatcgtgttaaccgtacgtttacactcccagtgagtgtaataaaggttattcgatagagggtgtctccctctttcttgggtaattcttcggcggtccggggtctctccctcgtcttttttttaaacttttctttctcatccactcttttgctcctttttactaactcttgtactctatagtcttttctcatcccccatccgccgttgggcaaagtttatttactttgttaaatccatattttatctctctcacccgtacagaaagcgtctccttctcaaacgcttttctgtactttttcttatattttcattaacatatttttcctgtttatactaacctaacctccattgtcaattactaactaacttgtacaacggatttcg

SEQ ID NO: 1152 - DNA, 69 bp, Cryptococcus neoformans
  source 1..69: mol_type = unassigned DNA
ccctcttaataccccataacacataacaaccccctaatcaacgttctctgcaccttaaacaccaccaac

SEQ ID NO: 1153 - DNA, 102 bp, Chondrus crispus
  source 1..102: mol_type = unassigned DNA
acgccccctatccatttctgccagcctcccatcggctcgccgtctccgcaacccctcttcctcggctgtaccagttccgctcccacaacctccctcgccaca

SEQ ID NO: 1154 - DNA, 74 bp, Chondrus crispus
  source 1..74: mol_type = unassigned DNA
  misc_difference 2: note = a, c, t, g, unknown or other
cnccagccamcgatcccgccgccactcgcmgcccggccgtctcgaccgccacctccccgasgccccagcccatc

SEQ ID NO: 1155 - DNA, 714 bp, Acanthamoeba castellanii
  source 1..714: mol_type = unassigned DNA
taaccctaaccctctccctcggcccctctaccctaaagcgccctaatcgaccggcgacgccctaatcgctaccctctacgccctaatcgactttggcgccaaagcgactttccccggccgattttcttcctgcctttttcttttctctccaagcgacgcgccttttactttgccgccgttctgttttttcttttctctttgcacttcgcttctacttcacacctcctcctcctccttctcgacccgcgcggcctcgagcgacttgctgcagcggctcccggcctcccccacgcggcctgctactcccgctttctagacgcccccggtcttgctctcagtctcccgcatcgaagcggtagtcggggtacgtgctcaagtgactcaagcctcttttcagcctcggcgctctctcaatccgcctcagtcttagcctttcaagttgctcgattacgctctcgaatcgctctctctctcagtctcagtctcagtctcaatctcgatcttgccttcgccttcgtctcgacgccttgctctcgwaatcgctgccactacgtgccagctttttcgtgccttgtcttcgtgtcgacccggaccgtttgcaagccctcgccttcgtaccccgctctcgtagccgttctcatcgctgaagcgttctacgcgctggcagcaagcctcggccctagcttgtagcgccgccggtggccgctcgccaac

SEQ ID NO: 1156 - DNA, 200 bp, Fragilariopsis cylindrus
  source 1..200: mol_type = unassigned DNA
atcaatctaatactgaaggcaataccaaactcaacccgaaatcaaaatcgttagaatcaatatacgacccccgctgctgtacatgtccagccggatctcgttgtaaagaagattgcagctgtaaaaaagttggacttctttgttcttcctgtgaagaagttgattgtggctgttcaaattcttttcataataaagaatta

SEQ ID NO: 1157 - DNA, 832 bp, Hydra vulgaris
  source 1..832: mol_type = unassigned DNA
tttctaatgttacgtgatatgatatggttagttcatggttagtttatgtttatgcttagtttatggaaaatcgtttatttatggcacaatattgtttgctgtttttaaatttatgtaacgtgtgcatttgatgtatattcttgaactttttaatctgaatttttacttggtttaatacgtttattatattcttcgattgagcaatttatcctatcaaagcaatttatccttcgattcgagcaatttatccttcgattcgagcaatttatccttcgattgagcaatttatcctatcaaaattagcatatatactgcaattttcaaataatctacgaaataagttcacttactgaaaatcattaagtaaaagaagaaaggaagaaaaaataaaaataaaaagtagtaaatcctttcataacaataatcattctattattaaatttaaaggaatattttggttttgtactaaatcatgcgttcatatttcaccgaagaagggggctgctatatttttgtttgaagttgtttatcttaaaactttaaacttgtgttcaaccaaccgtaaacattagttcgctgttcgctcaaattatctacaatataaaatttatcaatcttttttcgttacggtaaacaataaacaataaaataactatagttattttattgtttaccgcatattgtttaactatagttaaacaaagtatttgtttatggaacattaccagtatctcttgttaaggtaaacaacaaaacatagacggcatctctttttaaggtaattaagtatacggctaataataaaaatatacagctaataataaaatcttca

SEQ ID NO: 1158 - DNA, 258 bp, Lactuca sativa
  source 1..258: mol_type = unassigned DNA
acattaaattagagaggttgatgtttcaatggaagaagatgaaattccaagaagctatttttgttgcccaccaagtgtttgataaaatgtccaaactaatttttctcttgttgcagctttattgttcaagataatgtagtttgcttagtttgagcgttccttgtgcacaccaacagtgtgttggtgtgccatttcctttccttcctttttaactattgcttcatagcttaagcttcatctcgaggcttgttctcttgt

SEQ ID NO: 1159 - DNA, 122 bp, Monosiga brevicollis
  source 1..122: mol_type = unassigned DNA
catcttggcgtgaaccacgttgtcagacaaaatctgcaaccccgctctttgcggcccgcgttttggcggcgccctcgctcccaccgtgtccgctcgcttgctcgcttgcttgccccgcggac

SEQ ID NO: 1160 - DNA, 453 bp, Hydra vulgaris
  source 1..453: mol_type = unassigned DNA
aatttaaaaaaaaaaaatcgtttatttatggcataatactgtttgtaatttttgaaaattcgtgcaacaactgcagttaaattgaagagctgaaatttaagatctgagcttttcaatcagagttttttaccctaaaacattaaattttatcataacaaaaatcgttctaatattattaaacttaaagaaattcgttcttatatcaaatcttatttcagtgtttcacagacgaagggttttactagatttttattttttcaacttttgaatttgtttattataaaactgtaaactagtgtgcaaccaaccgtaaaaawtagttagctgttcacccaaaatattattcagtatgaaaatatttaatcttctttattcgcagtaaacaataaaatatctagttaaacaaaatatttcttaataataaaaaacaaaaactttttcttaacaagtaca

SEQ ID NO: 1161 - DNA, 1461 bp, Magnaporthe oryzae
  source 1..1461: mol_type = unassigned DNA
cccgaacccgaacccaaacccaaacccaaacccaaacccaaacccaaacccaaacccaaacccggagggttcccaagtcgcctaaacccgaagggtttaggatattatttcgtttattagaattggataattatttacccctgttggacaggggggttgcaggggttaaattaaggttttttattatttatgcgccgtttatttgtttacccccccaaatattataaaagcgcgttccatcctcttaggaaaagcgaagcttttccttgtaaaagtcgctagacttttactataaaagtcgctagacttttataccaatcttttaacaaaaagcgtagctttttgttgccaatctattaaaaaaagcggagctttttttaactttttcttttttttttttttttcttttttttttttttttttcttttttttttttttttttttttatatatattattattattattattagcggtggggctatttatgcgctttaatttgtgcggggctatttatgcgctttaatttgtgcggggctattaatgcgctttaactttacaaattttatttatgcgctttaattgctgcgggcctgttaatgcgctttaatttacaaatttcattaatgcgctttaacttttatatttactaatgcgttatttatataattgctattattatcgttgctattattattattgctattattatcgttattattattgcaattttattatataaaccctcgtttgtccctcgatttatcccgtttcttttccatcccatcgcgcgttttcgtaagctttggttttcgtaggatttgctttcgtaggctttgctttcgtaggctttcgtcagcttttacctgcttttattttttctttttctttttattccccccccttttttttacctggtttattagcggtttacctgcttttattacctggttcccctttacctgttttattagcggtttacctgcttttattacctggttcccctttacctactttataagcggtttacctgcttttattacctggttcccctttacctgttttattagcggtttacctgcttttattacctggttcccctttacctgttttattagcggtttaccagcttttattacctggttcccctttacctactttattagcggtttacccgtttctattagtgggcatttatttcccgtttttattagcagttaaatttacccttttaaggttatttacctgcttttattcacagggcacccctgtttttactagcagttaaatttacctttttaaggttatttacctgcttttattcacagggcacccctgtttttaccagcagttaaatttacctttttaaggttatttacctgcttttattaacaaccctttattttttcctattaacgggtatttatttacctgttttattggaattcacccgttggacggc

SEQ ID NO: 1162 - DNA, 278 bp, Branchiostoma floridae
  source 1..278: mol_type = unassigned DNA
ttttcagtctggctcagccagtgaccgccgggaaagtccggctgactaccacgaatagggtggtgacagctggatagacagacgacagctcggaaagacggcattggggcagtatgggttggcacccctaactgcatctcccctaggagagcatcccgcaacacgctacaaagaaccacaaagagcaatacccccagggatgcccgagagggggggaggatgagcatcccattcggacggtccaatcggtattgaccccagcaaacggagaatcgaca

SEQ ID NO: 1163 - DNA, 251 bp, Danio rerio
  source 1..251: mol_type = unassigned DNA
ttcaagcctggcgcagccagtgactcctaggaatagactaggtggcaaccaagaatagtttggtcgactactggagagacagttgacggcacggaaagacggcacttgggacagtatgggttagcaccccagcctgtgtctttcgtgagagagaacccaaacaagctacggaaagccccacagagatatacccccaggagatcccgagagggggggaggatgagatctccaatcggacggatcaaaggtta

SEQ ID NO: 1164 - DNA, 214 bp, Branchiostoma floridae
  source 1..214: mol_type = unassigned DNA
ctgaccagcagacgggaagcccgcgaccaactagtctccgcaaatattgcacacagggcgaccctatggagctgattcagtcaaatttcctctgagatataccgataactatctacagaaactgcacagttagtttggaaagagcttttctactgaaagacagcaaaatccgccactttagacgagcgtcaagactgccctccccataaccaat

SEQ ID NO: 1165 - DNA, 12 bp, Danio rerio
  source 1..12: mol_type = unassigned DNA
aaagcagtagag

SEQ ID NO: 1166 - DNA, 217 bp, Takifugu rubripes
  source 1..217: mol_type = unassigned DNA
agactaggtgacaaccaagaacagttwggtcgactactggaaagacagttggcagctcggaaagacggcacccgggacagtatgggttagcaccccagcctgtatctttcgcgagaaggaacccaaacaagctacggaaagccctacagagaaacacccccaggagatcccgagagggggggaggatgagatctccaatcggacggacctaacgtta

SEQ ID NO: 1167 - DNA, 247 bp, Tetraodon nigroviridis
  source 1..247: mol_type = unassigned DNA
agattggtctggctaagccagtgacgtccaggaacagactggctgacgaccacgaatagagtggtgacagcttggatagacagctgacagcagggaaagacggcaaccggggcaggaagggctagcaacccagcctgcatcttccgtgaggaagaacccaaaacttgctacgaagagcccgaagcaaagatacccccaggggagcccgagagggggggagaatgagctccccaaacggacggataac

SEQ ID NO: 1168 - DNA, 227 bp, Schmidtea mediterranea
  source 1..227: mol_type = unassigned DNA
aaacgacatcatgaacgcttggccgcaacaatccagttatccctgcggtaacattgtggaactcataagacaagtactaaaagaagaattagaaaaattagaagaaaaaattgaaaataatttatttataaaatttaaaaatttaaataaatttaaaaatttaaatttaaatttaaatgaagataaaaatttatttaatccaataaataatcaagaaaatcaagaaa

SEQ ID NO: 1169 - DNA, 74 bp, Caenorhabditis sp.
  source 1..74: mol_type = unassigned DNA
aaggacgctggtttaaggccgaattcgttcgttctttttctggcggtcttgctttgagcttggtttccgatcct

SEQ ID NO: 1170 - DNA, 815 bp, Caenorhabditis sp.
  source 1..815: mol_type = unassigned DNA
gcgccccgggttacattgtcggggccacctttctcttggagtagagtacagtctactaattttttgataagctagtcgggtccgaaccactagagtttgcttgaaaatgcgtcaaaccagcattttagaactcgcccaaaagttcggccccgacccccaaacaaatgggaccttcttgacgattttccctgaaaatcggaggatggaatggtcccctattcttgtaaatagkactgtgcaataccccttcgtcatctgtggggaacagatgacacgtgacgtcatccgtgtagacgtcacgttttcccgtgcctgcgggagcccccaatcgagcaatttttgctcttttgagtgtctggaacgcttgaaaccccagacaaatcaggcccagtcgtcggaaaatttctttttgaaattttttggcgcctgcgaaaaaaattttttaaccgccacaaacccccgggaggcgcggwtagggatatcgatgtcatcgactcgtcggtgatctttgattttctctctgcgtctcctattttggaacagtctcgaccaaaaaaccgggcctggcaacccaccgaatccggatgtcggagggatttggcaagaaatgttggaaataacgaaatttcgttattttcagcacaattgtcaaaccggcaagaaaactggatggacaagacacacaatttaccggaaattgtgcttgttacgtcgaatttcccaattttgaaaaaattcctcgttccactggtcgggacgcgaggtcagacgatctgcacgtctgaaacccaaaatcttcggattttatgcagtag

SEQ ID NO: 1171 - DNA, 14 bp, Caenorhabditis sp.
  source 1..14: mol_type = unassigned DNA
cgcgaaccagtcat

SEQ ID NO: 1172 - DNA, 19 bp, unidentified
  source 1..19: mol_type = unassigned DNA; note = Description of Unknown:Trichomonas vaginalis sequence
gggtgagtagtctagtggt

SEQ ID NO: 1173 - DNA, 389 bp, Caenorhabditis sp.
  source 1..389: mol_type = unassigned DNA
gactcgccttggggaaggtwtttcaggggksaattgccgmaggcaaggcagcccccsmmtagcttacaaagtaagtacmcattttcatttcttgtgaattctttaaacatatttttcttgttttttgatttcttttttctctaccttcccccaattcttcccctcatcttgtgtatacatccccctcctccaaccaatcaatacattgacctctctcttctgtcaaaaaatcaatactagtatattgtcccttgtatagtattatttgacgtcgtctttgtattaggagtaggtaacaawctgtgtatggcttcaaaaagcatgcacaaacwcctgtcaaaaagtawttcccatcmtgtgaatagctcaacgacwkgaagmccaatgat

SEQ ID NO: 1174 - DNA, 839 bp, Caenorhabditis sp.
  source 1..839: mol_type = unassigned DNA
ccaactctcatcgtattaacctacggtattcactcctagtgagtgtaataaaggttaattacgttttctcttgcmagagaaaaagaaaattcgaatcctttttgtgtaactcacaaactgacagagacctatcgaatttcctttgtttcgtatataggaatagtcactctggaccacgaagtggacagttgtcggcggacttccagagtggagagaaaaggtgtgaagagaggaggtctagaaacacttcggctgtctaggaccagttcctgagtggaaagaggaaggtctagaaacacttcggctgtctaggaccagttcgtgagatctctcgtggagagttgaaaacagtcagctgaggctactgtatttcttgatagccccgcccccaatccccctcccccccccctcgacagatttttctgtttgacctcctggaatttgcgaggagtgcgcgagaattttcgaattcttcgcgcgttttctcgaaattttccagaagattcgagcggagaatcttcgagaaagtgagctgaatttcgcgcgaattttccgcgattttcaaattatcgatttttgtcggaaaatttattttctggcaaaatttgattgagttcacgcgggagagaaggaattgttggaaaagggtattgatttttgtggcggaggaaactcccactgaatcaataactctcaaaggagaactcatcgaacaacctcgggtgacctgaatcttgggcgaaattttcgcattgacacaagataamacaaattactgtkgaaaataaatcagaacaaactgtcaaaaagagagacaaaaagtattgattaacaacatc

SEQ ID NO: 1175 - DNA, 320 bp, Caenorhabditis sp.
  source 1..320: mol_type = unassigned DNA
cccttttctatcgtattaactacgataaccgctcatttgagtgtaaaaaaggttcccccctcctcgcctgccttacccacgcatctctgcctctgggaaggcggagggtcaacttgcgggtctgtggatttcctttcctatccaccgcccatattctctgtcgaaagcctacctagatcagccgggagtttttcctatcccattcaggcgatcgctcaaggctgttttatcgacactccttcttgacaagtatttatttcttgacaaattctatttttccttttatcgattttctcttatttatcgattcttgtgaaaat

SEQ ID NO: 1176 - DNA, 992 bp, Schmidtea mediterranea
  source 1..992: mol_type = unassigned DNA
ttaaatcatttttaaatgtgtttgaatatcttaaattatcaaatcatattaatatcaatgctaaaaaaaaatcgtgckcatcaggcgcacgaaaataatggacacaactcgtcgacctgctgtcgactcacagagaacctcaatttggaagaatgggaagcctataatgctacaattccgccaacccctatttgaatgacagatagtcaaatatcaaaaaatatacaaactgctgtcaagcgtgactcacttccttccaatcgaaaaataggaakatgtaagaaacatgaaagtcaagctgaaaaaccaataatatgtcctaaaataaaacaatttgaaaatatgcaaaaaatacctataaaatcacagccgaataaattcccatccgttctaagcagaaaccgctacgaactactgcaagaatcggatcaagtatattaatttccccccmgggggaaattaatatacttgttakaaaattaattttttaataaaaataaataaatcgaataaatataaaataaaaataaatcaaattaaacttttattaacaataaaatcgcagtaagtaaatttccactgttattaaatttaaaacaaaattcctttaaaaatgcctctctttttcagtaataacaccttttcttgcttttattactatttcttgtgtactgtacaaatcgagcacagttattgcaaataggacatagaaattcctttttaagtaaatttaaatccatgagaaataaaataaaatccttttgattcaaagtttctatgttgctttctaatagaatggtgtaagcattaatgggtcttgatttttataaattaaatatatttaatctattaaattaatatgtttttattaattattaatttttatagtggggggaaattaatatacttgatcccaagaatcaactgatgatgaagaatatgttatttcaaaatacatacaagaagctggaaaaaacaaatcaatcgctaca

SEQ ID NO: 1177 - DNA, 1123 bp, Girardia tigrina
  source 1..1123: mol_type = unassigned DNA
gtaggtaactatgactgcaaaataataattctacacctattgttgataactcatctcgtgcgcaaacggagcatgttatttctaatcatttcgtcacacaggattcttctaattctgatagtaatattatagatagagataggaaccttgttgatttagatgcgtcaataacttctcctactattatacagccagaggatagtaagatatctgaggatgaggacttcatcttagtcaataggaaaaagagcaaaaataagaaaaaatctaagaaaacaactgaaaataaaaatgaaattcctattcaaaagagtaaagataagaaaaagaagtctaaaattaataccgaaaaactaactgaaaatattactacttctgaaataccacttgaaattgctccttccatacctttaccttcagcaagtacctcgggttctcaacaaccggccaatcctccagaagacgctactctaagtgatacggatctcttccttacacaggatgatcccgatagtcttattctttctggaagtactcaaccaacctttgttgacctcaacccttcacagcaatcggaacttccttcaaatactgacagccaaagatttgaggcgggtgaaacacccaaaatcataacttcttacagggatgaccttttctactctacagtccttcactacaactcagatacaggttacggtataagtgttgacaatggggagcagaggtttcgaattcttgctaggaatcttgtcaggaaaaccaaggataagttcccctctttatatgctggacaagtaattagacacacagtcttcttcaatcacttcaaccaggcatactacgccaataatataactgatagtaaaggtaatctaattgagttttctgatgataagccttttcaaagtataccgactgacccaaaaactgaactagagcaaattaggagagagagacaacatctagttgatagagctcttagacataatcagttacgggaaacttatattttaaataaacttaataataataatggggggggtggcgaacatttgaaaaggaaaaagatcaaagtcaatacggatgatgtctccagcaatgatggagacagaaaacatag

SEQ ID NO: 1178 - DNA, 43 bp, Chrysemys picta
  source 1..43: mol_type = unassigned DNA
gtttaattccttctgatggacatctgcaacacccgtcctgaag

SEQ ID NO: 1179 - DNA, 107 bp, Acanthamoeba castellanii
  source 1..107: mol_type = unassigned DNA
cccgtcaagggtgctccacgagatccctgtcgctagccgaccggttttaccaccccaccccgcccggacaaccacggaccctgctccgcagcaggaccccacgcacg

SEQ ID NO: 1180 - DNA, 188 bp, Acromyrmex echinatior
  source 1..188: mol_type = unassigned DNA
ggtgcacaacggatgcatcatacgtgtaccggagcatacgggctgtcacggcggctgcatgcgcgatctagctcggagattttatttatttatttattaatttatttatttattcatcgagtgtgagtgttcgcgttttgccgagaagcgattttcgttaagtgatacgcgccgcgttcataggttag

SEQ ID NO: 1181 - DNA, 1264 bp, Alligator mississippiensis
  source 1..1264: mol_type = unassigned DNA
tgctggaaagacggagaaccgcttcctttttccctgcgcctggcctggtattgcagtacctccaggattagcgccaactagtccggcagactgtcggaatacagcaatagaaagwgagctgactagcagcttgctttccttcctccggtgcagcatgggttctcgtcagtcmtgacgggctagggaaggcggtgctgccagtacgtccgaaagagtgccggttgcgcaagcgaccgcgccactcaggtgagtagccaagggtcttacagttcaccggacccgawaacgcgaaaaccccaactcgggctagtagccgaagacctgggtcccccccmggtcagagtaggcgaacgccwgkgctcagaggacggaacgcggaaaacacccccaggtcccaaggacgccctgatccactgacaagaacgctcgaggcacgccaggagacccccagctagggtggaccgccgactgcaggtccggaggaccctcccaggagggtggaccagcgaacccaagttggcgacgaaccctgacgcaccccccacgatgtcaggaccccgacaggcggcggtggaccactgaccatcgaccgacccccagaggcagagagactctcagagcccggaaccccggctgacgagagccgcctcccggcggaggaccccggagcctgaggatgccccccggatgacggcggagcgccccgagcgacagcggacccctccggacccccacggcccctcggtgacgatggcgggccccgaacgacgacgacccccggaccccggcggtcccgaggacgccccccccgagggtctccccacgctggtggaggagccccggacccccccgacaccggacccccccacggacgacccaggcgaaggcgtagacatgacagcactcacgttcctccccttccccctcccggcgaagctgttctgcccgacctgccacccgccaagacagtacaggtcgcacggcgacatgaacaagcacctacggcgcttccaccagctgcgcctagccttctactgcgccctctgcggcaccgagtacgaggccctgaagctcctgaagaaccaccagaagggatgcgagggccacggagccgagaggagacccggcacgctggtgaggtccgctgccccggcccgccggacccaggccgcggtgcgaaggcccgccagactggccaccccgccgacaaccccaccggaccagacctccagggaccacccgacggagagacctgccccagtga

SEQ ID NO: 1182 - DNA, 200 bp, Chelonia mydas
  source 1..200: mol_type = unassigned DNA
ctcttcttatgaatacttgcaacacctgcactgaagatggattctccggctgctatttttgaaaaactgatgctgctttgaaggtgtattctgctgctgctaccttggaaggaaattctctctctgctcctgagacatccccagctgcaccgtgtaccaccaccaccactgctgctgctccacagaaggtttctcggaca

SEQ ID NO: 1183 - DNA, 460 bp, Chrysemys picta
  source 1..460: mol_type = unassigned DNA
ttttttctgatgcttgactgcaaacacccatccagaagatggaatctcctgcagccatttttgaaaaaattgatgctgctttaaagatatactccattctcctwktttgkaagaaaactctttttcagcttcagctattctgtcatcggctgctgctgttcctgcttcccagaaagctcagcmaaaacctatcctgaagaccwcccttggtgcctcacggaagacccggascacctgcaagaaccaaaacattaggagctggctgaagaaaccccccgtggatacctcwgcagggagacctggstccagmaggacakctcttcgggacctcmcatcsaggagcaagaatatctcaacagctcttcaggagggggacccccggagaaccctgcccgcttcccagaaccaggatgctgatcgccgccccaccgggaaggatgccaccgcaggagccccccca

SEQ ID NO: 1184 - DNA, 380 bp, Drosophila sp.
  source 1..380: mol_type = unassigned DNA
aaagtgtagttcttttctgttttagtgtagtgggaagtctgtttctttttattatgttttttacgaaaaagtcctggtctttgaaattcattgtctaaattttaaataaaattataaaatttaaaaagaaaattaattaaagaagcgatgaaatatctctgaaattcaatcaatcaattaatcatggcgtctcagcgagtgcacgtatttgcctaccccttcgtgggaccattccggtgctccgtatgcatggatgcgtccgggatgcatcccactaggtcgctgggcgaatacggcacatacgctgcggcatatcagcacataacccggcgccacccacaagtggttattacataccgttgccgggtctgtggcgctga

SEQ ID NO: 1185 - DNA, 557 bp, Gavialis gangeticus
  source 1..557: mol_type = unassigned DNA
  misc_difference 325: note = a, c, t, g, unknown or other
  misc_difference 444: note = a, c, t, g, unknown or other
cgctggaaagacggagaaccgcttctttttcctgcgcccggcctggtattgcacttcctccaggaccagcgccaacctagtccggcagactgccggaataatagcctcagaaagagagctggctagcagccctcttttctttcctccggtgcagcgtgggttcttgtcagtcctgatgggctagggaaggcggtgccgccagtacgtccgaaagagcgccggttgcgcgagcgaccgcgccgctcaggcgagtagcccaagggtcttacggttcgccggacccgataacgcgaaagccccgactcgggccagtagccgaagaccntgggcctccctccccaggtcggagtaggcgaacgcccgtgctcggaggacggaacgtggacaaaacacccccaggtcccaatgacgccctgatccactgacaagaacgctcgaggcacnccaggagacccccagctagggcagaccgccgaccacgggtcgcggaggaccctcccaggagggtggaccagcgaacccgagtcggcgacgaaccccgacgcaccccccccgcg

SEQ ID NO: 1186 - DNA, 10 bp, Lytechinus variegatus
  source 1..10: mol_type = unassigned DNA
atctactatc

SEQ ID NO: 1187 - DNA, 102 bp, unidentified
  source 1..102: mol_type = unassigned DNA; note = Description of Unknown:Nasonia vitripennis sequence
ccattccttcgtacgggttttcgtgccggcatagccgggtgggagactcgcgcgggggaggtcatatctcaccaccatcctcgagctttttgctgcacctga

SEQ ID NO: 1188 - DNA, 1097 bp, Phytophthora capsici
  source 1..1097: mol_type = unassigned DNA
  misc_difference 169: note = a, c, t, g, unknown or other
  misc_difference 956: note = a, c, t, g, unknown or other
gcccgccggtggagtagccatgttggccaccaccgcccaagtctccgccgcagctgcgactgctgctgctcatcgagtcgcagtagtcgcagctgcacaagcaccacctcctgccggacgcgccgccgtggagcaccacgcgcgcgctgagccgtaccaagaccaaggnttccaggctcgcgcgcgcgtggmgctcccagccagcgacgcgttcagcagcagggtcggctgcggcagctcgacgctgcacggggacggcagcgacggcaggcaccaagaccacgacgaccaagccgtcgctgccgtccccatggacgtcgaccaaggtgctcggtggccgacagcggatcamcacccgctgtcgccgccaccggagctccgagtcggcggcaagcgccgccgcctgaacgacggcgacgacgaagacatccgcgagctggccgagcttctgctgcccgacgaggaggaggccgacgaccacaaaccagcgcccaggttacccgcgaccagcgctcatccggcctccgtcctcgctgtgtacgcgcacaacgcgcagcgcttcaactgcacgttgtgcgtgtacacggctgccagcttcgctgctcttacgcgacacagggactctcggcaccggcgcgtgaccttcctggacaggttctcggcgggttgcgcgtgcggcaaaccttttgcctcgaggctggccgcagcaagacacgcacaaacgtgcgccagcctcagcaccacactggtcgcggtttcgacgacaggaggagcatcaagccacactgtcgtcggagccaacaccaccgtcgccacggcggtcaccgccgaaccccccctgctccaccatcaagcctcggaactcactgtgcccccccccacgtgtgagttcccccgacgtcgatgtgcagctgcacagtccgccacaggaagatcagcacgaggacgccacccancacccggagagcacgcaacaccaacctcctgaggcaacccgctggggttcgccgctcgcgcccacgctcgttgcctccaggattgctcagcgactcggcgagctggaacctccacgctggggcccaccattaccccgcgcg

SEQ ID NO: 1189 - DNA, 378 bp, Phytophthora infestans
  source 1..378: mol_type = unassigned DNA
agctcggcctcgcggctgccttcccaggcgccgccgacttcgcgctctggcgcggcccacacgccgccgccgagcctccaagcgcgcccgttggctttcgcagacgcagggctcgcggcgacggccctcgccagcccccaagaccccccctacgatgtggcaccacccggcagggcggccggcaggctgcccgactcggtatcgccgggtgctacactctcagccgccacagctcgggccttggcggtccgccattggcccttggagctcgacagcgacagcagcgacgacgaggacgctcaagacccccacgccgccgccccagaacccccagaagacgtcgcgagtgtgcttgccccacccggcagggcaggcagc

SEQ ID NO: 1190 - DNA, 142 bp, Patiria miniata
  source 1..142: mol_type = unassigned DNA
ctgatgtggataccttggaattactcaaccgtgtcggagtcttttgtcttttgcgcccaacacctcatggataccatgcttgtcgctggagcgacgttacaagcgtgagggcgccctccatgccggacagctggtctgtgcc

SEQ ID NO: 1191 - DNA, 291 bp, Phytophthora sojae
  source 1..291: mol_type = unassigned DNA
agacgagcaacgcgctggggcccaagacctggcacgaacgacactgcccaggctgtgaacgacgagcacgctgctaacccggcagcgcaccggcctctgggctccgctgcaccggttaccggtgcaacacggtggggtccacgtcacggcgcgatcggggcagcggctgtagctcgcctgctcacaggcctacccacggcaccagcaccagctacgcgccggcctgcttcggctcggcgctgcccagacccgcccgctccccccgcggccacgacgacagcccccgatgcg

SEQ ID NO: 1192 - DNA, 698 bp, Pythium ultimum
  source 1..698: mol_type = unassigned DNA
gcggtgtacgcgcacaacgccgcgctcttcgagtgcacgttgtgcgcgcacaccgcgcgggatctcgccgcgctccagcagcatcggcgctccgcgcaccgcagcgtccgctttgtggatcacttccacagcggatgcgcgtgcggcgtgagcttccactcgcgtgcggcggcaaccaagcacgcgcgcgaatgtccagagagcgcgttctcggtcgccgccgccgcgcgcactgcagcggccaacaccgcaggtatgtctctcggcgccgacgaacgcgaccacctcgcgtccgtcggcgccttgcatgatgttgcatcccccgcttttggcaacattttgccggttgcgtttgcgaccgcggcagacgcatcaagcgccaccgtgatcgcagacgcagccatgcagcacagtgctgtgccctctgctgccgcccaatcccctcggcgtgcgcacgtcccccccgtgccgcgcgccaccacgacaccatccgcgctgcggattggtggcaaacgccgccgcctgaacgacgacggcgacaacgaaaacagcgacggccgcgacgccgacatcgagatgcgcgccgacgacaccgacgcaccagcgccgaccaaccccgcgaccagtgcggctgcaacgcccgcgcgcacagcaccagcaccaacggatgccgcgaccgcgcgccgccgccacacgcg

SEQ ID NO: 1193 - DNA, 485 bp, Strigamia maritima
  source 1..485: mol_type = unassigned DNA
ggagtgttcttttcggagacgccgcctactttagaggagagaatccccacgggcatcctcatttgatctgatccatcgagtatctgcgaatagtcggcgcactccttttgccatgatcccgggggtctcatggtaaaaaggtttgtggcacggcttagttgacgcccctcttccacgtcactcggcctgcatcgatcgactgctctctcctcttcctccctccctcctcttcacgctctcttcacgtgaccccttcccatcccgcccctcggcttttggcaaagatctgtgtgtcctccaaagcacccatctaccatttgctcgagttgcgattggtcgaagctgccacgccactcgtctactctgcctctctgaccccttcccccctctctccctctgccgccctcgcctctcgggtcccttcccatctccctcctcccatccacgtgctccctcctctcgtcacgtgatcgttgcggctcgac

SEQ ID NO: 1194 - DNA, 1328 bp, Strongylocentrotus purpuratus
  source 1..1328: mol_type = unassigned DNA
aaggctcaaaccaggctgccaaccaagctgccagcttaggcaccaaccaagctgccagtccaggctccaaccaggctgcccaccaatctgccagcttaggctccaaccaagctgcccacctagctgccagcttaggcaccaaccaagctgccagccgaggatccaaccaggctgcccacctagctgccagcttaggctccaaccaagccgccagcccaggctccaaccaggttgccacccgaaagtctgccagtttaggcaccaaccaagctgccagccgaggctccaaccaggctgccactcgaggctccaaccaggctttcacccgaagcattacccaggctgcccgtttaggcacaaaccaggctgccagccgaggctccaaccaagcaaccagcccaggttccaatcaagctgccagccgaggctccaagtaagctgccagccgaggctccaaccaggctgccactcgaggctccaaccaggctttcacccgaagcattacccaggctgcccgtttaggcacaaaccaagctgccagccgaggctccaaccaagcaaccagcccaggttccaatcaagctgccagccgaggctccaaccaagctgccagccgaggctccaaccaggctgcccaccaagctgccaacttaggctccaaccaagctgccagcccaggctccaaccaggttgccacccgaatctctgccagtttaggcaccaaccaagctgccagcctaggctccaaccaggctgccactcgaggctccaaccaggctttcacccgaagcatcacccaggctgcccttttaggcacaaatcaagctgccagccgaggctccaaccaagcaaccagcccaggttccaatgaagctaccagccgaggctccaaccaagctgtcagccgaggctccaaccaggctgcccaccaagctgccagcttaggtaccaaccaagctgccagcccaggctccaaccaggttgccacccgaaactctgccagtttaggcaccaaccaagctgccagccgaggctccaaccaggctgccactcgaggctccaaccaggctttcaccccaagcatcaaccaggctgcccgtttaggcacaaaccaagctgccagccgaggctccaaccaggcctccaaccaagctaccagccgaagctctgccagattaggcaccaaccaagctgccaccgttagaggcccagagcccaccaatcccataacgtgtgagatatgtgaagcttccttccacacctccgccggtctccgtcgccacacggccaggcttcatcgcaccactgctgaacacactgacgacagc

SEQ ID NO: 1195 - DNA, 232 bp, Trichinella spiralis
  source 1..232: mol_type = unassigned DNA
tttctggtatgaatcccaagcggattcgttacgaaatttgcataagtttttgaaaaaataggcatttggtcgagtgctcgcaccaccatttgtcgcgggtcgtcctgatattgcactacattcaggaacggcctattcccttcggggaattgtgttttaggaattggaatcggtttggttacgatcggtcgagtggttcgtgagatcgagtgacagccgggtggcagcgaca

SEQ ID NO: 1196 - DNA, 927 bp, Chelonia mydas
  source 1..927: mol_type = unassigned DNA
ggcagaaactgcacsttctagaagactcactgcctatcctgaggaagactaccgctttggagatggattctactgccgctgcttcaaaagaaaatcttcatgctgcttcggaggctccaggacagastgagaagatgatcgctccctcgccgattccacagaaaccttcaactgccgctcggaccgctgctgctccacggagcgcccatcggggaacagcctctaagagaccctcagcgcttccaggacatcgcagatgagcagcatcgattggaaaagcagcgcctccctgaagaaaacccgtggagatgctgctgcagggawatcttgcacctcgaggacggcctcccaggacatcgcagccaggacaaacatcatctcgcctgctcttcaggasaaggatgccmsaagaacttmtcccacctcctcmactgcccaggatcctsatgctggtcgtcgtcctgctgtgctggaagmkaccccaactggcgagacctcagaaaccacccagmwggacckcaacatctcactagatgcctgcccagccgaacctctccatgcwactctcccagagcaacsagaaccatccagmgaatccgctgatatgactgaagccmatccaacagagggagaaggaaaggagaatgactgcatctatctccagtatcccctccctacggacacgctcctctkccccttccgctatccgagggttccagtacattggcagtctcagcamacacctcaagagaatccatascaagcggatcaccttccggtgtgccctctscgacctgcctttcgagacgcagatgaaatgtaagtctcatcaagtcacctgcaaaggacatctcgaactggaagagtccaactttaccagtctatgttgccgccaccccatctctgctccgaaagcagaaacaccac

SEQ ID NO: 1197 - DNA, 840 bp, Phytophthora capsici
  source 1..840: mol_type = unassigned DNA
  misc_difference 125: note = a, c, t, g, unknown or other
  misc_difference 574: note = a, c, t, g, unknown or other
  misc_difference 588: note = a, c, t, g, unknown or other
  misc_difference 611: note = a, c, t, g, unknown or other
accgcccaagtctccaccgcagctgcgactgctgctgctcatcgagccgcagtagtcgcagctgtacaagcaccacctcctaccggacgcgccgtcgtggagcaccacgcgcgcgctgagccgcntcaagaccaagaattccaggctcgcgcgcgcgtggcgcttcaagatggcgacgcgaccagcaggagtggccgctctactgacggcggagacgaggccaagaccgaggacagcgacgcggacgcagccaagcgccaagccgctcaagcagcaccgagaccccatacccmggacaccgcgccgtacgacggccacagggactcggtgctggctgtgtacgcacacaacgcacctgcattcacctgcgcgttgtgtgtgtacacagcacgcaacttcgccgagctgaccaagcatcgccatgcagcgcatcgtcacacccgcttcgtggatcacttccacagcgggtgcacgtgtggcatcggcttccagtcgcgcgcggcagctacgcgacacgctcaagcctgtgcagacagcacacacgccaccgtagctgcctcgcgcgacccggcmnccastgcssccsgngccggmagcgasgaggaggaccncgcaccccccggtcctctsstcgcggcagcatctgcagctgcagcagccgcatcaagcgccactccagctgcagatactgccaccacgcagagcgccgtgcccatcgctactcctgggccccagtacgccccccacgtgctggagccacctccagagctccgagtttccggcaaacgccgmcgcctcaacacgccgatcgacctgcagccgctggacgtggacgcgctg

SEQ ID NO: 1198 - DNA, 377 bp, Phytophthora infestans
  source 1..377: mol_type = unassigned DNA
gctcggcctcgcggctgccttcccaggcgccgccgacttcgcgctctggcgcggcccacacgccgccgccgagcctccaagcgcgcccgttggcttccgcagacgcagggctcgcggcgacggccctcgccagcccccaagaccccccctacgatgtggcaccacccggcagggcggccggcaggctgcccgactcggtatcgccgggtgctacactctcagccgccacagctcgggccttggcggtccgccattggcccttggagctcgacagcgacagcagcgacgacgaggacgctcaagacccccacgccgccgccccaggaccccccgcagacgtcgcgagtgtgcttgccccacccggcaaggcaggcagc

SEQ ID NO: 1199 - DNA, 166 bp, Phytophthora ramorum
  source 1..166: mol_type = unassigned DNA
tcaagccccgccgccaagcccagctgcggctgttgccgcccctccagcagcagcagtcgcagctgaacctacagcccctcctgctgatcgcgccgccgtggagccccgcgcgcgcgccgagccgccccaagaacaagcacccccagctagcgcgcgcgtggagccc

SEQ ID NO: 1200 - DNA, 867 bp, Pythium ultimum
  source 1..867: mol_type = unassigned DNA
tgactggtgtttgatcacgatcaatgaggtgattaacatgagccggagcaggccccttacacgctggtgctgtaatggttcaggaatgctcttatgagtaactccacagtataatttttgttagcgggggtgagcgcgtgcgccgcccccacctttctcttttcgtttgtatttggttcctctggagcgacttccgtggcttttgtcgcgcgctatcgcgcccggcatgaggatcgtcgctcctgacgccatgtgcgccagtatatcggagccccgtgctccgcttgggtgtgtgttccgccacgacgccacgcgatttgcgtgcacggcatgcgctggcgacttccgctcagtgcgcgaactcgcggtgcatcgtcgacgtgcgcaccggtctctggccttccaggactggtatgagtcgtcgtgcgcgtgcagagcgctcttcaccgcccgtctcgacgcgttcgttcattcgagccgttgcgaccacaatgcgaaccaatcagcgaacgccgtcccctcgtccgccgcctcgacaacgagagcggacgcggatgcgacggccccccctcccgctatctctcttccgcggacgggcttcccccgcccctgtcctagttgcgccgctctccttctggatgcggcaacttggacgacccacgtgcacgcgtgcgctgccgccagtgcgacggcgttgatccagcgtcatctacacgccgttcctcccgtatcgacagcaaccgatctcaacggcgatgatagccaacctccagacccgcgtgccaacatccaacagcttccagccatccattcgacaacgacaacgacaacgacaacgacgacgacccgctgctcgacgacgtgctc

SEQ ID NO: 1201 - DNA, 56 bp, Phytophthora infestans
  source 1..56: mol_type = unassigned DNA
gtacggccgaatccctggcctctcagcctgtacgcggggctatacttggtctaagt

SEQ ID NO: 1202 - DNA, 568 bp, Phytophthora ramorum
  source 1..568: mol_type = unassigned DNA
tgcgcggcagaccaagacgcgcagccaacaacagaccgtgcagcgtgcgggtggaaagcgccgccgcctgaacgctggtgacgatgaagaccagcgagagctggccgagctcctgctcgtggacgaggacaaggctggcgccgaacaccccgcgctcaggctgcccacggccagcgctcatccggcctccgtcctctccgtgtacgcgcacgctgcaactcgcttcgactgcacgctgtgcacgtacacggctgccagcctcgcttcgctcaagcgccaccgctcgtctcggcaccgacgcacggccttcctcgacaagttcttggcgggctgcgcgtgcggcacgcccttcgcatcgaggttggccgcagccagacacgcgcaagcgtgcgccaacctctgcaccacctcggcgacgacttcgacggcagcaaaggcatcaagccccactgctgccggaggcagacccaccgtccgtgcagtggtcaccgccgcgcccgacctgccccgccagtatccctcggagctcgttgcgtcccccccgcagccgagctccaccaacgttgca

SEQ ID NO: 1203 - DNA, 378 bp, Phytophthora infestans
  source 1..378: mol_type = unassigned DNA
agctcggcctcgcggctgccttcccaggcgccgccgacttcgcgctctggcgcggcccacacgccgccgccgagcctccaagcgcgcccgttggctttcgcagacgcagggctcgcggcgacggccctcgccagcccccaagaccccccctacgatgtggcaccacccggcagggcggccggcaggctgcccgactcggtatcgccgggtgctacactctcagccgctacagctcgggccttggcggtccgctattggcccttggagctcgacggcgacagcagcgacgacgaggacgctcaagacccccacgccgccgccccagaacccccagaagacgtcgcgagtgtgcttgccccacccggcagggcaggcagc

SEQ ID NO: 1204 - DNA, 190 bp, Phytophthora ramorum
  source 1..190: mol_type = unassigned DNA
ccaggaatcacccccgccgcccccaagcgctccgccgccgagcccagctgcggctgctgccgccccactggtgacggcagtcgcagctgcccctgccacctctcctgttggccgcgccgccgtggagccccgcgcgcgcgccgagccgccccaagaacaagcacccccagctagcgcgcgcgtggagccc

SEQ ID NO: 1205 - DNA, 130 bp, Phytophthora infestans
  source 1..130: mol_type = unassigned DNA
ctcaagcctagcagcggctaccgcagctactccagctccggtagctgctactgctacaactgctcgcgctgctgctcgcgtcgccgtggagcaccacgcgcacgctgaaccgaaccaagaacatctaccg

SEQ ID NO: 1206 - DNA, 190 bp, Phytophthora ramorum
  source 1..190: mol_type = unassigned DNA
ccaggcatcacccccgccgcccccaagcgctccgccgccgagcgcagctgcggctgctgccgccccactggtgacggcagtcgcagctgcccctgccacctctcctgttggccgcgccgccgtggagccccgcgcgcgcgccgagccgccccaagaacaagcacccccagctagcgcgcgcgcggagccc

SEQ ID NO: 1207 - DNA, 1193 bp, Ciona intestinalis
  source 1..1193: mol_type = unassigned DNA
atcaacccactactacaccctctacaaagaacccactacagcaagatcttggcgaccaactacacctgcagcctcccgtcgactcttcaccacctgcgcacctccctccgactccaagcggcagacagtggcaccaccagcactccaagggtccacagccagaagagtgcaccccccactgctaggaagagctaggccattgcccgctgtgggccttgtgctggctgtctgccgctgattggcacgttagggagtgtgcgctgagcacgatagggaggctgctgaagccgaagaacccgcgccggggactttaggactttaactaaaatctgtaacactaaaattggaatactggattactattggattactactggacaataacctgatctacaacaaccaattggattacagaaccaaattacaatctcaactacaaacaaaaagtgagtccccggccgggtttctatattacccaattactgtttttacaattttaaaattttatagtattttactaatttttccgccccgctagcacttaaattggcaccccccccccccstccaaaaaaaaatagataaccctccaccacctaaaccccggtcaccccctcagaactaattggaacccggatcttttccctctatcaaatttccggttcagtttggcttaattacctaaaacccgtctttattttatccctttattgccccttaaaccaaattattcaaattgaaatccggccaaattgccttgctgaaccaccatttttgtttttcttataaaagtaaatttttcaacaacccaaaatcataaaattaaaactgttatctgattagtctaaattctgttattgacaaaaacctccataccaaccttaatcttatcattatcttcacccagactgctcaatctagttcttttttcaatcaataaggaggtgttttctttggtctgttgttttatagtttaccgttataatagtctgttgtcctatagttttccgtggtgtatttctggtctactatagttggtgcctctaaaacattattataccgaagagtgctagcgatttctattattaactcacccaccagtactgctgtgcatccacgcagcaccacgcctgccatcacgtacagtgcgcttgctgccttgtgttttgttttgcagacaccactggacgatag

SEQ ID NO: 1208 - DNA, 360 bp, Schistosoma mansoni
  source 1..360: mol_type = unassigned DNA
  misc_difference 137: note = a, c, t, g, unknown or other
atctcacgttttaatttatttttgaactactgcagtctgagtgcttctaacgacccgaaggctcagaaactacccacttcttgaactgctactttttgctgtttatccacaacaacagttgtgattctattctccanatattccttgtgcttttgtcaacattattctataccaactgtaccacctacttcttcatctcacgttttaattctggtcttattttctcatcattagtcacggagagggcctatgaacggtccgtgacgcgaaattctatccgcgatttcgacctctcctgctagtggtccccgaagtacggttcctctggcctgtcagttgtgttaaaactatataataacg

SEQ ID NO: 1209 - DNA, 332 bp, Bombus terrestris
  source 1..332: mol_type = unassigned DNA
tcaatagttactcgggggcaggcgggatattggtcttgccttgcccaagtcacactcctacctcctcgtggtaccgccggtaacacgcgcacgtccacatcagcgaggggcgtactcccccggatgtggcggcgcgtggctaaacggagtgtggcgacgaaggagcgaaagactaacaactataacggtcttccgtaacggctacttggagccgtgaataatggagcctatattaaaccctggaactcgttccttcgttctgttgacgactggaacggcaaaggacatgatttggataacaattggaaacttaatatcgaattcacaattaa

SEQ ID NO: 1210 - DNA, 422 bp, Crocodylus porosus
  source 1..422: mol_type = unassigned DNA
aggcgtctcctttaagggcaacggtctggttacgcggtcgcagcagkcttgckccaggtacctccwcgtggttcccgccgggtgccgmagmcccaggsctgtcggtagctcgatcctggcacagtamggccaggggagtkcttccttgctgcwggtgccccacaagcgtktggcagsmcmcctgcttcwtcgcaamaatmasagkgtsmtcagtagtcggccccgccgctagccaaaactgttcgccacscagttacagatggtgcctgtgctgacckgkkgccccgtgggctcggwggtgcaggggwggccggcccatggctgggccagacstgggccktggagcccgctcccamcccagagttccccctcaamgccgccaggkcagmamcakccggggagkgmcacggccccggccgtga

SEQ ID NO: 1211 - DNA, 149 bp, Drosophila willistoni
  source 1..149: mol_type = unassigned DNA
gaagctgggtcggatgagcgcagaaggggtgttctttggaacactgtaattcataagtcgtaagtctgatcaagtcgactcgaaacctcctcgtggtgtttcctgggtgctgttgagttcctagtctctaggttcttttcagtagctaa

SEQ ID NO: 1212 - DNA, 290 bp, Gavialis gangeticus
  source 1..290: mol_type = unassigned DNA
aggcatctccttkaagggtaatggtctggttacatggtcatagcaggtttgtgtcaggtacctcccagtggttcccgccgggtgscamagccccagggctgtcggtagctcgatcctggtacagtacggccaagggagttcttccttgctgtcgggtgcctcgcaagcacktggcagccccaatcgcttcattgcgaaaaacacaaacgtcctaaggggatgatcagctagtcagttctgccgctagccaaaactgtttgccacccagttacagatagcgtctgtgctga

SEQ ID NO: 1213 - DNA, 247 bp, Ixodes scapularis
  source 1..247: mol_type = unassigned DNA
gttccaaaggaaggcactcctttggttcgtgatgagatgttcatggtgcttgcctagctggagaaatccgactcacacctgcacgtggtccctgccgcctgccagtatgccgaggaaacgggtgcaacttaatccgtggatactggtagcaacgtgagcaacggtacggtccttcgcggaccaccctgggcgttcgggttgccagcccgttcgcccgaaatatcttggccctgaaactaaaagaaaa

SEQ ID NO: 1214 - DNA, 473 bp, Mnemiopsis leidyi
  source 1..473: mol_type = unassigned DNA
tgggggccccttggacttgctccctggggcaggacaccagtgaaaggagatcctcaagacaggacagagagacaggcacaccaacccttcgaacctgaggagacacccagatctggttaccccattcctgtaaccatggttgctctccgtgcgctgttaaggaaacccagcctagtaccctcggggaaaggttgcgtagtacttagcagtgtgcggatcaaacctctaccggtctctctagcgatgaaagtttctccgactggaacttgagggactggctagcccagctagcctgtagagcaatgcgtatacgatgccttggcgacaatggcgaccgctgcttagcagacggaggttagtgaaagggcgacttgctgttcatagtcacgtgagtcgtctagaaactgcaccgatgctgccctctgttccaggagaaggacagtggaggactaaatcgtagcgcgagcggtgtt

SEQ ID NO: 1215 - DNA, 1124 bp, Petromyzon marinus
  source 1..1124: mol_type = unassigned DNA
ctattaatgggatgaagaagggggacacgagtttgtgtgtgcatccagtttccatggtgcatgcaggagtggtggtttaaatggcgagactctacagggcttccatggctacacgggatgcaaggcatcagacattttggcacaggcaatccttttggtctctaccgcaatcatgtcttagacctcagtagcgaccactacaaccacagtggtgactgctgttgagtgaaggacgactgagcgctggataacaactttcttgcgtggcccaacatcgaagcaaccacttcggagctggcacaaggcaagagggcagcccaaggtgtgaatcatctcaacttcactgcaggaagaaatgctgtgcaaggatgagtgtgaacgacaccaacgggattgttgctgaccaggaggtgccaaccaaatttgaatggattgactttgggcctggtttctcctgcgtgtattgcacggaaaaacaagtggctacacgtgtggccgtcgtgtcctggggtttcgcaacacaactccacaagatcgacaactatgaggatgacaatgtacttaaagaacaaagagactgacgccaaaggggatttaaaccgccaaatcgtacattgggtctcactacaatttttttacgtgtatttattttcctaagtgtctgtacttgccattcttcgctgctttttctgcattaattgcatatcgtatgcaaataagcgaattaaccaccaccgtgcaactatatgcagatgttacagctgagccctctatcataccggtgtactaatctggtatggtgttggcatgctatgcttgcgtaacgacctttgctgattggttcagtcggctgatggtgggttcaggcgaaacatttgtatattggtttaatcaaaccgaaacactaaaattttgaacacagttttccattacaccagttgtattgctagaagtgcaaatcgaaggagtcaattttgaccgacgattagctgccgatgtgcggtgaaaaagctgatcacaatagcatacacttgggccgacaaccccgtgtgctataaacgtaagtcgcgaattataaagaaaacaaaccggacggactactcggtgacgaactaacatcgctc

SEQ ID NO: 1216 - DNA, 1090 bp, Schmidtea mediterranea
  source 1..1090: mol_type = unassigned DNA
cagtgctattcgaatgtcaatgtgaagaaattcaactaagctctggttaacggcgggagtaactatgactctcttaaggaattaagaatttacctgccktaktaaaartgaaatcmgttgttcatwgcaagtggtattgtacaccttcccgcggtgctagtcgtttaaaactaagttacaaaccacgaggggcgtcctgacggactgsaaaagcattgagrgtcmtgaagagaggctcttattgtacgaatctcttcaacgatcgaagtctggaccgatatgagaactaatacattagttgacaggtgaaaaatactgttgattacttagttctcagtcatgtggtatattgccagtcaattactacatwaatattagtgtggctctcaaaggaacacgattgrtcggcagtccaatgcgcgactggcgggcttgttgtttgcatttgttaccggctacttgaaaaggttatatatagcagacgcttaaagcgcgactgtaatttacatytcattgcccagtatttgtcttttgtcagatttagcaaaatttcatattttgttaattaccttaactggttaaacgatcccataattgcttgcaattattataaagtaattcaggtaaaaattacatatctggctgatcctgccagtagtcattttacttccgccgcgctataaaacagtttaaaaactgaataggaatcaaaaagaacatggcaagcgactatatgtaactgggcattcaacattccctattacatatggtggtgcctggggtctgttttatataatgggtacccgggaagtggatctgtatcaccagtcatggtgccatatctttkgataaagatacagtttaaaactgcgatgatactaatagagatcctcttagaccttcgtaaagaagtggggattgatgacattagcattggaagaattaaatctccaaggaaatggagtaacttcaatgaagtcccacaaccccgttgaagggctgggttcgagtatcgagagaaaactctaaattctcttcggttmtgtccaacggaggggacattactgtaaaatatcctctaaaaacaact

SEQ ID NO: 1217 - DNA, 743 bp, Strongylocentrotus purpuratus
  source 1..743: mol_type = unassigned DNA
tctcgcgacgcgttcttctgcctgatgaagtcacgtcaggtaatagacttagaaggttgatgagcgttcctctcctggaccgggggtgaggatgtgttctactgaatcatcgttccggttgtgaggtccgctgcaaataggccttggggtggtctacctccgggtcgctactccttttgagctagtcgatccaggtgagagtcggggaagcccacttaggtgggccagctaagcagatcacccccccagcacgacagtgcgctgtaatatagcctgttgagagtgcacccatttatactgttataaaagtataaatggttcttagctaacctatccaatgatttttattgttatgtataatactgaccactttagtctagtgtcatgtaaggatccgagacaatagcctatgtctctagtctagcaataacacaagagggataatccacctccctactccagccaccacctttacctttcttatcttccatatagatgccaaccagacgggtcgatgggcagtgagaaacaagaatggggataatttggaatttgacattctttcctaaagcagacctgaagggttaagagtcacaagcggagtccggactgtctttataaacagacaatattttcttattttaccacctatatggggatatttcccaactcgtaatatagggcccactgtcaagtggctggtataagttaccctgtgggtaacaaataaattcaaacaaaga

SEQ ID NO: 1218 - DNA, 1496 bp, Salmo salar
  source 1..1496: mol_type = unassigned DNA
aatctttaaccccggactcttggggttcttacgactctgtatgaggaacagtcgaagagagggcgctaccaatccaagtatatgtcccaagagggctgggacagggtggaagagtgcacctcgcgatctggggcagggaaggaatggagagaagtcgaagaaggcttgtagagaaggggctctcctagatcctaacctgtatgacgcccgtaaaacggtgaccccagtagcgaataaaggaggcaggtgacaatagagggcagggccgacttcccaggtttacattgttgtacttgtcaacataaagaggtgtctcaatagtttgaatcaacaagggagaggaataccgacctgctcccttggggcgggggtactggtcttagcccggttccccgcaagtttcctttgcctgggatgtgcctgactggctccatcccctttccccattaggcacggctagatgacgcaccgatgggcgggtgtgtaggtcgctaccgaaggggactgggggtgtccggtgaaccaggacttcccaaaatggtctcacatttttaagcggcttgagtatcgcccagtatcctcgcgcggcactgggaacccagtcaaccgctctgtgccccggcgcaggcgggggtttaatgtctccccggcttcaccggcgcttcggcgacgacgcagaggagcacccggaggcccccatgaacttaaaccaacctatcttgaaatatggcctctcgttcgggtgaagggcaggtgggaagagagggctgcctcacgataaacacctagtcaatagccagtcgggaaaaatgtggaatgttaggacagggaggtaagggaggcggctttttcgtaaggctccttcaacccctacctgtagtccacctattgcaggtgttgacaacatgcaagatgacctgcctcgttacgggtcgcgtatcattgctacaggtcgtgtgccgcttctaagaggatagtaaggagaggttatagggaggtcctgttagggcttcctcaacccctctctatgcgattccttacaggagtggatcgagaagtcccggacgtaatacaccctggaggtaagggagtggccttctagtagggctgcttcaacccctctgatgggagtgtaccgggaacctcgacttgtaagcacaggttagtatgggagcagaagggggagccgtaatgggcttctctttcacctgcttacataatacctgtggtgcatgtatctaggtcttggcgggagagtactgagagacaaggttgagaccccaagattgggtctccctagcctctatagctgcgactcttagcggggatatggagtaacatgtaccaagggagtgaataataaaggaattgacggggtacaagtgactgttggcccgaatcctagccacttgatgaccagggatatattacagactgagagcgaatctagagacgtgagaataaagtgagaattggttgagcgaatacagaggaag

SEQ ID NO: 1219 - DNA, 173 bp, Tribolium castaneum
  source 1..173: mol_type = unassigned DNA
agtcatagagccagaacctcctcgtggtcccgctgggcacagggattaatttttctgtggcaaatttgactggcttcagagagcgtttttcgaagtggwctgtgtgactgcgttccccccttagttgctatwtccgctkmgattaacatctcacctcgacgtwtaagatcatt

SEQ ID NO: 1220 - DNA, 305 bp, Tinamus guttatus
  source 1..305: mol_type = unassigned DNA
ctggggaccgtggttacaacccgggcttagctgcagagacagtacctccccgtggttcccgccggaccccgtaacatcgggtgactgaatctgtctctgccccgggagtagttcctccttgccctattgaccagcggtcgccggctgctcaatagtattctaggcgtgaaatatagcgatagtcctagtggttgtcttactgggccatagccccttgcttcaggggtcattcgcgaagtctctcaggagaactgggggtggtgttcttctgggtatagctaaaccccctagactgtgtccgatcc

SEQ ID NO: 1221 - DNA, 131 bp, Trichinella spiralis
  source 1..131: mol_type = unassigned DNA
ctcctgactaacctgatttcgtccgtgcggcggcgttttcttttcgctctccgctcgtcgaaatttgctgtagttgattcgcttttctttgcgttttcttctactttcgcagttttttctgcattgccacg

SEQ ID NO: 1222 - DNA, 481 bp, Tetranychus urticae
  source 1..481: mol_type = unassigned DNA
ctctcttattttaacatattcgatgtactcgtacattgaatatgcttttattttttttcaaagttttttgggtgcatacccctggaaaattctgagatgtataaatctcccatcagctttggctgaaacgttggctaagttttgtaggttgtttgccccctactacttagtcgcaaatggtatttgctaacagttgttaaattgttacatttacaagtcctatccagtgcctcctcgtggcgctacccggtaacacttagagtaatctgagtggctaaactggaagggcggaaaatgcaaacaggcggttggtagatgcttcggcattttgccaaaaatccacggctttttagcccaacaacatcagggtgatggacccgccagcttgtggtcaggatcccatccatgaataaagcatggctctgcttctggtgcatcctcaacgggatcggcttcggctggatgtaagtcttgcggaggc

SEQ ID NO: 1223 - DNA, 157 bp, Drosophila willistoni
  source 1..157: mol_type = unassigned DNA
gaagctgggaagctgggtcggatgagcgcagaaggggtgttcttcggagcactgtaattcataagtcgtaagtctgatcaagtcgactcggaacctcttcgtggtgtttcctgggtgctgttgagttcctagtctctaggttctctccagtagctaa

SEQ ID NO: 1224 - DNA, 153 bp, Petromyzon marinus
  source 1..153: mol_type = unassigned DNA
cggtgcgttcccttgggtaaggaacacgagtcttagtggccttgacctccacgtggtcccgctggtaacatcatctcttgatgatggctaacaaggctaatgcacccattccatctcctatctcgcatggaggccgctatgcgtgattactag

SEQ ID NO: 1225 - DNA, 364 bp, Schmidtea mediterranea
  source 1..364: mol_type = unassigned DNA
agtcatagggtgaactgcaattctgacacgatgaccgagctgtgtcagtttgcagctagtcgctaaagactcgatcagtccgccaagtgaggtggccgggtatctgcagcactagagccactggtatcaagagcagagatacgcgagtggaagttgagtacgactaccttcacggggtcctcctgataaccacagtggactgtgggaactaaatgtgtgctcagcgttccctactttctcgtagggtaaagggtatgataacccagagaatatcccatgggagatatccatggaaaaagcaccacgttagacaatccgatggtctaactcggctccgaggggctaactatcccaaagggcttaa

SEQ ID NO: 1226 - DNA, 661 bp, Tribolium castaneum
  source 1..661: mol_type = unassigned DNA
tggaagaccccgcccatgaggcttggagagtgtgatcctgatcacacttgaaaagttatgctgagtacgtcgtgagagtcggtaactgtcccaggatggtctgggataggctaaacctcagcaggggaaagttgtaggggcctgccacccctacacttttatagatatggcattcgatacctcaaatagagcctcggacttggaggagcatggttcccctcctcctcgtactagacctggaaccaacggtcttgacaaccccattggacctacgggagcggaccatgctcatggacatggattccgaagacgaagcgggggaacacggaccccccgccgataatgctcacttaacgtcaggcgaacccatcgaaatcatcttgatgttaccctttcaaagcaggtcatgcggcatatgtctcaatgccggaaagggtggctcccgggcgtaacggacatctatcgctgatggaasctagctcgctcttgaagaacggcggacggggacttggaatcgtggtgtggttctgatgtaagtcctgaaattatggcgtgatggcccgcccgcccgaccggagggacttagaacccccttccgcgagggtcctgtctgtaggtccwccatctccgtaaaacgagttggaggaaaccgcagacgggg

SEQ ID NO: 1227 - DNA, 26 bp, Megachile rotundata
  source 1..26: mol_type = unassigned DNA
tctagttagcaagcggccccctctaa

SEQ ID NO: 1228 - DNA, 1095 bp, Apis mellifera
  source 1..1095: mol_type = unassigned DNA
tggtaatcaaatgcctcgctattttagtagcggtagcgctccgcccgcgcaggaaccattgacgccgccgtagtgtgggtgattttatatccaaccaatcacgtcaactacgatcatttgtaatcaccgacggtacttggtaggggtaccacatgggcattcttgctcattccacaacgccgcctccatcatggcaacaatttaaaatatatataaattcttaaggtttgaccgtattcatatatatatatatatatttaatattacaaccataaatcttatatcgagccttctatttggtctcaaaagcaatacgttgtcagatcttgtagaacatcaggagtgagcggtgcgctgtggtatccgtgctttgtgccgcggcgacaaaccaatacgctgctgcctgtcgcaaagcaatacgctgctgattctcggatgcgggtgtcgacggtcacgcaaagcgatacgctggtggggtttcaaaacaatacggcgctggtgctaaaaagcattatgccgctaacggctggattgtcgatcgccgctgcgggggctagtggcgcacccagagaggtgcgacgcgcaagcattggttctgtgcgaagcggagttcttgagagtaatggttgctgggggcacaaagcgcaacatatagcctcttatgcctcaagtcgtagttcgtacctccacgtggtcccgctggaatgcctatcgactcctccccggaggatcatagagttcgaaaccggctacggcgaggcaagggcggtgaggtgcacaccgatggggagcagcgaccccacctacccttagctaagagagcaggcgatccgccaactgtcagcacgaaataaactaatcatatgtatacgagggagaatttacaacgggtaccttgtgcccgaaccgcctgtaggtatcacctacaggtgttaaaatgaatctgatagctggcggatcgtcgaccctctttgatggctctgcgccaacgactggaaagaataggaacggaagtctaatggaaggaaagtgtcgggagcactataaattcccaaagaagaaaagaaaagaaaaaaaataaaaaacccaaattaa

SEQ ID NO: 1229 - DNA, 655 bp, unidentified
  source 1..655: mol_type = unassigned DNA; note = Description of Unknown:Nasonia vitripennis sequence
gactagactatgggttcagtcagtcccaaatagccgatcctggcgcgtccggcagtaatgccacgtatgagtcggttacccatctctaaacgcgtagaggtggggagctaaaggccaggcggtttacccgacgtcgaatttctccaggtctgtgtcagtcgacggaataaaggtactacaacatctactatctatcgggatcggaagacgccttacagcgttttccgatttttgctctttgagcatttttcttcaaattgcgataaccgacccgatcacgcggggctttgacaaagcaatgcgtggtcggtaagatggttgcaatcttttccacctcgtttcttttacggaacgaaagcaatgcgtgtggggaacgttaaaaactcccttcatgcatcccaggatttatcctgcttactgcaaagcaatgcgtgtggagcgactttaccacgagtcgctccaccgcaaagcaatgcgtatcgcgcaaaagcaatgcgtgtgggggacttgtcaaagatcccccgccgcaaagcaatgcgtgtcggcaccacgtagagcaaagcgtgtaggcagactttgtcaaaagtagttctgccgcaaagcaatgcgtgtggagatcttcgccggtgaaagcaatacgtgtgggcgaacttag

SEQ ID NO: 1230 - DNA, 286 bp, Ciona intestinalis
  source 1..286: mol_type = unassigned DNA
cgacggtgaaccaccttgtcgcggtgtaagagctttagtgtctcgaacaagaaatagcttgtgtgctgtccttctgggcggtgcacatacttcttaacctcccgaggccatgccggcgggggctttagcccccggcaggttttaccatgccggacgggttcgagaggtagaggccaaactaagagttcaccagcagacttcgcacgcggctggccactggccgaagtttaaacaacagggccgcatcttcccaaactcaatatatggtgttaagtgaaccgtgccg

SEQ ID NO: 1231 - DNA, 189 bp, Nasonia giraulti
  source 1..189: mol_type = unassigned DNA
cgggttcccccgacttcggcttgccgtggtctggggctcactgctttttgtggagtcatggttacatggtgaccctggttcctcgcacccccgctggaaactatctggggaggccatgattgggtaacgataaaggtcctggtcgtgtcctcctgagataggctgaatgggtcactaagtggcacctaa

SEQ ID NO: 1232 - DNA, 165 bp, Lepidurus arcticus
  source 1..165: mol_type = unassigned DNA
ggggtagcaattgatcgattcccgcttcctcgtggcgctaccctgggtaatactatgaggaattgatcacaccgtagcgaacgtcatcagtcacagctgcacgaatccagatagaaatataacagacgagtaattcttttaaaagctcgtcagtaatcttcccag

SEQ ID NO: 1233 - DNA, 183 bp, Lepidurus couesii
  source 1..183: mol_type = unassigned DNA
tttggggtagcaattgatcgattcccgcctcctcgtggcgctaccccgggatagcctcaaagaaatttgacggtaaagcaaagaggaattgatcacccaaggcagtacatcggccttcctgcaggagctctgataaagatattagtgagttattctgttgaagctcgctatttcattcccctg

SEQ ID NO: 1234 - DNA, 192 bp, Lepidurus couesii
  source 1..192: mol_type = unassigned DNA
ttttggggtagcaattgatcgattcccgcctcctcgtggcgctaccctgggataacctcaaagaaatttgacggtaaagctaagaggaattgatcacaccgtgacgaatatcatcagtcacagctgcacgaatccagatagatatataacaggcgagtaattcttttcgaagctcgtcagtaatcttcccag

SEQ ID NO: 1235 - DNA, 184 bp, Nematostella vectensis
  source 1..184: mol_type = unassigned DNA
ggttggggccttctcgtggcggagtcgtgagtaaggggtataggggtaagggacaccacggaccgagaacggttaccgctcaaggcgagtggtggaaggcataaaatcgtaacgccgccctccgacctgctcctgaaactaatgccaaccaactgactgtggggctaacctccccagagtcagg

SEQ ID NO: 1236 - DNA, 340 bp, Schistosoma mansoni
  source 1..340: mol_type = unassigned DNA
atgttttaatttatttttgaactactactgtctgagtgcttcttacaacctgaaggctcagaaactacccactttttgctgtttatccacaacaacagttgtgaatctattctccaaatattccttgtgcttttgtcaacattattctataccaactgtaccacctacttcttcatctcacgttttaattctggtctaattttctcatcattagtcacggagagggcctatgaacggtccgtgacgcgaaattcaatccacgaattcgtcctcttctgctagtggtccccgaaatacggttcctctggcctgtcagttgtgttaaaactatataataacg

SEQ ID NO: 1237 - DNA, 176 bp, Triops cancriformis
  source 1..176: mol_type = unassigned DNA
tttttggtctggcatttgatcgtttccgcctcctcgtggcgccagactgggtaagctgatttatcagtgagctaagagaaacgatcaccgcaggagtccatctacctgcgctgcacgtgatttcattgtgcacttggcgagttatcccttgtggagctcgctcgttagcttttgag

SEQ ID NO: 1238 - DNA, 124 bp, Drosophila ananassae
  source 1..124: mol_type = unassigned DNA
agaatatggatttgattgtgcagagggggtgctataccgtaactcgtaagccatgcaatcagatcaagtcgactcaaaacctcctcgtggtattctctgggtgccagtatttactggtagctga

SEQ ID NO: 1239 - DNA, 285 bp, Drosophila melanogaster
  source 1..285: mol_type = unassigned DNA
ttggggatcatggggtatttgagagcagagggggagtattcttctgtaattcgtaagtcatatcatatgatgtgcggaaggggaattttactctgtaactcacaagtctctcctttactcaagtcgactcaaaacctcctcgtggtggtcccggtaatgctaaactcgtttagcagctaatttgagcggaaaaacttttccgatgggctggttccccagaggaaatttattcatattggaactacaagcacaaataacgagcctcggatacctttacacaatctg

SEQ ID NO: 1240 - DNA, 120 bp, Drosophila persimilis
  source 1..120: mol_type = unassigned DNA
aagatatggatctgaataatagcgtagaaggggagtcattccgtaattcgtaaatcgtaaaaatcagatcaagttgattcaagacctcctcgtggtatcttctggatgctattagactga

SEQ ID NO: 1241 - DNA, 128 bp, Drosophila pseudoobscura
  source 1..128: mol_type = unassigned DNA
caattggaaagatatgggtctgaataatagcgtagaaggggagtcattccgtaattcgtaaatcgtaaaaatcagatcaagttgattcaagacctcctcgtggtatcttctggatgctattagactga

SEQ ID NO: 1242 - DNA, 177 bp, Drosophila sechellia
  source 1..177: mol_type = unassigned DNA
gggatcaggggtaattgcgagcagagggggagtatttttctgtaattcgtaagtcatatcatatggtgtgcggaaggggaattttactctgtaactcacaagtctctcctttactcaagtcgactcaaaacctcctcgtggtggtccccggtaatgctaaacttgtttagcagctaa

SEQ ID NO: 1243 - DNA, 160 bp, Drosophila simulans
  source 1..160: mol_type = unassigned DNA
gggatctggggtaattgcgagcagagggggagtatttttctgtaattcgtaagtcatatcatatggtgtgcggaaggggaattttactctgtaactcacaagtctctcctttactcaagtcgactcaaaacctcctcgtggtggtccccggtaatgctaa

SEQ ID NO: 1244 - DNA, 135 bp, Drosophila sp.
  source 1..135: mol_type = unassigned DNA
gggaacatggggtaaaggtgagtagagggggagtattttttatactctgcaactcataagtcttgcctttactcaagtcgactcaaaacctcctcgtggtgtttcccggtaatgttaaacttgtttagcagctaa

SEQ ID NO: 1245 - DNA, 334 bp, Kalotermes flavicollis
  source 1..334: mol_type = unassigned DNA
gagaggtcactgttgctgatcagctggacacctagctgactgcgtgcatgcgtgcacgccgcgcgccgcctcctcgtggtaccgctggtaacgcagggtcactgagactacctgcggctaaaggcgcgcgcgagggattgtaagtccaccacctccacgtggttccccgcgggcaacggcatagttcatctgccggccaagcgtgccgttccctcgatcctcctctgattagggataggaggggggcggtggctcccgccgacgacctggcaaacaccttggacacgctaagataataggccgtcctccgggccggccgaatcataagcacaca

SEQ ID NO: 1246 - DNA, 1138 bp, Reticulitermes lucifugus
  source 1..1138: mol_type = unassigned DNA
ctcactgctgtcatgccattgttaatgcgttgggtgatggcgggtgatgggagacgagttacagcagagctggcttcacggggggggctgtagttgcccgaaccagtctgcttctgagtgcctccacgtggcctcgctggaaacgtcggagctgcttacggctaacccgtagacaactccggcggccaaactcagaaaacggccttactaccagggtcatccctcgcggcggcgctaagaccttactgtatgtactacggactacagttgagtagcgcgggagagcacttgatgtgagggtagcaacttgttgctacttcgactgtctccctgaagatttccgaaggggtgccgcaagtccatgggggcggtcctgctgtgggagttatcttgcacccgggaagccctcagtggataaatactccaaaatggcttagccacctcacgtggagagaggggaattaggggtttactcctaagggccgatgcctccaatcggatttccccgggcaacggctattatcagccggctaagttcggaccctcatctactgatgggatactctctctccccccgcctgcgtgattagttgggaatgcacgcgggcgggtgattctgacaagcccagcccaaaagttcttaccacgacgtacccgggggtgtcacccgaactaatatattttccgccgatcggttcgctgtggggggatgtcggggcctggtggccgggaaccgtcagccgctctttgagtgtcctgcgtaacccggaggcggtgacgtcgaagggctaggctagcacggtccagacccctgaacgcctggggagacgggcccaccacctgagtaggagtgggtcctttacctcatttgaggtgtctcctcgttcttgtagggggcgaaggacgaggaatgcatccgtccctccaggatgctggtggtttccgtctggtgggctcatgctgaaacgcgcaggtgccgatttgtcgaagaggacatatggggtaacccatagaacctaggcaggagtaatcccttagctgggggggtcagctggtgggtcctgtcaatttatcctcccctccatgccagagccggtccgaggttagagacggactcattttctcctttttatatgtc

SEQ ID NO: 1247 - DNA, 1137 bp, Reticulitermes urbis
  source 1..1137: mol_type = unassigned DNA
cacactgctgtcatgccattgttaattcgttgggtgatggcgggtgatgggagacgagttacagcagagctggcttcacgggggggctgtagtggcccgaaccagtctgcttctgagtgcccccaagtggcctcgctggaaacgtcggagctgcttacggttaacccgtagacaactccggcggccaaactcagaaaacggccttactaccagggccatcccttgcggttgcgctaagaccttactgtatgtactacggactacagttgagtagcgcgggagagcactcgatgtgagggtagcaacttgttgcttcttcgactgtctccctgaagagttccgaagaggtgccgcaagtccatgggggcgacccggctgtgggagttatcctgcacccgggaagccctcagtggataaatactccaaaatggcttagccacctcacgtggagagaggggaattaggggtttactcctaagggccgatgcctccaatcggatttcccagggcaacggctattatcagccggctaagttcggaccctcatctaccgatgggatactctctctccccccgcctgcgtgattaattgggaatgcacgagggcgggtgattctgacaagcccagcccaaaagttcttaccacgacgtacccgggggtgtcacccgaactaatatattttccaccgatcggttcgctgtggggggatgtcggggcctggtggccaggaaccgtcagccgctctttgagtgtcctgcgtaacccggaggcggtgacgtcgaagggctaggctagcacggtccagacccctgaacgcctggggagacgggcccaccacctgtgtaggagtgggtcctttacctcatttgaggtgtctcctcggtctagtagggggcgaaggacgagggatgcatccgtccctccaggatgctggtggtttccgtctggtgggctcatgctgaaacccgcaggtgccgatttgtcgaagaggacatatggggtaacccatagaacctaggcaggagtaatcccttagctgggggggtcagctggtgggtcctgtcaatttatcctcccctccatgccagagccggtccgaggttagagacggactcattttctcctttttatatgtc

SEQ ID NO: 1248 - DNA, 1379 bp, Rhynchosciara americana
  source 1..1379: mol_type = unassigned DNA
cagaacgtggagaaacggaataactacccagatccgttggttaaccggtggcaaagttaatcaaggttgccataggcttaataaccctatggaaatgtttccacacacctccacgtggtgcctgccggaaattgttctagggtgaacaagctaagttgtgagaaacgggctccaccacaatatggagcctgccagggcgcgagactcaggactctccatgtacaaagtggttagttgcaaaaagagtgcgcctagcatgactgataatttttcactgaaataacgttgaactttatctgtgtcatgtgcacaacactatggtgtctgatcaagcaccatcagtggtggacctgctaatgtattagtagaacgtgtccaggcgataatgcacacacggcctccgggcccatcgctttttttgagattccctagaaacttcagtgtgtgcgacaactgtataacccataagggatggacaaaggttatactagggggtaaaaaccctaatcggctaatggcaaatgggatgtagaaatgccaaagattactcgcaccgaataatggtggccgaaaagcgggtaatcgaatgaaatggtaatgctgtagcggaaacatgatcacattctgtgacagtaaaccattagacctagggggaactatgattaacaagataccagcttacatggaagcaatgaaatgtaagtcacagtagtgataagtggtgaagagtcttgtaatcaccgtaactaggccaggttctggggatgccatgaacttagggggagtatggttagcagatctaccagctaacactattactgataatatgtaagccgcagtagcgctaagtggtgtacagatttgcaaccaccgtaactaagttctgtttcgatggactagggggaatcatgattaacaagataccaacttacatggaagttatgaaatgtaagtcacagtagtgataagtggtgaagagtcttgtaatcaccgtaactaggccagatgtagtcaaagcacatgtttagggggaacaaggttaacattggtaaaagaccaatgcaacctccgtaactaaacgtgaaggcacaaaactaaaagtccagtggatgacaggtgaggtcatcactggacccaaatgttttaagctcatcataacaacacggtgaaaaatccagcatttatttgcctgattgagtagcttccacactattccaaagccgaacctatctgggtttttcttgaaaggccgtatagggcatatgtcgagaaataagtccaaggtgaggtagtgtggccctgtacccaggggtaaggtactatacggtcgagtggctcagtaggcctaactagccactgagtcactataatgactagtt

SEQ ID NO: 1249 - DNA, 979 bp, Ciona sp.
  source 1..979: mol_type = unassigned DNA
ccaaaattacttccagcacctccacagcagacgaacgaagaaagaagacttacgaaataagaataagcagtttaaagacgaagcagacgaacaccactccaccaacgacgctctgcagctacaccaccaccatctcgccgcaacaagaagaattttccgctgctctccactctgctccaacaccacctctcctgctctgtggactgctgccttgctgctggaccaacctctacccgaaggaacccttcgaacccagcagcaaggtacgtgtcaccacctctccacagagccaaggccagagtggatagagcagcggcctctacaaccaagttctccactccgacgacaaaacacctgcctcgtggccagagtcctgccgaagaagaatcttcgaccccaacaccgtctcggcagggctccaagcaacgacatcagccacgagtgcccaccggagtggacgcggcgaacccgaggaccgctgtcgccaagaacaataacatcaccgcctgcagcagctaccaaacaaaggttagtctcctacctcacctacaaactcgtctgaatagacgcccccgcgtgggagctaaccttggtagctagctgcagtgccctgcgacagcggcctcgaagagctgcagagcgtcagcctgcttcgacctcgcttgttctcatttcaacctactccgtcctgtggaatcaaaagagccccactaacaattacattcataaaatctagcaagaacgaagagaagcgaccaacttttaatccataacttttagatctttttatttattactgtttttaagccctaagcatattgcctttttttagatcttataattataaaaatagattcaaagttaacaccaccaggccgctacagagcattttatttaatcaatttgttaccgacctcctgctgcttctttttactttctccagactactacccggatacaacccttggaaacgagagga

SEQ ID NO: 1250 - DNA, 418 bp, Bombyx mori
  source 1..418: mol_type = unassigned DNA
gctagctccctaaaatcctaccttacgtccgaggcgaacatctgtccacgtggggagcggaaacgcgtactatcgaaacttacgcggctaacaaggtaaaggtaacccattaatatggagacaagactaaaaagaaaattgagagggccgcttcccgggggcgatcgccggggcacacctggagctggcgctgggtgttccagcataggatccgtcagcggcggagagttgagcaggcgggctctcgccggggatttacaacccgaaaatgctacagccgccaacagaaatcacgatgtagaaagtaggagcaatagcccatgtgaaccttacagcccgagtaccggttcatacaacccctcggtacaatcatcaccatcatcctcgggtcatagaggctcaccaacgtcgactatgg

SEQ ID NO: 1251 - DNA, 17 bp, Anopheles gambiae
  source 1..17: mol_type = unassigned DNA
gaaggctaaccacaata

SEQ ID NO: 1252 - DNA, 539 bp, Bursaphelenchus xylophilus
  source 1..539: mol_type = unassigned DNA
gggatcctgggttcctactacctcgctccacctcctcgcgatggatcctggggaagtctccggactgagctaagagagcgttaaagtagagggtgacggcgtaagtacctccaagttgcggtggagcggaacatctactcttcggagagaggggaagctctatggcggcgttagaaaggttggactacggcaacgccagggagatggggaaggttcatcaggtgatactagttcgctactgtcattcgatgtatccggaaccatactcgccaagttgtgaactatgtgaaagtctggatccaatccaagaccacggggcgcaattaaaaggtgtgaagcagcttgctggtgatcaccacggtggtacctacaccggcgggggaacatctttaatgccgagatgaccgcgcgaataatagggagccggcaaaagccgagcgtaagtggaaaggatacagaaatttgctcaaaagtataccaacccgccacttataaaagaccgagaaaagggtaccactagagctcattataaaacatct

SEQ ID NO: 1253 - DNA, 919 bp, Heterodera glycines
  source 1..919: mol_type = unassigned DNA
tggcgatactcggaacctccggggagcctggtaggagttggcctacaggtcgcgaaagtccctaggtgctgcacgggttgcgctaatccgagggcgctgggttaccttcccatcggccaaaaacgtctgggccttcttagccgcgggtccagtatttctgttgagcctgacagttcttcccggatatggcgaaagattacagggcggtatttcgtgaaacctaaaaawggtcgggccgaatggcacggacagactcacttcggagtgagctcgggggcatccgtgtgttaccccgctgcaccacgccgaagctgtcatagcgagcccgaaggggaatggccatggagactccagcctcaccctgtaactcgaacctaagtccaggcccctttctggtgttggctcgcactggttaggaacacgacagtctcgtgtaatcccacacgcaccgaaagccctagccctcgtaggcgaaggctgcgttgctggtttcagaactgtgagcwagtggggttcggatggccgagtgtaccaacctgcttgctaacaggtagcatagagtaatatgctagtaagcagggcacgagaaagggccgtaaaggctccggctatgaaggaccttgcgaccacgcgtgtgtctcccacgtgcggattcttgaagccagagtcttgcactgcgcgcaggatggagcctgtgcaactcctccctcgctgatcgcaggagtggaggatcaccactctttttaccttgctagcttggggtaccaccttgagctggggccggccttgctagcttggggtacgaccctttgagctggggctggccttactagcttggcgcgccacccttggagctggggtggcgcaagatcacttgtatacggtctaaccaatacatttgaaaagcgatcaaagcgaa

SEQ ID NO: 1254 - DNA, 488 bp, Parhyale hawaiensis
  source 1..488: mol_type = unassigned DNA
ccgaccgccagcgggataactggcaaaccctgtctcgaccaccggcccgtgaatccatcggggcgtatgagtctgacacaggggggtgtttaaggtgaccctgttgcgaggaaatgcgcagcaaaagccggatgagccttagaacatcgaaggccaacgacaacctgccgaaagactggcgactaatccagtcaacctcctgtaggtcaccggctggtcatgctgaatctcagcttaaccaggcgtacgaacttacagttggagggtcgagcacccctgatggctgaaaaggaccatcaaagtcgaaggtagccaacgagaagaccaacggctgattcaggcggaagagtcaactcgttgaatgcgttcgacagcttggggtagatggaactcctaagccctgaaaggcagtccatcttcgcagacgctaaggtgccccgccgcctgagggttatcaggccccgccgcctgagggttaccaggcaacc

SEQ ID NO: 1255 - DNA, 791 bp, Bursaphelenchus xylophilus
  source 1..791: mol_type = unassigned DNA
gaggatcctgggttcctactaccctgctccatctcctcgcgatggatccttggggaagtctccggactgagctaagagagcgttaaagtagagggtggcggcgtagtgacttccaagttgcgatggggcggaacatctactcttctgagagagggaaagccctatggcggcggtagaaaggttgggctacggcaacacttgccatgatcagattcgatcaaaattagcctctggggctggcaaccctacaacggattgtaaactgaactatgctatgcaaaatgaaaataaaaaatgggggctttacaatctaaggtgttggcagatcacgaaaactgcccgtcgatgagggtgagataacatcctacggaacagcccctgctggaccaaaccaaatcatccacaaattggagggttttcttggtagtttcccttggcacgtcttgtttcataagccagaataaaaacgataccatacagacatgaggctgggtacctgccagccgcgacacggaaaaccggtaggtgcaaccggagacagctaggggaaagaaaatagtaaagtgtcgaaaacaaaacaggtagcccctggctagagggaatgggacattgtccgattaggttgccttgacccaatgaaagccaaccgggtttacattatcggtctaccaagggcaatgaccagagaaactgcgactatgccgtaacccttcgcagattgccgatgagaaccatcgatcgtaagtcgaagccaagcggattgaccagtggagggttatcccgacaacagc

SEQ ID NO: 1256 - DNA, 1171 bp, Heterodera glycines
  source 1..1171: mol_type = unassigned DNA
tgtggcgatactcggaacctccggggagcctggtaggagttggcctacaggtcgcgaaagtccctaggtgctgcacgggttgcgctaatccgagccccttccggtgttggctagcactggaggggggggggtccaaagaatacgtgaagcggaccctgtgttttctctgacctcatacgggtatatcccgatgatatctatacagtgttcattttcatttcttaacctgctttttcctcaagagaaatatgaccacattcgtttgccatttcgaaggtgcgacttttgagggagttctcagggacatcaagctgttcatggacggcttgacggctcgtggcggcacgcagccgcgcgggccagttagggctggtgccaatgaggcagcgaagaagtctctgaaacgccaaaagcagcgggagaagagagagaaagcggggacgggttagagataatagcatgattgacggcgaagcaatactttgacttccaggtacggaggacggcggcaaaaagcaaaaaggggacgaaaccgatggcattgccaaaggggccgaaaccattgagctggacgctgatgggccgtctgccgcgcaaaaggaggggggagcccctccgtctgggaagaaggtgcggcgccattcgtccaacaaaccggaatagatcttgatgatctcagcaattgatcatattgatctctttttccagttgttgcgataaattatcgtgcattatttcttcgatttctccaaagcttaactcctttcctaatacctactcatgtatacgttagtaggcatgttttatgcaggtaaagatagacctggtgcccccgggcgacttgggatgtggatgatggttggcggagagttctgatgacgccgtagttccggaggaacagttcctactagtgccagcctgggctagtggagctggtctggcgagtgctttgctcgtcagataaggggtggttggggtggtacctctggaatgatgtgtcggataagcactctgccttataaagctgtcgttctgcccaggtttctcctaaccaggttgaacttgtaatgagcctttgggtatctggtcggggtctgcgcggagatagctcgtgaggagctgttattacattattggttgaacgcttttgggtcgtactgcacagataaat

SEQ ID NO: 1257 - DNA, 1414 bp, Strongyloides ratti
  source 1..1414: mol_type = unassigned DNA
cgtcagaagagcaggtgtttttcaaagcaaagacttattctacgaaggggaaagatgatcaaacatgcagatttggctgcaatgaaatagaatcaaactaccatgtggtgacatcttgcaaataccattcatacacaagaagacacgatatggttgtgtacaatatattaaaaagactaaaagaaaagtataagttagatggtgatttacaatatggtagatcagtatttaatgggaagaaggaaaaaattaggatcagatctggccataagtttttgactgaacaaccgttagtaaacaataaaccggatattgttataacgatgaaagaagggaaaaaaaagataacgtacatactagagatgtcgataccacatatctagaacttgaagatgcaagaaagaataaagtataaaaaatattgtgtgagctccatggtaaaaataacgaatgataatgttgattcgatagctcgtgattttaatctactaaatttaatggaaagaaaagaaaggtgtaagataaagtttggatcatttgtatttggctgttatggagaatatgtcttgactgaatctgctctaagaacacagaaaatcctgattgaattgggattctccaaaaaagagatggatagcttgatcaaagagtgttcttacagttaaatgaatgagacagcaagaattattatgaaacatctagaaggcgaaaagaatcaagatgaaatcagccattaataacttttatttacccaattatttattgcgttaacttgattatatgatatttattgtatatttattgtttaatttagtttcatagtacaaataaaagaatatactacgattctttacttttaagttctacgagaacgttgttttagaatattttaataatatttctactacaattaagtaattagaagaaatcaacgaaagcagctaaacttactcgcaaaattcgttgatcgaggctggaatggcaccaactaatatactaaccaacaatagaaaaaaaaagaagaacttcagtggacttcaaataaaataaaattattggtagaattgtatgataaaactgagaaaatttgactaaaacaaaaagattagagcaaatatgtcatcattttcctaatcatacaattaaagcgatgatgacgaaattgagagaatttgaaagagaaaaaagggaaaattgtgaaattaaaatgagggaaaatgaggaaaaacctgaggaaaaattaaattttgacaactatgaagaagcaaaattgaaaagaggaattaagtgtaaaaaagaagtaaaaccaattgttattgaaaacaaggattaggaatttttgaaaacggaaaaattatttctcaagtttgtcaacacaatcaattaccaaagaaagaagggtaaatcaaccaga

SEQ ID NO: 1258 - DNA, 722 bp, Bursaphelenchus xylophilus
  source 1..722: mol_type = unassigned DNA
gggtcctcggttcttactaccgtgctccacctcctcgcgatggaccctggggtaggcctccgggctgagctaagcagagcattaaagtaaagagtgacggcgcagttgcttccaagttgcggtggggcggaacatctactcttctgagagaggggaagccctatggcggcgttagaaaggttggactgcggcaacactagccatgatcagattcgatcaaaatagcctctggggctggcgaccctataacggattgtaaactgaactatgctaacctgtcagtaaagacagaacgggggctttgcaatctaaggtgttggcagaccactaaaactgccctttgatgagggtgagataacatcctacggaacagcccctgctgatccaaacaaaatcatccacaaatcggagggttttcttggtagtttcccttggcacgtcttgtttcaaaagccagaatataaaacaataccgaagtacagaatggctggaacctaacagccatggcacagaaaaccggtgggtgcacaccggagacagcaggggaaagattgcaaagtgccgtaaataaagatggtagctctctgacctgagggaatgggacactgtccgattaatgccttatcccgaagacggtcaaggttctatcttatcggtctccaaagggctctggccatagaagctgcgaggaagccgtaaccctacgcagattgccgccgtgc

SEQ ID NO: 1259 - DNA, 1793 bp, Bursaphelenchus xylophilus
  source 1..1793: mol_type = unassigned DNA
tgccagcggtgttgattaggtccaagttctttggccaaagatccgccctcggtttagcagtaccgaacgagtataccttcaagtggtggcactgaattagactgaatactctgaactgtagacttttgtgcaactgtgtatggtgtggaagacttgtttgtaccactatcagctttattggggctcgttactgtttcatacaggtagatgtcccctttagagatttccctgcagtttgcgctccaagtcgctagcctcttgcgtgtagtcaaaggaatacattcgccgtcggtgacagggctatacccggcgactacggacttgtttattacgtagtgcagcctcgtttaagacgaatgtgaaaagaaggtgtgattactaagcgttatgagtcgggttatctggaaactccgccccgccgcaatggcttcaagggtcaaactgctaacattttaaaccaatatttggcagcagcagactatgatgtcagagtgccgggggtctatcgatataagactgaaagcgatagacgtggagtgaaaggattccctttgttaagagaatcggtagaattcactttttacttattcaagaacttaacagcaacaagcactcgcgaggattaccgccccagattcggtcggcggtacttcacctgctttcttccactttcggaatctggcatcctggctttcagtgtggtgatggccggcttgagttttcttgagtcgtgcgagtgcctcatctgggacgtccggaccgattgatggagtctgcagtggacgaggacttgatggaccgtaaccatagtatatccctcatgcgtcttctcgactcgagggggtagcttgcactacccacccttctcttctccgattgggatttagacctagccctctggtgtgtctcgacccgcgatatcagattcctgaatcgactgtgagaaatgtctacgcgcaaagatcgacccattgccacccggctatgtggatcgggctcttgactgcttatctccggctttaatcgcttgaggaaaggggggtgtcgcccgaaagggttacgcgatcatccgattcctaccgtaaaaacgtagttgaagtaggattgaacctgagtaccaagtgaaaagagtggctataatgctccatggtataccctagggataaccgtgtcgagcgcactgctcaataccctgatttgttagtgtaggtatgtctagtggctgcctaggcagattcgcctattcactacgtaaaatctgggtgagtaccataagaacctcctgtagggccaggagtcaaactagtccaggttcggtatgcttcggtatactctctcacgggctagtcacctaagagttaagaaccgcctttttctgcactgtgaatagaaaaagaagggcgggagaatatacgggcgaggtaagcacgtcggaacggggtgtgcccaactcgtaccgtacgcccggacaaggaccatctttcgtaccccgttcacccggcacaagtccgattgtctctcccgagaggcgtcggcggaggttggctaacgccgtctctccaaccatcggtttgggtttaagtaacgccccagtggccggtagccaaactgatggaggcagaaatgccggtccgttgctaaatgcgggaacggaccaaaacgccggtgtggtggatacaggtggaagagtcttttggtctacgcaagaaaagaccaggctcaagtacgaatacgaccgtcttcgtgaacgacgccgtcgagacaaagttcgaaatcctacggtcgataaggcc

SEQ ID NO: 1260 - DNA, 450 bp, Ascaris lumbricoides
  source 1..450: mol_type = unassigned DNA
ggggccggtgggtttactcacttctgacccaccaccaacggaacgagggaaagcagagctggggccctcttccgattggcatggaaccgacctccacgtggtggccctgggcaacggaattcaagagaggatttaatcctctctatcatttgcaagatggatgagatcgaggtatccggcaaacaggttccaagtgagcacctttcccatagctgggaatatgggttaggcgtcctctgacatataagaggaatcagactcgttcgcgcccggtcattaacatcgatcagcgggagggccggactgaagtaaatttcctgttggcccgagtgcaggtggagctcggacccgaaaaacgatccctaagaggaccacaacccgaagggatggacgcagtcgccccggcacgtttggtgttggttatcctggagtgttgtgggacgaatagct

SEQ ID NO: 1261 - DNA, 100 bp, Heliconius melpomene
  source 1..100: mol_type = unassigned DNA
ataaataataataataataataataataagccccctaaaatccaaccatacgtccgagtcgaacatctgattctcgtggggggcggacacgtgaaaataa

SEQ ID NO: 1262 - DNA, 129 bp, Takifugu rubripes
  source 1..129: mol_type = unassigned DNA
ttctatgcgccttatgcgactggataggccagtggtttacgccgctgactttggtgcggaaggttgtcggttcgaatccaggcgagcccttaggcaaggctccttacgcatatatgcctacacctcggt

SEQ ID NO: 1263 - DNA, 325 bp, Taeniopygia guttata
  source 1..325: mol_type = unassigned DNA
ttcaggttatttagatgcttagtttttgtacctttcttgttttgtttaggattttgatagtgttagtatttttatatttttgtacgattgcataatgttcttttttatacagttctgttttaataaaatagacgatagctagagacgttagggcagccacaagccagttaggtagcggatagtaggtaggaacagacttttactatttcataacgcgtcaattaccacctgatttggaccaattcacgggatttgtccaaggtggacgggccacctttacttaacccggaaaaggaacatatataatttatgtgtgttcgataaa

SEQ ID NO: 1264 - DNA, 289 bp, Geospiza fortis
  source 1..289: mol_type = unassigned DNA
ggtagataatctttgtatagtggggggggatctcatgtaccgggtttcttttatttgattttcaataaaacagacggtagctaggttcgcaaggcagccacaagccaaagataggtagggtgctcatagtgagtagggacagtgccttttgattcacaacgcgtcaataccatctgacacggatacccttaccggacttgtcatgatctcccagacttgtccaaggtggacgggccacctttacttaacccggaaaaggaacatatattaattatatgtgttcggaaaa

SEQ ID NO: 1265 - DNA, 350 bp, Zonotrichia albicollis
  source 1..350: mol_type = unassigned DNA
gtagtcacattgcactttctgtaacttgcactgggtgtgggatgtgggcctggggtgtgggttatggggtatatatgtgggatattctggtgggaatgtccattcactgtatgcctatctttttaataaaaagacggtagctaggttcgcgaagcagccacaagccaatagccagttaggtagctcatagtgggtaggtgacaggaacctttgactcagaacgcgtccattaacatctagaacggaccaaacttcggacatgcaccgattaaccggatttgtccaaggtggacgggccacctttacttaacccggaaagggaacatatatagttatatgtgttcgtaata

SEQ ID NO: 1266 - DNA, 1449 bp, Danio rerio
  source 1..1449: mol_type = unassigned DNA
aaatcccagcgggatacagcaagaaggtatcggatctaataaggttgagcgaggagagggtggagatcctttggggggggtcgggctaagttcccctctcgggtcctcccacggtgacgctctacccctccctcctcgctcgtagaacccaacggtgaacacggttggcaggatgaagtgacgtgaggggtaagacatgcgtacgtgagcgcgcatttttgctgttctctggactgggtttcgtccccctcacaaccatcacttacactataggggcacagcggctcctacctccctccctatgacccccccttcccataccgatccatggctgttctagtctggaccgagggtcggacggggcatttgaaggtagctggaatcctccgctgctgcgagcctgaggtcgatggttagaggtgaaatacttgggaggagacacagcctccggagagcccctcccgggtggtcatcatggcaaccgggtgaaaccttacggtttcacttacgaaacagcaccataacagcgccgtaatagcgcaccggtgtgactactgtccagtgctgatattctcatctggagaatacaacacgggtaatggcagagtattcaaaacccaaatgtttacgatcgaccaacggagtcgttcccttgcatctaggccggacccgaaactgccgtaattgcccgtccccaaggtagcctcttagaaaaccgaagcccggtcggggcggtggttgcggcggcgctgcgggggcctgctgctcgggcggcgtcggtgtgccgcggtggttgcggtggtgcggcggggatctcggtccttgcggtgccgctgtgccgccgcggtcgcgtcggtggcgctggggtggtggcccgagtggcgtcggcgtgccactgcccatagtcgcccgcgggggcgaccgatctggaggggcgagggggctcgcgggactttaacgagaaacggaacgcaacttctcgcatcgctcccgggactttcccccctcgttcagccgagggatgccaaaaggcatgaaaggtaagtaccataccggtccgcaaaactctcttctgactcggttctctgttggttttctagagtaacaacgaggtggaggagagggacatggcagggactcccattcgtgccagcgggtggggacagatcgaaggaacggttcgagggcgtaacagacgagagggaatccggtcacacattgatgccatgcctaaataggcgaggtttgtatttctactttgtgggttcagtatagtcggagcatatggtcggttgtcccgttgttttcacggcgggcaagcgactatcatgataaagtagaatgggagacgggctccctgacaaacccggaaaggcgcccccccgtggttcgtagcagctgacggatcacgctcgaagaaaaatgagtgagaggggacgccgcaaccac

SEQ ID NO: 1267 - DNA, 1155 bp, Gasterosteus aculeatus
  source 1..1155: mol_type = unassigned DNA
ggaggggagtaggtctctactctgacccgaagggcccccccgtttcagacctgattctaggctacctgtgcctaattgggggggtcccaaagagatgttgtctgttgtagaagggtttgcgccactgactgcacggaagggtgggcctcgacaggtaggggttacatgactccgtgctgctcagcagacccgcgcctctgagaccgggtagggctacttgaacaagcgacgccctggtgtatgtccgtatcctaacctggtttgggaaagccgataccggcaatgcccgccacaggtgtcgcgcaccccacgggatgacgtatgggccccgggggacctcatggatactccactggacttgcacaatcctggtgtactggatgcagcgacgttggtgacataagcaatcgctaagtcggggtaggggaggtggggacctcggcacggctgtaggaacgggtgtatgggctccggcagccgtcgtcactcccatacaacacaggggctgcatcctggtggccggtgctagttggttctggaagcccgcccgggctggttcgcagaagcagggtgcgcccagggtaggtttggtatatctgggtccggtgcgatacctatcgatgggcagcgagggccgcctcgtgacgcgctgtgtggagctggagccggcctgggtatgaacagttcttgcggatgtggcgtagctagatagtacccgtggttgtgggcgtggtgtcgaccaaatgttgtcctgtgtgcacataggccaagggttacgtgggtggcagtcagaagcacccgcacctggaagtgattgccccgggatcccggctctctgtgaagagctaccttgaggaaaggtgttccgctggaactcaagaccctacagtaggggatatcaactggctttgaggtgctgtgattccggaaccagggcgagggcgagtacttagagcatgtccaaaagcccggggaacgttccgggggcctgcttgggtcgttggacccacatccgtaaaacgatggatctcgcgtcggcgctcgggagaacttcccgcatgaacgctgattgcatgtgagaacgcccccacggcggcggggcaggcgctccccctgggtgtaaggctcgggggggtcacggctccgctctaaaag

SEQ ID NO: 1268 - DNA, 245 bp, Bombyx mori
  source 1..245: mol_type = unassigned DNA
gccttgcacagtagtccagcggtaagggtgtagatcaggcccgtctgtttcttccccggagctcgctcccttggcttcccttatatttaacatcagaaacagacattaaacatctactgatccaatttcgccggcgtacggccacgatcgggagggtgggaatctcggggatcttccgatcctaatccatgatgattacgacctgagtcactaaagacgatggcatgatgatccggcgatgaaaa

SEQ ID NO: 1269 - DNA, 507 bp, Hydra vulgaris
  source 1..507: mol_type = unassigned DNA
taaatgccaaaagttgcttgggctaaatgatacgtacgctagaaaaagcgacttgctgcacggatgacggttcatcagagcccgatatgtgcatgtcaaggcggcagggagaatcactagtgtagctgttctttccattacgacttacgcggttaacgtggcacgatagatttacaccaggaaataatacgtgaagggttccaccatatactggagtttagatctatgagggaaacatttgtaataagtcagtctggtaacctggcgccgctgttgagtcaaattaactatgtcaatactcattaagttatcgactttgatatggcatggggtgattccgcgttatatcaaagtcaaacatgatgattgcaatgagaaactaccacgcttggtcacgtttgtgaggagaacatctcattcaagcctcccggatgtcggcacccgctgacatcttctggcttatgaaaattttcattaatttttgtaagtcatgggcggcttgaaagc

SEQ ID NO: 1270 - DNA, 523 bp, Hydra vulgaris
  source 1..523: mol_type = unassigned DNA
atgcccgaggtagttgggataatgatgcacaagctcgtaaggcgacttgctgcacgtatgccgctaaacgcttagctcgatgagtgcatgtcaagacggtcgggagtatgatcagtggagctgactttccagacaactcacgcggattcgcgtgcggtggatacaacacctggtataacatatgaagggttccatctagtacagggataacgatccatgggagcaaactaattagttggaggtaatccaacgccgctgttgagtcagtttttaaccgccagtcaactcttgtaggttatcggtcttcggcagaccttggaccgcctagcgccggccaacagtttgtcgtcgactaacatgatgatttgcgagagaaacccacgctttgtcacttatgtgaggataaaatctcttgtccatatgatcctttgaagggaacagcgctttgagcttgctcggcgttggcacctttagtctgtaatattttcttgatattatggacgaaaaaggtagtatggttgca

SEQ ID NO: 1271 - DNA, 303 bp, Adineta vaga
  source 1..303: mol_type = unassigned DNA
actagtctccttcttctattagtcagtctaattaatttttcttacattctacatctagttccattattaaattggtatgatcagtgctatctctgctacactcaatgcttaatcgtatgttattgacagtctgacacttgattactcttacgacatatgcactgtttgcttcagagaaaccactgttcatatagtgaagttcctcagttttctgttgatatattcttctttcattctcgcttctccttttctactgtgttctttttatcagttttttgtggaaaaattgagaataaataaagt

SEQ ID NO: 1272 - DNA, 108 bp, Oryzias latipes
  source 1..108: mol_type = unassigned DNA
gggggacagctgggagtctcggcatgattacaaatcttgcgctgcactcggatgtcgtccccgtgacggacacattaatccggaaagcgagtggtgactcgcctcaag

SEQ ID NO: 1273 - DNA, 148 bp, Limulus polyphemus
  source 1..148: mol_type = unassigned DNA
attttgtctctttccccaatgatgtctactagcacgctgccgaagctagatagattgaggaatctgcgtaatctgtaatgattacgcctcatgggcatctatcggtagcgtcgaccctgacgttaaattgggtaataagaaatatcga

SEQ ID NO: 1274 - DNA, 1570 bp, Caenorhabditis elegans
  source 1..1570: mol_type = unassigned DNA
cctccagggcacgccgcacgccaaaagtcctggcataactctgcaaataacatcaaacgtcaatcaactccacaaactctccactctcttcaagtcttctcggtgcttccaacaccacaatggtgaaagctccttcaccttttccctccaaaattcttcccatgtggggaagtcctgttcttgtaagctctccggaggctgcaagagcagaagaaattcttctttctgacaaggtcagaaggaagtcctgttcttgaggcgtccatcccgggcgtcataggagagatcagatgcaccttctagcaggagctagaagggctgccctgtcttgagatccccacgggggtcaatagacgggaggggctgctggctttctctttttaagaggaagcaccaatccggagatccttaggggtcaaaggattaaaaggcagcaggtccaattctcctcactgacttcggtcagagaggagtcccgccttggagacctccccggggaggttgctgaagaggcggaagctccttctagcaagagctagagggagttcccagtcctgaaacccttgcggttgatgatggaatggaagagtacttcggtactgctcgttgctctctctgcgttttactgccgagggccggatttgctcgaatcgcgaaaggtctcaatcgaccattcaagatgacggcttatctaaggtccgaaagcagttgggagagtaacgtgttctcctacctttcaagttgaatggtcgttttactgtttgggatagctgacttgatgctagtacgcttcatctgtggatgacgctccccaagcagtcaagtagacttgaaaggtgccctcgccctagttagctcttagaccttatgggtcgccatggttgtggacgggtatgcttgccggagccgagtcgtgtttcttagaaccaacctcgacgaggcgaaagcttgcacaagttagcacaattgtggtagggccgactagaaaatgagtcccttagggggttacgccttggcgaaagtgaggacaattggcattgacgggtgcttcggcactaggcaaaggcgccaccacactgtccaatctctaaaaagttcacattcatcgaagaactaccggaaccaaccacacatgtgttgaaacctacacggtggaagggaaaggaaagcttcgctggaacgaaaagaacggataggttccccttcttgatggctgtgaggcttaggatggacgggaaggccgtgaggcctcaggcgggtaactcggccagacgctagttgatcttcggatcacgacagccctggctaagaggaaccctggatggagtgtgaaggatgggcgggtagggggttaagcctgttgacagaccaccgactgcagtcacaaaatcagtgattatgcgggtggaccaatctgttggcgggtgtttccctctacctgaccccgcaatatggtatgtacgatcctcggatctaaaattcataatggcccaccacaaccataaacctccctagcagctggtggtcccgataattcgggttcttgccactactgcgacccaggctcgcc

SEQ ID NO: 1275 - DNA, 130 bp, Cryptococcus neoformans
  source 1..130: mol_type = unassigned DNA
tgaggaagaggaggttggattattttttcttttctttaataagttgtttatttaagtagtttctttcattcgggcaacccacacgacaacccaataaattaaacaacgaaaaatgcaacctctataaccc

SEQ ID NO: 1276 - DNA, 60 bp, Chondrus crispus
  source 1..60: mol_type = unassigned DNA
taagtccttgacgcctgccccgtgatacagcatcggtacccctagcatttgaataaaaaa

SEQ ID NO: 1277 - DNA, 69 bp, Chondrus crispus
  source 1..69: mol_type = unassigned DNA
taattcaccttcatatctgctagtgtctctgtaagcgcacccctcatgcattgataaaattacccccca

SEQ ID NO: 1278 - DNA, 348 bp, Acanthamoeba castellanii
  source 1..348: mol_type = unassigned DNA
taagccgcgcgacgaggacggccaggacgaccaggacgacggcgacggcgaccacctagcaccgcacgcgccacgacatattgtcgcgcgctgtacaggcggctaggtcgagcccagccgaccgttctgagcctcagtcggcttgagcccccggcttcccaaggcctaccggggcggctctttttcgccctggtttttgccggcctgttttttctctcccccttttccccccttttccatttgtacttagtttttccttcggccgcggcagcttgttgcccggcatagtgttaatatgtttaaaaaacgtgtaaataaataactgtttaaccctaaccctaaccctaa

SEQ ID NO: 1279 - DNA, 261 bp, Fragilariopsis cylindrus
  source 1..261: mol_type = unassigned DNA
tagcaccaccatctattcatatccacacactgaccacctccaccttcacaactccactctcaattcccctgactactaagaaatatttcatggtggttacattggaggtatcccaacaccaagcacaaaatgaacccactaaccctctcatcctatccacggggaccacctttgagcagaacaccattcatattacaacctttagctagattaagataattatttagtacatattttatactattaaaaaaaaaaaaaaaa

SEQ ID NO: 1280 - DNA, 32 bp, Hydra vulgaris
  source 1..32: mol_type = unassigned DNA
taacttgtatttttaaattgttttattagttt

SEQ ID NO: 1281 - DNA, 27 bp, Lactuca sativa
  source 1..27: mol_type = unassigned DNA
tgaactatattttatatattaaaaaaa

SEQ ID NO: 1282 - DNA, 528 bp, Monosiga brevicollis
  source 1..528: mol_type = unassigned DNA
taggtaggcaccgtctcgggggtccctctgtggggatccctgtgtgcacctgtcgctccctaggtggttcctcgttgtgtcttttgatggcttgacttgtatttttgttttaattttgctttaatttttgctgtatttgtgtggtatttttgctgaatttttgtaaggtcctttgtatgatgtctttgtcttctgtggtcggttgttttcctcaatccgacgttgtgtctcgttggatgtgagcgtgccgtggtgttctttgtgtttgtgctgtgatggcttgtagttgtgatgtgtgactgcctttttgggtgtcttgtgtttgaaatggccgtatctctggttatacttggtcgttttgtacgatttttgtttctatgtgcgtgattcttcgcgcttgtacttcttggcatgatagaagccaatgaatgtgtcttgttctcttgtgttgttttgcgtgccgtcgtgattttgatgtcggggttgcacagctttgctttcagctctgaggttcaaacacctaattta

SEQ ID NO: 1283 - DNA, 38 bp, Hydra vulgaris
  source 1..38: mol_type = unassigned DNA
tgagctcttataaatttatattatagcattttgtttta

SEQ ID NO: 1284 - DNA, 363 bp, Magnaporthe oryzae
  source 1..363: mol_type = unassigned DNA
taataggtaacgtccctatttttgtctttggttttgtttttatctttgtttttgtttttgttttcgtttttgtttttgttttcgtttttgtttttttttttgtttttgtttttgtttttgcctttgtttttgtttttatctttatttttgtttttgtttttactttgttttatttgttttatatttaccttttgattttttctatttttcccacccttattattataaccccaacctactaatattttttcttttttcttttttctttttacggttttattttcccgtttgttttttctattttatttgtacgacaaaacccttagcaaataagcttagaatataataaagcgcgaattaaaa

SEQ ID NO: 1285 - DNA, 85 bp, Branchiostoma floridae
  source 1..85: mol_type = unassigned DNA
tgattaaagacccgaaacacccaatgaccccgggttcatcactgatgatgtgtccctgttcgcactaccagagtgtattctagag

SEQ ID NO: 1286 - DNA, 127 bp, Danio rerio
  source 1..127: mol_type = unassigned DNA
tgatcaaccccggctgggtcacctgggtgagagtgtatgatgttgagagacccgaaacactcaatgatcccaggatacatcactgatgatgtgtcccaaatgcatccatgagatgtttcttgcataa

SEQ ID NO: 1287 - DNA, 270 bp, Branchiostoma floridae
  source 1..270: mol_type = unassigned DNA
tagaaacccacaaggctgagaaatgtagagcatctgtatggacaatattgatgattgaaatgttgtgattttagatcaaatttagaaatatgaaaaccgaactaaactaaatataatgttttttttaaagtaatgataagcaatacccacattgtgcaatactatctatgttatgtcctttgtcccccctgcatgtttggtcaataatgaccatcgtgtcctgggctccgtgtacctttctttactatgaataaagaatgattttactac

SEQ ID NO: 1288 - DNA, 154 bp, Danio rerio
  source 1..154: mol_type = unassigned DNA
tagcatgccacttggacacaggccggggtctgatcagcctcggtcgggtcgcctggaggagggtgtctgttgcaagacccgaaacaccctgtgagcccaggaaacaacactgatgatgtgtccaaggttgtgcatcaggagatgtttctgtaac

SEQ ID NO: 1289 - DNA, 123 bp, Takifugu rubripes
  source 1..123: mol_type = unassigned DNA
tgatcaccccggctgggtcgcctgggcgagggtgtatgatgtcgtgagacccgaaacaccctatgaacccaggatacatcctgacgatgtgtcccagtgcatccaggagatgtakctttaagt

SEQ ID NO: 1290 - DNA, 128 bp, Tetraodon nigroviridis
  source 1..128: mol_type = unassigned DNA
tgatcactcccagtcgggtcgcctgggtgagggggtctgatgttgaaagacccgaaacccccgatgaccccaggtactatcactgacgatgtgtccaagacatgcatcaataggtgtatttagaaatc

SEQ ID NO: 1291 - DNA, 508 bp, Schmidtea mediterranea
  source 1..508: mol_type = unassigned DNA
taaaatggcaaaaagatatttcaagatgaattgtggactcatctaaaaaatgaccaccttgagtccaaatatgcctagctatcatggttgctgatggaaacagtaaggcacctgatagctaacttttcactgtgaatatcttcagatattcacagtgacacgaaaggacaccactagtaaaaaccactagttttttctgacacctcttgctacaaactctgtaaaaatcaaaaggatcgataggccgcgctttcacggtctgtattcgtactgaaaatcaagatcaaggaagcttttccccttttagtcaacaccaggtttctgtcctagttgagcttcccttgggacatctgcgttaccatttgacagatgtaccgccccagtcaaactccccacctgacactgtcctcaaaacagttcaattgcatccgaagatcgcaattttttcactaaaataaattaacaaaagttaattatactgcttcattgagtaagtagaaaaacaatc

SEQ ID NO: 1292 - DNA, 659 bp, Caenorhabditis sp.
  source 1..659: mol_type = unassigned DNA
taaacccacacgagamctacgacgccataagatcaggcatgtacggatgtgaatgagactgatgaacggaatgagcacgtgcccataagatcgggtatkaaagawcagagacgatccctamcatcgggaaaacacgagttatactgcttcactgamctcgctaagctctcataatgaccgaacttgttcgcaactgcctcctaaccgggcgggtgtgagaagggaggtcgccttgaggcggacgcaatgagggatgtgtgcaggttccccctcttgagatccgaaagtctaaaagtactagaccgaaagatcgaggacggacgggatggccgcgaggcacacggcgggtaacacagccagataacctagtagatcttcggatctcgtcggcctggagatatgtggaaccctgggaaaggagaaagttgtttgttgggctggcaagagtgaagtttgaatgtgaaccaccgtcatgcaaccactaaaccagtggcgatgcgggtggagtcatcacaggaaaatgtttctgttgcttgacttatcagtgtttgatatcgccctcaggcacaagtatgaaggcccccacccacataaactccctagcaactggtagtccagcaagcgctggtwcttgctactattgcgccccaggctcgccc

SEQ ID NO: 1293 - DNA, 680 bp, Caenorhabditis sp.
  source 1..680: mol_type = unassigned DNA
taaaagccaaaagccacggagcatcgggaaagaaaaatggaaaaggactgaaaacgagactgaaaaatcccaaacaaaacaaatccaaaacaaactgaaaaaaaaaaaaaaacaaaacaaaaactggacagacactggaaacagtgtcaggcaaagtcgccgattatactgttccacgccttaaaagtcccgaaatggcgcaaaacaacctgaatctatctgaaagtgctccaaaccacgcacaactcggagaaaatcagggacaagttgcttcacgcaacgggctgggacaggtaccccctcctgaaaccgcgaggttgaggatggacgggaaggccgcgaggcttatggcgggtaactcggttggtgtgctagtagatgatttatatccgacagccccaactaagaggaatcctgggaaaggaaaacttgaaaaagtttttacagggctggtaatagttcagcacaattgtagtctactgtcttgcaaccacaacaaaccagtggttctgcgggtagatcaaactataatttgtgtgttttcttttacttgacccgggcaacacattataccacgtccacaaggacgaattcataatggcccctccctaaataaactccctagcaactggtggtccggcgaagccggttcttgccactattgcgccccaggctcgccc

SEQ ID NO: 1294 - DNA, 893 bp, Caenorhabditis sp.
  source 1..893: mol_type = unassigned DNA
tagccgatcgtaaaagaaaccgagccgtaacaacaagcaaagtaaacaaaagaaaaatcaataaaaaggaaggttgacctcagaccccgaggagggaagagagacaccsagaaaaagagagacgcagagaaaaggagagacacctctcataaggagaggtaggtcaatccaaatgtaaacagaaaaaaccagtggggaggaaagaaagactgatttcacccactaaaatgaatttggaaacagaatttggaagagaaaagagaaagggaaacctaaagaaaatagttctcttgccaaaattctgtagaggaatactttgtcaaaacatgatagaaaccagtaatctggtacgaaagacaagtaagacctgaactgacaagaaggaagtcagaaagaaataccgctcacaaagcctgtgatcgattctcttacctactgaacttgttctcttggcctcgtaaccggctaaagggagaaggaatgttaattggagatagacataaagataggtggagtgaaggtcctgttcttgaaactaggaggaatgtggaaagagcagaaggccgcgaggctttagacgggtaactcagtcagttgctagtggtcttcggatccaacggcttcggacatagtgaggaaccctgggtacggagaagaaatggaaaagagatagggcgggcaaaggctaagttcatacactgtcatgcaaccactaaaccagtgggatctgcgggtgaatcactttcgaaaagaagtgaatggacgtgctgatgtctgactttaaagaagtctgaaattaaaaaaacagatataaaggcccctcactataaactccacagcaacaggtggtccggcgaggccggttcttgccaccattgcaccccaggctcgtc

SEQ ID NO: 1295 - DNA, 409 bp, unidentified
  source 1..409: mol_type = unassigned DNA; note = Description of Unknown:Trichomonas vaginalis sequence
taagaagagataagacgagtgagaagaacagaagcatagtaggattggcagagcttaagcgatgtcactcggtacgaaacgtgtaccaaacaccggattccgtgctaggaatcacaagccaaaataaaagagacaccacgaaaattactcaccctccctcaaacagataataatattaacctcccatccatcagtccgtatggtctgataacagactagcaccacatccatgatacactcattggagtgaaaaccaccaacaacaaatccacctagaccaaatcctgccccacctccacccaagtagctcgcttcgctcgctcacctaaaactttgctcgctcgcttcgctcgctcgtcttaaccctttccgaataaacacttacaattcccggctcgccccatttttt

SEQ ID NO: 1296 - DNA, 1468 bp, Caenorhabditis sp.
  source 1..1468: mol_type = unassigned DNA
taaaccggctcctctgggaggaggtatgtcagaggacattctccgtgggcggatgggaggagtagggtaacgacccgtcattctggatgcctaaaccaccacaatctgtcaaggcaaagtgccccaaaagcacacgcgtggatcggtttggatgccgactgagccagagggcaaagtcgaaggccggtaggctcccggcgggttgtccgtcatagtcagtggtgcgcctacacccaactgctatgacacacaaggacaacccaaaataaataagccaaggcggcgttagcttcgagctaacaagctccccgagaggatggttgccacagggcaccatcctggggaacgacccgatctttcggatgcccaaccaccgccaatctgtcaggcaacgtgccccaaaagcacacgtgcggagcggttggatgccgactgagccagagggcaaagtcgtaggccggtaggctcccggcgggttctccgtcgtagtcagtggtgtgcctacacctaactgctatgacaagcgtataggaggcccggaaaaacaagccaaggcggcgttagctgagagctaacaagcttctcgtggatgggtgccagagggcaccatcctggtgggtggatggggggagcttgggaacgtcccgatccttcggatgcccagaccaccgcaatctgtcaaggcaccgtgctccaaaagcacacgcgcgggttggtttggatgccgactgagccagagggcaaagtcgtaggccggtaggctcccggcgggctctccgtcatagtcagtggtgtgccttcacccaactgctatgacatgcgtacaggaggcccggaaaaataagccaaggcggcgttagcatagggctaacaagcttctcgtggatgggtgccagagggcaccatcctggtgggtggatggggggagcttgggaacgtcccgatcgttcggatgcccaaccaccgcaatctgccaggcaacgtgcttcggawggtcattggttctagacttgtaatagaccattggccggaagagcacacgcgcggttggttggatgccgaccgagcctagagggtgcaaacctgaagggcgaggtcgaaggccgtgaggctcccggcgggaaactccgtcatagttagtggtgtgcctacacccgacgactatgacacataggaggaatcctgatctgatatgatcatgtatatagggagggcgaaggtaaatagtcagkgtcaaagtccacgtggcagctactccccagcatagtagtgatgcgagtggawccaactttgacactgatgttccctgagcctgacccatctgcacaaatccaacagtgtatgatggcccacacactgaggacgagtatcacttgtgatactcagaggtgtcccccatgatcaaccaatatcacagctagcggacctaccgtgaggtagacccccgccgctgtagcaggctcgcctc

SEQ ID NO: 1297 - DNA, 635 bp, Caenorhabditis sp.
  source 1..635: mol_type = unassigned DNA
tgaataccgtcagataagcccccaacataaaaataaaagtcggcgttagctaaccactaaaccggctcctcattgggggagagtatcattccggtgctctccgtttgggcggtagggaggagttgggtagcgacccggaagtatggatgcccaaccaccgcaatctgatctggcattgtgtttcggatggtctctgtctctagatctgaaatagagctctggcctgaagaacacacgcgcggaccggttggatgccgactcgatctggagggtgcaaacctgaaagggaaagttgaaggccgtgaggctcctggcgggaaactccgtcatagtcagtggtgtgccaacacccgacgactatgacatagttggaggaatcctgatctgataataatcattgttcatataagggagggggatggtaaatacccagggtccgaaaccatcaaagcagctactgaccagcatagtagtgatgaacacatagaccctggggttccctgaactcgacccatctgcacaaacccactttgtacaaatgaaccaaactgatgaagagtttaatgatttcttacatcacagctagcggacctaccgtgaggtagactcccgccgctgtagcaggctcgccattg

SEQ ID NO: 1298 - DNA, 1425 bp, Caenorhabditis sp.
  source 1..1425: mol_type = unassigned DNA
taacatgccttggaaggcaccacgccaaaagtcctggcaactgatttgaataatgtataaaagtaactggaaccaaatgcccgataggtagggcgggagaaaatgacctagaaaacacaaagtcccaagcccccggattcgaaagacctataggaagtcagtgaatagagagaaatatcaaacaaatctcacccattcacaaggacttactggtcgagtagaaaacaagccaaaacatcaagcacgacgcaaaaaggggtaactttgggcaactaattaacggatacctccgtgtatcaggcaaagccgccaccaacagcaaattactgcccgataggtagggcgtgagaaaatgacctacaacctccaagacccgagcccacggaatcgaaagacctataggaagtcagtgaattgatggaaatacaaaaccaaatttcttccattcacaaggacttactggtcgagtagagcacaagccaaaatatcaagtatgacgcaaaaatgggtaaccttgggcatccaatcaacggatacctctgcgtatcaggcaaagtcgccaccaaactgtactactccgaaaaaaccaagaaacatgattttcccactccgttaaagcatctcaaccaagctaaagcggtaaggttatcatgtcaaaaggtgtagctacagcaacctaaagcccgaaaggtagggccgtataaaaagacctacaccctccaagacctaaacccacgaactcgaacgacctacaggaagtccgtgaatggagagaaatatctcaccaaatctcttccattcacaaaggctaactggtcaagtagagcacaagctaagcctccaagcacgaagtgatatgggtaatttaggcaaccaatcaacggatacctccgtgtatcaggcaaagtcgccacaaacactgtactactccgttactcccaaacacatggatctccttctctcaccaaaaagctttataaccaagctaacggtggaaaggacatcatgtcacgaggagtagctacagtaacctctctcttgagactgcaaagtcgaggatggattgggaaggccgcgaggcaaaaggcgggtaactcggccagacgctagtgatcttcggatccgacagccctggccttagaggaaccctgggataaggagcacgacgggaaggatgttccgcaaggatttcccttcccattagtcagggctggcagttggtaatatagcctttctacacaccaccgtcttgcacccactaaaccagtgggatatgcgggtggactcaatgtagaaaggtgttcccactgcctgactcgccaactttatatgtcttgtcaacataatggcccctcactataaactccctagcaactggtggtccggcgaagccggttcttgccactattgcgccccaggctcgcc

SEQ ID NO: 1299 - DNA, 146 bp, Schmidtea mediterranea
  source 1..146: mol_type = unassigned DNA
tgagtgtgctacgaggcagcgctggtaattgcatcggcgttgcagatttgtgtacgatagataaaaaccaatagtaataaatgctgagcctagctcgcatatctaagccgaaaggcagcatatatatgagacaatttaaaaaaaaa

SEQ ID NO: 1300 - DNA, 178 bp, Girardia tigrina
  source 1..178: mol_type = unassigned DNA
tgatccgtgtgtttgtgtcgtatgattgtttccgtgtgtgtctatatttttcttttttatactttcaattacctcgttgtaatgttataacttcatatggaatatatgtaatttagtttagtttagttagtttagtttagtttagtttagtttagttagtttagttagtttagttagt

SEQ ID NO: 1301 - DNA, 338 bp, Chrysemys picta
  source 1..338: mol_type = unassigned DNA
taaccgagaccgccgaccagggaaataacccacttccttccctgacgaaccaagggacgcaccccacccatgtacttattcgctacaccgatactgacttggactccttatacattccatgggtggcgtacccgagcccacttatccactgacactttaaaaactcttgcaccccaatctgggtctatgccggttatgcgatatgtatgtatctcttcatccttgcaaccgatacctgtaatccctcataacccaagcctgaccccagatgtacagtaccttccctcttaactcgtgtatatttaattttaaacattaactttaataaaatttttaaa

SEQ ID NO: 1302 - DNA, 124 bp, Acanthamoeba castellanii
  source 1..124: mol_type = unassigned DNA
taacaaccatgtatggtgaaccacacctctctcgatcttgtattctgtgattggacatcagagttcctgcgaagggatacactctgccaatctcgtgggttgtaataaatccacaccttcaaca

SEQ ID NO: 1303 - DNA, 668 bp, Acromyrmex echinatior
  source 1..668: mol_type = unassigned DNA
taaattattttgtctttgtcttggccccccctttttaaaccaagcaggagagagtggcccaatgcccaactattatatattaactatttactgtgatatttattatttgactgttgggcgggcccctctctgctggttttatttatatatattttttactcgcgtactttttgtactactctatttttctttttattttagctatgctatttttatctctttctttgtctctattttctttctttttttctttccttttcttttctttcttttattcttcttttatttatctttttttcttttctgttgtggggccctgaccgtccgagtgtgaatgccgcgaaaaacaatattatgttttatacgagtgtgcatgtgcgtgatatatttatctattttattttatttatttattataatttattgccgcgcgcgctcctccgggacttttattcgttgacaatactgtgatatttttctgckcaggctgggggggcttgccccccagccccttagttttaattgcctatgcggggggggcttttgtcccccgcaaatgtatatatatatatatttagcgcgcggcttagccgcttttgtttgtattaccccagaggggaattgtccctctggggaaaaaaaatgattggaaaaataaagtgagctaa

SEQ ID NO: 1304 - DNA, 408 bp, Alligator mississippiensis
  source 1..408: mol_type = unassigned DNA
tgaaccccccctctgcaccagatggaccttcacttcgagaggattcttcagcaatggacgaccccgctccacccgaagaggacccccgcgatgagactctatatggactgagacactttttcttcgaaccacttcctccaccattgcggaccattgtaacgggtttgtgtgtatctatcttctttctctctcagcgtcgcgaaccccctccctccccttcccctccccctcccccccacccccgggcttagttggctaacattgtatctcctgtaacctagttgcgttcccctcctcacccccatccctctattgttagtccctcgctcgggcgctctgtatttccctaccggctttgtcatcttttttggattcacaatcctaaacatctactaataaaagtcaatc

SEQ ID NO: 1305 - DNA, 401 bp, Chelonia mydas
  source 1..401: mol_type = unassigned DNA
tgagccggtacgacatcgtgcatcaactatgagaaagggactgagagactttttccattggaccatatgaactggaaccataaactcactgaacattaaatctcaccaaatgagggtaaatccatcctcatcatcgtatccactcattatactccacacctgaacatagccattatatgaacaacatacccccatatctcaatgtctgtactttgacccgttaaccttttacccccaatcggggatattgcagattatgtattccttacgccacccgatcctaaaccgaatttcgcaccccttgataatctgtaccttattccctgataaccagaaacttctatgcttaaactctgtaccgtttttttttatttcaacatcatcttaataaaattattaaa

SEQ ID NO: 1306 - DNA, 402 bp, Chrysemys picta
  source 1..402: mol_type = unassigned DNA
tgagccagagtgacatcgttctcccactacgagaaagggaccaagtgaccttctccgttggatcatatgaactggaaccataaactccctgaacattaaatctcaccaaatgagggtcaatccatcctcatcatcatatccactcattatamtccacacccgaacacagccactctatgaacttcataccctcatatctcaatgtctgtactttgacccatcaaccttttacccccaatcggggatattgcagattatgtattcctcatgccacctgatcttaaaccaaactttgcaccctcgataatctgtatgttattccctgataaccagaaacttctatgctcaaactctgttcactattttttttaacatcatcttaataaaatttttaaatctgtt

SEQ ID NO: 1307 - DNA, 228 bp, Drosophila sp.
  source 1..228: mol_type = unassigned DNA
taaaaaattaaaatgccttaaaaataaataaatatatcaaaatttaaaaaaaaaaacgaggaacaaataaacacaaattctgaaagatttatataatttaaaawataaatcgaaaataaatgttgaaaacaaaaaaaaaataataataataataaaaacacaataacactcacccggcctgccccagaggcaggtaaacatttactggccatatggctttttttttaa

SEQ ID NO: 1308 - DNA, 408 bp, Gavialis gangeticus
  source 1..408: mol_type = unassigned DNA
tgaaccgccccccctccgcgccagacggaccttcacttcactccgagaggattcttcgaccacggacgaccccgctccacccgaagaggacccccgcgatgagactctatacggactgaggcacttccttcgaaccacttcctccaccattgcggaccattgtaacgggtttgtgtgtatctatctcctttctctctcagcgtcgcgaaccccctcccccaccccccacccccgggcttagttggctaacattgtatctcctgtaacctagtcgcgttcccctcctcacccccatccctctattgttagtccctcgctcgggcgatctgtatttccctatcggctttgtcatcttttttctggattcccgatcctaaacatttactaataaaagtcaatctgttcttt

SEQ ID NO: 1309 - DNA, 297 bp, Lytechinus variegatus
  source 1..297: mol_type = unassigned DNA
tgaatagcatttatattgtgttccaaacaacatactcattattatatctaaacatttttttttctgttcctgacaatctacgtaaagtctgctaaccaactggcatgatgaaataagataaaatccccttacacattaatttcttgtcacatcataatgctttgtcaaagcaatgtcctacataatatctcgatgtcaccccaattaattttacatccttcggtaacctttataccgttggatcaacatatatgatttgtaaaactgttatttctgagttttttctatgctaataaa

SEQ ID NO: 1310 - DNA, 257 bp, unidentified
  source 1..257: mol_type = unassigned DNA; note = Description of Unknown:Nasonia vitripennis sequence
tagtggggccataacacctaggccccacagtgtggcgatgtccatgtgtgtcgtccttacttatttatttatttgtcctgtcgagctgtttaatctattcatatgtatgtgttgtgtgtgtcgtccctcgtagcagttttattccgtccaaccagaggtcgaccaatattaaaataagcatggcttgaagcaggccaagcgccgtgttctaaccccgttttaggggaagttacttaacctaaaaatacaacttttcc

SEQ ID NO: 1311 - DNA, 246 bp, Phytophthora capsici
  source 1..246: mol_type = unassigned DNA
tagacggcacagttctggcccacgtaggccgaaagggccccacccatgtagggaaccgccctcgggaaatccattccggtgttcgactgaagagatgctccttcgccttgacggaggtacatctcgacagtcgaacttcaactcgcaacatatccgatacagttacaaaccacagttagatatcagataggaaccttcctttaggaagctaacgggtacactggatggtaaatacacatacatttc

SEQ ID NO: 1312 - DNA, 948 bp, Phytophthora infestans
  source 1..948: mol_type = unassigned DNA
taagctggtcatcatgaccgacagggcactacccaggtagggaaccgcccttaaaaaacccaggaagacacaaacaccctccacttagtgacatacatattttagcctagatttcagttacggagaggttactaactggtaaatacgaacacatattctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggttgtcgggcttttttctttttgaccaatcagagcgcgccatgcgcctcttctggccaatcagagaccgggccctgtcctcggacagcgaggcctccacggccagccaatcgagtctcggcagcgacgcgtctttctatagcgcagctgacgaggccgatctggcggcccccgattggtccgactttcggccaatcagcgacgacgagggggcaggggtttacacttttgcccccgtttcgacttcaacttcaggccaaaatggcgatttggaccctccacgcgccgtgccactgctcggcaccggcggcgattcagcgggtgcaacttcgggcacgtgtgcaacacatgcagcgcccattgcacgccaagcggcatcgcgggacgacgcctcggccgcccaagcgcagccccgcccttccagcacgacctcgcgccgtttggcggatcgccatcaagacgtgcgagagccaggcggggtcgggcaaaatatacttactctaagtatgcccgaatccctgccctctcaggctgaacgcggccccatacttgatctaagtatgggaggatccctggcctctcaggctgtacgcgagaccc

SEQ ID NO: 1313 - DNA, 1277 bp, Patiria miniata
  source 1..1277: mol_type = unassigned DNA
gattagcgaacactaatatcctgccmtagacgtgattgctaatccgcaaaccaaccggatctacagcctgaacactgaactttaatcttcacccatgtcacatctggacactaggtttttgctctgtttgtgttttcctgcctttwcmttggawctttcgcmctggaatttatttgtcgcttggattattttttttctcacaatttggatctattttcgtttgttcacttcgaactctagctgccctttcttcggacactgaactttaatcttcgccatggctgtcagtcgccggttcacttgctgcggtgggatcctgttgtgataatccccgtgcattgcccatggatttatttccgccttagttgttcctaaccttggatttattgctgtgggtgatgcccgggttttgtttacatcgggatcccgctgcggctcggtgttccatgcgactggcagcccctttgtttactctsgactctattcattgttgtatttcttccacactggccagtgatcacactgctgtgtttcccgggaagatatcctctgcggttttcacgctctgggtgtctccccgggcaacgcactggttgcttgctgcgccatcacccttttcgtttatattcattttcagtctgccgttatcttggccagcgctcattcttttgtgatggccgtggactgaccctctgcggttttctgcggtcascactctcggtgaatgctgtgccaccatttttcatttgtttactttttcagctacaattatcctggccagctttcactcttttgtgatggccgtggacggaccctctgctggttttcacgctccgggtttgtctgcggtcagcacccttggtgagtgctggtcgtttgtttgctcattttgcttagttcaccattatctttmttctcttttgtwtggttttcctagcggttgtctgggagttgagctgcagttgtctggtcttggttttacccccatttgttttcttttaacgcggggcgtattgccttgaccggccgtctcagcttttctcctagagcaaccttccgttcatccaacttttagttttctcagttcttggccattccggttggttaatttttatttatacttaattttatgtttacattttctggttggagaccattttagcttgttttaatagcttttcttctttaattaataccctctgccattgagggtttttattactattaattttgtttactctttgtaacttgtttgattgaatattttaataaaccac

SEQ ID NO: 1314 - DNA, 346 bp, Phytophthora sojae
  source 1..346: mol_type = unassigned DNA
tgaagctgcacaagcgcgaggctcgacagctggaccttcagctgtcgagccactgcatccgcgccagccaccgcacctggggctggtactgccggcgccaccgcgaaggacaacggagcggcaacgcctcgcgagcgccgcgtgggtctggggggggcccgcggcgcacatcgcaggctcgggcacggcggtaagctggtcatttgaccaacagggcactacccaggtagggaaccgcccttcaaaaacccaggaagacacaaacaccctccctttagtgacatgcatattttagcctacatttcagttacggagaggttactaactggtaaacacgaacacacat

SEQ ID NO: 1315 - DNA, 159 bp, Pythium ultimum
  source 1..159: mol_type = unassigned DNA
tgatgcgggtcatattgaccgaaagggcaccatccacgtaggacaccgccctcaaaaacccagttcagtttattgacaccctccacttagtgacatgcatattcaaaccgatacatattcgttaggagaggttactaactggtaatatatcaccatttc

SEQ ID NO: 1316 - DNA, 371 bp, Strigamia maritima
  source 1..371: mol_type = unassigned DNA
tgatgggagagtgaggaatcttctccactgtgcaaaaccatacagtcagaagatgctaactactagtttgataccctgtgccccctgcaatgtcccgcgtgtcgtacccaagcccggctggcattgagacacattaggctctcgctcccccgtatactctcataatttcgtgtacgctaatcctaccctacccctccctttgaccactcacccaaccatgtgtatagctgtgctggtgatcccggggcggttattcactggttatcatatcattctaaaatgatctttgatctctcaattaacaactaacttatttctgtttgtttcattgtttcacctcgtaagaggaagttcattgtgcgataaatcaa

SEQ ID NO: 1317 - DNA, 317 bp, Strongylocentrotus purpuratus
  source 1..317: mol_type = unassigned DNA
tgacgaaatgttcaatatatgacattctaatgttcatgtattttttgtttgcttgacaaagctagatgaatatattccctgtcctactacatacatctcgatgtgcccttgctagacgatccattggtaaccatgatatcaatggattaacacatgatctgtaaacaatatatgatttacacaatgtatttattgtttcaataaatctgttcttttcactttaatacatgaaacatgactgtgccttctccaactggagacctacataatttgttaaaatgatataaatatttcgaagatgaaattattattaataa

SEQ ID NO: 1318 - DNA, 134 bp, Trichinella spiralis
  source 1..134: mol_type = unassigned DNA
tgatccgtcccgaaccaacggaaccacattgccgcatgacttcgatttcgcttttgctctttttgtatttaattttgctattaacaattcagtttgttaactgttttgtattcatttgaagatccaaataaaac

SEQ ID NO: 1319 - DNA, 394 bp, Chelonia mydas
  source 1..394: mol_type = unassigned DNA
tgagctggagtgccgatgagaagcgcagtcgggaaagtaactgaaatactttcctcatggattgtattttctaaatggacaacctacctaattctcaattactgagggacaatctccactcattgatatattttgctttccacaaccaaatctctgtacaacttttcatgagtgatgtacccgagtacttggattctaatatctaaactgtattgttaaatctattcacctaaatttgggttattgctgattatgtactctatgtatcatatgacttttaaaaacaaactttgtatttgtggataatctaagcactatacccagatgtacagacactcttttcccaacctatgtattatatttttttaacattagctttaataaaatttttaaa

SEQ ID NO: 1320 - DNA, 155 bp, Phytophthora capsici
  source 1..155: mol_type = unassigned DNA
taagctggtcatttgaccgacagggcactacccaggtagggaaccgcccttcagaaacccaggaagacacaaacaccctccctttagtgacatacatattttaggctacatttcagttacggagaggttactaactggtaaataaaaagcacttt

SEQ ID NO: 1321 - DNA, 1015 bp, Phytophthora infestans
  source 1..1015: mol_type = unassigned DNA
taggcggaaaccaggcccaagacggccgacagggccccacccaggtagggaaccgccctagaaacccatttcggtggtcgactcgaaggccttacctattttttccttagacattcaattaggtagcgaccaaattacaaatttggtaacgagtaagccaaatggtaatacacaaaacttttctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggctgtcggatttttttctttttgaccaatcagagcgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggggtttacacttttgcccccgtttcgacttcaacttcaggccaaaatggcgatttcgaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgaacgcggccccatacttgatctaagtatgggagggatccctggcctctcaggctgtacgcgagacccgtacggccgaatcccctggcctctcagcctgtacgcggggc

SEQ ID NO: 1322 - DNA, 380 bp, Phytophthora ramorum
  source 1..380: mol_type = unassigned DNA
tgagcaccttgggttgctcaagcgtgatgcgaagcggctggaccggcagctctcggtggcgtgcatccagtccagccgccgcatctggaacctgcactgcagccagcaccgcgcgcgccagcaccaagcaccagggggaagtcgggcggcggagaccggggggactccgccgcgcaccggccgccgctagacggcacacaggcccacagcggccgacagggccacacccaggtagggaaccgccctcaaaccccgccggtacattatggtccgacacctatgaggtgcaacctgtacacaagttacacaccacatagcgactaccaggtatttactacctggaagccaaggattaaccggtcggtaatacacataacttt

SEQ ID NO: 1323 - DNA, 210 bp, Pythium ultimum
  source 1..210: mol_type = unassigned DNA
taagcggggggtccagaccccacaagagagaagcaggaatcatggtccgcatggaccagtagggcacgctccacaaaggttatcgccctcaaacccatcacacgaaggatctaaaaagaaagcaacaatcgaaatagtaaatagtaaatagcttagaaaggtcaacatgcgaaatgcatgaggaacgtaagatggtaatacatttttata

SEQ ID NO: 1324 - DNA, 1098 bp, Phytophthora infestans
  source 1..1098: mol_type = unassigned DNA
tagacggcaaagttctggcccgcgtaggccgaaagggccccgcccaggtagggtaacgccctcgggaaaaccattctggtgtttggctgtttttcaacagtcgaacttcaactcggagcatatcagatacacttactcacacatttagatatcagatagggaacctttattagggagataacgggtacaccggatggtaaatatacaaaaccttctctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggttgtcgggcttttttctttttgaccaatcagagcgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggggtttacacttttgcccccgtttcggcttcaacttcaggccaaaatggcgatttggaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgtacgcggccccatacttgacctaagtatgggaggatccctggcctctcaggctgtacgcgrggaccaagtacagccgaatccctggcctctcagcctgtacgcggggctatacttggtctaagtatgccccggtcgctggcctctgagcccgtacgc

SEQ ID NO: 1325 - DNA, 242 bp, Phytophthora ramorum
  source 1..242: mol_type = unassigned DNA
tagacggcaacactctggcccgcgtcggccgaaagggccccacccacgtagggaaccgccctcgggaaacccagtctggtgttcggccaagaaatgcaccaccaccacggcggaggtgcatttcgacagtcgaacttcaacccgccacatatcggatatagttacagctctagttagacatcggataggaacttcttagaaaattaacgggtataccggatggtaaataaaataaaaacttc

SEQ ID NO: 1326 - DNA, 1036 bp, Phytophthora infestans
  source 1..1036: mol_type = unassigned DNA
taaacgggtcacttgaccgacagggcaccacccaggtagggaaccgccctttaaaacccaggaagacacaaacaccctccacatagtgacatacatattttagcctagatttcagttacggagaggttactaactggtacataaaattacacattctgttctaatcagtgtgaaaactggttttcgccttttggcggactttttcactcgcatttttgggcaatcgtctgcggctagcttgctagcggcggacgagcggtctccgggggcgtacacctttcccccgcgaggccaactacaccgatcttctctacacttttctaattcgccttcgtcttcggtcttcggctgtcggatttttttctttttgaccaatcagagtgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggagtttacacttttgcccccgtttcgacatcaacttcaggccaaaatggcgatttcgaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgtacgcggccccatacttgatctaagtatgggaggatccctggcctctcaggctgtacgcgagacccgtacggccgaatccctggcttctcagcctgtacgcggggctatacttggtctaagtatgccccggtcgctggcctctgagcccgtacaca

SEQ ID NO: 1327 - DNA, 193 bp, Phytophthora ramorum
  source 1..193: mol_type = unassigned DNA
tagacggcacacaggcccacagcggccgacagggccacacccaggtagggaaccgccttcaaacccggccggtacattatggtccgacacctatgaggtgcaaccggtacacaagttacacaccacatagcgactaccaggtatttactacctggaagccaaggattaaccggtcggtaatacacataacttt

SEQ ID NO: 1328 - DNA, 1063 bp, Phytophthora infestans
  source 1..1063: mol_type = unassigned DNA
tgacgcaccgtgacatagtgcggcacgtgaagatgcacatgaagctccgacactgggccaagtgggcggccatgcgcgaccaaggcaagacagctcgtgcacatggtggggttggtagtggcttcctcacacggccgcgaggcctgtgggaagccgactaccggttcgcggtggccggccgcttaaaccaggtagacacgcacagtgtcctcaagcgccggcgcctccgagcacatgacaggtgcagacacccaggatgcacgcgctccgagacgctggcgcatgtgcttaaccactgcgacggaaccatggacgcagtccgtggccggccatgacgccgcactcaagattattgagcgtgcgctcctcgcatcgtcggccgaccagcaggaccgtgctgagctccgcgtgaaccagaccgtgccgtcactcgccggccccgcgctacggcccgaccttcagctctacaaccacaccaagaagacggtggcggtggtcgacctggccgtggcgttgaggagcaggcgagtgacgacgcgagtagctcggcactgtcccggatcgccaaccacaagcgagccaagtacgaccacatcaagctacacctcgagcgccaaggatggaaggtacacctctcggcactcgtgtacgggtcgcttggggcggtcgctagtggcaactaccaggtgtacaccacacacctggggctactcaagcgcgatgcaaagcggctggaccggcagctgtctgcctaatgcatccagtccagccgccgcatctagaatctacactgcagccagcaccggactcgccaacaccaggcgaggcccagccaaggaccaagaggcagccgggcgacggagaccggggggactccgtcccagacaagccgccgctaggcggaaaccaggcccaagacggccgacagggccccacccaggtagggaaccgccctagaaacccatttcggtggtcgactcgcaagccttacctatattttagacgtagcgaccaaattacaaatttggtaacgagtaagccaaatggtaatacacaaaacttt

SEQ ID NO: 1329 - DNA, 415 bp, Phytophthora ramorum
  source 1..415: mol_type = unassigned DNA
tgatgcccgccaactacaaggtgcttactgagcaccttgggctgctcaagcgtgatgcgaagcggctggaccggcagctgtcggtggcgtgcatccagtccagccgccgcatctggaacctgcactgcgcgcagcatcgagcacggcagcaccagggccaagcgccaaggggcagtcgggcggcggagaccggggggactccgccacagagcggccgccgctaagcggacatcgggcccgtagcggccgacagggccacacccatgtagggaaccgccctctaaacccgcccggtacattatggtccgacacctatgaggtgcaaccggtacacaagttacacaccacatagcgactaccaggtatttactacctggaagccaaggattaaccggtcggtaatacacataacttt

SEQ ID NO: 1330 - DNA, 1562 bp, Ciona intestinalis
  source 1..1562: mol_type = unassigned DNA
tagccaaaagatttggtgttcttggcgagctgcagtcccggcagagtaggcgagatcgtgagctctacaccgcttcacgatttgacgagttcttcttgagtcgatccccaacggcaacgcactccaaatttaacgaccgcatggcgacgccactgatctcccagtcatccgtgctccgagggcacttaaggggaaccgattcactgatgctgcaagttggcgggggcgcactcaccaatggaagatgagggagcccaacgatgccccgaactaccgcaccgtccccagcaccgtgtccttgtgagtaattattttcactaatccagggacggggccatgaactgaactatgtctgcacgctgccccgcctagcctcggccacaaataaatagtcaagccggggcgtactaccaattgattcggatttggcggggcccatcacgcgcctccgcccccacacacaaaaacacttttaaactcttcggttccccaaccactacaacaaagcgagcggcccctcttagatccaattttaaaattttaaatcagtgcactcaacttttttacgtgttgtgttttttgtattttttcccacagattttgtatttttatattatattttatatacacaacactatttttatacactaccttgcactgtcccactttttgtaattatcaccttttaccttttatgccgctcgctgagctccttgcacggatgaccagacaaacttttataaaattataacattgttttaattgtcgcggggtatcagtggcgcccccttgcggccgtgaaagcccttttcaccttaattcgccccttagtccaaatttttccccattgcctgtaaaagtgcgttgccgtcgactcgaactcgtcctttttaccgcctctctgttactgaactatgaccagcttggctgttgaagtcggctttaattcgccggcttcacattatatttttttgttgggtaatctgttttttttcatatataaaaccattcggcttaaaatcaccaatccccatcatccaccctggtcacccattgaaacatctctttttagtcaattattttttcagattacccctcccaaattgtcatatagtttaacaccccgtttgccaagttggtcttttccccatccccttctgtccttccggtaatcccataacattttattctttaattcggccccataaatagtgtaatcttaagacgaagtccccagaggcccggtcccccccttctttgtcatggaccgggccagcccccctgttaccacaacaacccaccattttattctttctttctttttattagtatttatttatattgccgcccaactgtcgtgtcgtggcgcaggggggttccctctgtcggcccagtggacgaccgtctaaaaaacaggcacaggcagcaggcacttatcacccggtacctccgggtaccggaggctggttttcagcgcactgtacgtgatggccaattttattcattgcattttatccgcgtcgtggtgtttgcgtggatgcattaataaaagatgaaattcc

SEQ ID NO: 1331 - DNA, 602 bp, Schistosoma mansoni
  source 1..602: mol_type = unassigned DNA
taacggctgaacgaatagcccccttcactcttagacattcccccactgttgttgcttatcttcatgctcttgtgttaattgactgctctcttctgggttgacgtctgattgtctctctctctttccatattgcttgctctgcccgcttacttccaatagttgtcatattatgtctttgtttacttgccatgtctaacgacaattactttatctaccttagtttgtcctcttggtttcgattgccttcatatgttcatggcggaatctgatgtttataatgactattcctattaccaccactacaactactattattattttcattactattaacattattataaacattattactattattattattactattattacttctacaattaatattatggctactcctctcagcacaccaataaaatatcaatcaaacatctcaattatatccacctattaaactctctctatttcccctgagttataaacttacaattcagtctaaccgaatatctctcttttacaaatcttaagtatgtaattttgtgccaaacccatttgggtctgtacaatttgatacttaaaaataaatgttattagcc

SEQ ID NO: 1332 - DNA, 90 bp, Bombus terrestris
  source 1..90: mol_type = unassigned DNA
tgaaaacacgataacgattatgaatcaaaataagaaagtaaacatcccagaaattgtctacgtcttatttgttatctatttatttgttta

SEQ ID NO: 1333 - DNA, 1815 bp, Crocodylus porosus
  source 1..1815: mol_type = unassigned DNA
tgaatcccactctggggacccccaaaaattagaaaaacccaaaacagttgtgtttaagtgtgttcttgtttgtccctttggcttcacctccaagttgcgatcccccatctcccctgcgctgtctttctgaatgaccagtggtgttgaggctggtgtgacctcggtcacctccaaggccaagtgccctggccccgagtaggaccaggtggcccagcttgctgggcacccgtcaccgcccagggcaaatggaagggatctatcctgaccactaccaggctaagtgtggtgctgcctagcctgccgtaaggtcaagcgccctgctgccgctcgggtakcagtcctcgttcactcgtccctcctagtaccctccgcmtctgcgcttctgctatccactgtggccggwgatgccgaggwtgswmcawcctcgacacctccagggccaagcgccttggccmcaggtaggacctggcacctgcccagggggccagacactgcctgcggcaagggaaagggagccgtccctgaccgttaccgggcttgatggtgctggctagcccgccgtatgtcaagcactccacagctgctcgagttcgctggcttcaccttcatcccwcctagtgccttccgcctctgcgctattttcgtcccgactcgtacctccccacctctgcgctacmgctatccctgmaaggaccaagtgggcaggggsgttcgccccccgcccgcaggaggctcggcgtatccgtggcktcwtgcctccaccgtcttgtgccgctagaggggtacctcmgagaccggcgcaacacgaccttgacgsttagacagtagggtgmaacakccctgctgcaggcstgaagggccaaacggctgtgccatgagaggggaaccttgaagaccgggscagtcagccagttagtcagttgggcgaaacaatcccagctgcaggcccammagggctgtcaggtgagggggtatccccawccaccccccgccgccgactacggaggcakgaagtccctagtgacttckgacccccacgtcttgtgccgggagaggggaaccttgaagatcggggcaagccgcacttgatagttagccagtckggtgaaacaatcccagctgcgggtccgaaagggccgactwccaggcgaggggggcctgcggaaamccccctccatggtacggagktctggcgtcctmaccgacwccttgccaccaacgtcttgtgccgggagaggggaaccttgaagatcgggscaagctgcacttgatggttagtcagtcgggtgaaataatcccagcwgcccccgctgtgactgctaagmcwggtccccaaggggcatgaggcatstgcgctgagccggsaggggtgacacmcggcgatcggcgcagcacakastgaagggaggcacttgctgagactgcttctgaggccccagacttggggtggtgcagccttgtctggggtatggtacagcaccctactgctccctttggkcagcagaattcgtcccgacctcttacccacccgagtctgcgccttgttccgctatcctgcatctccgatccacctcgctgtctccccgctgcgctgcttttctctcaagtgggttaaatcttgtcatgattacctcccacgtttccgctcaagggcaatgcccaamatgacggggatcgctggtgcatggcagtcatgagaccatccggaccctccggtggtcgctatagtcattttktgttgcatggggcatsctgagtcacttaaccgaaagactcwaaataactcaaaagaggkamcctctgsggttcggtaaa

SEQ ID NO: 1334 - DNA, 236 bp, Drosophila willistoni
  source 1..236: mol_type = unassigned DNA
tagatgtactaacctctagcttttcttatacttttgcctgctaccttggcattacatctaaaaaggtacaaacatcgcattgtcataaagaggtggttttagtacgtaggcgctgtgggacttcattgtcccggtgatgcagtgaatcgtgcatacgagattgtccagtagttggttgctcgtatctttagaagatttccttcctcggcgatcaaaaaaaaaaaaaaaaaaaaaaa

SEQ ID NO: 1335 - DNA, 2018 bp, Gavialis gangeticus
  source 1..2018: mol_type = unassigned DNA
tgagaagttgcgagttcttatgcaagttgaataccactctkgkgaccccaaaaaawwaaaccccaaaacagttgtgtttaagtgtgttcttgttcgtccctttggcttcacctcsaagttgcgatccccccatctcccctgcgctgcctttcagaacggccggtggtgtcgaggctggcgcgacctcggtcacctccaaggccaagtgccctggccccgagtaggactgagtggcccagctcgctgggcacccgtcaccatctggggcaaatggaagggatctgtcctgaccactaccaggctaagtgtggtgcggcctagcctgccgtaaggtcaagcgccctgctgccactcaggtatcagtcctcgttcacttgtccctcctagtaccctctgcctctgctcttttgctatccactatggccagtgatgttgaggttggtgcatccttggtcacctccagggccaagcgccttggccacaggtaggacctggcacctgcccagggggccagacactgcctgtggcaagggaaagggagccgtccctgaccgttaccaggcttgagatggtgctggctagcccaccatatgtcaagcactccacagctgcttgagtttgttggcttcaccttcatcccacctagtgtcttctgcctctgcactattttcatcccaactcgtacctccccatctctgcgctcctgctatccctgcaaggaccaagtaggcaggggggttcatccccctacctgcaggagactcagcatatccatgacttcttgcctccaccgtcttgtggcgctagaggggtacctcagagaccggcacaacatgaccttgacggttagacagtagggtcaaacaaccctgctgcaggcccaaagggccaacagctgtgccacgagaggggaaccttgaagactggggcagtctgaccatgctggttagtcagttgggtgaaataatcccagctgcaggcccaaaagggctgacagtcaggtgagggggtatctccatctgctccccactgccaactacggaggcatgaagtccgtagtgacttctgacccccacgtcttgtgccatgagaagggaaccttgaagattgggacaaaccgcacttgaaagttactcagccgggtgaaaataagtcccagttgcgggcccctcggggctgacagtcaggtgaggagggctgcaaagcccatctcctgactccagaggcctggcgtcctaaccgacttcttgccaccaatgtcttgcgccaggagagggcaaccttgaagatcggggcaagccgcacttgatagttagccagtcgagtgaaacaatctcagctgcgggtccgaaaggactgacttccaggcgaggggggggcctgcggaaaaccccctccatggtacggaggtctggcatcctaaccgacaccttgccaccaatgtcttgtgccaggagaggggaaccttgaagactggggcaagccgcagttgatggttagtcagtcgggtgaaataatcccggctgcaccctgctgtgactgctaagcccggtccccaaggggcatgaggcatgtgcgctgagacgggaggggtgacatctggcgatcagcacagcacagactgaagggaggcacttgccgagaatgcttctgaggccccagacttggggtggtgcagctttgtctcgtgtatagtacagcaccctactgctccctttgggcagcagaatttgtcctgacctcttacccacccgagtctgcgcttttgttccacctcgctgtctccctgctgtgctgtttttctctcaagtgggttaaatctcaacatgattatctcccacgtttccgctcaagggcaatgcccaacatgacggagatcgttggtgcatggtagtcacgagaccatccggaccctccagtggtcgctatagtcattttgtgttgcatggggcatgctgagtcacttaaccgaaagactgtaaataactcaaaagaggtaccctccggggttcggtaaa

SEQ ID NO: 1336 - DNA, 437 bp, Ixodes scapularis
  source 1..437: mol_type = unassigned DNA
tagtgtgacggagtcctcaagcccccacaagtgcctgccaggtggcaggaaagggcaactactggtgagcgacccaagcaaggcggagccaagaccaagctggagccaagagcaactccaggaggcaggggtggatatcaagagcaaccccaagggacacagaccacgggcaactactggtgagcgcccaagacaggggtggatattaagaacagccccacaaagtgttacctatattaacaataaagttgaagcctcaaccacgcattgcgggttagatggcgtggcttggcccgccgccatgatgagctggaaccctccacctggtgggccgcacgagaccaccggctctttctactaaggccggtctccgtgactgcggttgggataaactccaagcactgagcggtaaaaaaaaaaaaaaaaaaaaaaaaaaa

SEQ ID NO: 1337 - DNA, 970 bp, Mnemiopsis leidyi
  source 1..970: mol_type = unassigned DNA
tagtgacgagaaaagtcgctttatccttacataacagtgtgatagtcatccttatcacaactgtcctggcgaacaaaatggcagagggatagtactcggtccaaccagaaggaagcccacacgatgccaaacttgctgtaacccacgtgagcggaaaacatcctccgagtatagtatgatggaaggatacaggatgtggaccgctctaggcggcggacggtgtagacggcgaccttaccatagctgcgactgctgtgcgatccggaacgggcctttctcacttacctcaagcaccgtgtcggatcgcggggtgggcgcgggattcctgctgggaagttgtctgcacccaagtcgtcagctaactgtcggtacttatacgcacccagagccatgctcttaccaggccacttgacggcgctacaccggtctgtaggagggtatctcagcgacttggacaaaatggatcttgactgcctgagggcgcttatcgagtgacccagagtaagctggtaggaagaatcttgcagttgagagggctagtagggccagcctctgctcgtcaactgtcctaggcgttaacgtgtgcctccctatgaggtaaccgtgaagtattacttgtttccctgtagagaccatataactagctgagaaacgccctgcgggttaatatacagttaccgccgtcctgcatccccgagttgtgaccagcgtacagccatgtaccacggcacttccagcattctctggtctaagaatgtatcagctggcccgccgaaagatagagcgaccccgcctctatcactagagtaagcaggcacgcgaaatatatgcaggacgccttggctcagtagctctggtactgagtatagcatggctgaacgcccctttaagttcggtggcccagagactctccgagacttcccagtcctggagagggtacacctttaccagaactttctgtggtcggttg

SEQ ID NO: 1338 - DNA, 153 bp, Petromyzon marinus
  source 1..153: mol_type = unassigned DNA
taatttaaggtaaaatcgtgggattgttttgatggcaatctgcctagtcgcggccttccattttgggtaggcagcagacccatctatataacaaactactttgcctttcataggggtacccgaccctaccaactttcggggaagtaaaagaaa

SEQ ID NO: 1339 - DNA, 1231 bp, Schmidtea mediterranea
  source 1..1231: mol_type = unassigned DNA
  misc_difference 260: note = a, c, t, g, unknown or other
  misc_difference 446: note = a, c, t, g, unknown or other
ggccacgcgcgtcgtccttgtttgatcactagtggatcaaccttcgactccccggaactgtgggagtggcggaagaaaggccagaggatgtcctgaaaccatatatttatttatagaagttttacttcatcctatttacgtatttcagtatgaaaatgagtaaagttctcgactcgatgagttgggggcaaccattgggggtcctgaagagaggctctcactgtaaaaaatctcttcgtgtctgtttattcctaggcacntgctgcattatgaagcggwgaaagtaaagttagagctgagagataggtacttgctgcattatgaagcggagaaaggcctcgaataaatagggtgttagagttattgatggagagtatactagtaagcttaagctgcgcctcgcgcggtgcccaaaaatatacttaatgagagcaataactcaaggngagtttaattcatatgcgcatgcggcaccaaggtgctgaatggcatcgattaaacctctcctgttgtagaagcaggtcataaatggaggrgggcaaccactgaaacttatgagccagaagaagcttaactacawaagttttaggcaattactgaacggagttaactgttagttaacactaccatgtagttgtttataaagcaaatatcaggtttcagtctatatactaaaagtattttttgataccgtggtatataggcaactagttaggaaatagtaagggatgacgcattgtctctctttatggtactgaggaaacttatcgactcgcgagggatgaaacccgtaaaccgatcgatytagcctataagtaccagcgacagttaaaccatcttacgcgaggggtaaaacctgaggaccgattatggtataacttctcaagattagcacaaaatgcgagtgcaacttgaggaggaggatttgagtgttaattcataatgtactaatctaattaaactgtgacgggaattgcagcttcggctgtaattactttgaggcctatcacggattgtaaggaacatattgacaccgtaagtctaacgtgttcccgatttccaaccaggtcatatgaagggctgcccttgataaggcggatttgacccaattcttcatatgagaggcttattccagccttcccgtagtaccgtgaggttttcccgcctcgaacggaacaatgttgcagggtaattaagtacatcgggctatatmgcgatatttaacgtttta

SEQ ID NO: 1340 - DNA, 813 bp, Strongylocentrotus purpuratus
  source 1..813: mol_type = unassigned DNA
taaaccttgcctccccgggcccccctcagtgactaagacaactttcaccgtaataatcatatatttgtataccatgtattaatctaggtaacaattgaaagtaacattgaaccgtattcatactttaatgagtacaatagtgaagggaactgtatattacatacctcgagatagaggtttttgtaccttaagggttcgtgagaatccatactgcataaaggggttaacttgtaactcaaccccagggagacaagccgacaaattcggcattactatgtgagggtcataagtgttaaaggacccattgtatataacttgtaaatgtacagagaattcgagttgagttcgaagaataaacaaacaaaaaagaaaacaaagagaattcgttcgtccatagaagcggaaaaagcgcaaaaaggcgtcctaacctcacggtctaacccagaaacatttaaggggggaaggagctcattactccaatccaaaaccacgttccctagcccaaaagcgcgcttcaatgagggagccgatattggaggacagagttcatcaaaagccacctgtaagtaggcccatttctgccaaggacatgcgcaaaaggaagcagattatcaaaccagtcaaacaagcacaaacattggggggatgggataaccccggaaagagagggatctttagatagtggatggaaggggtgggacgttgaatccaaccatgccgtttttatgttcccgataaagaaggataaggtcactccagcctgacacacaaagtggggtaaaagaactccgctcgtacggactccaaatagaa

SEQ ID NO: 1341 - DNA, 2663 bp, Salmo salar
  source 1..2663: mol_type = unassigned DNA
tagatccgtttgttatgattggagggagcctgccgagtggtatgagcgctccaactattgaacccatatgattcccgaggcctggccagacgcctagatgcctgccacaattgaacgcagccctagcttgctaggagatccataggaactggcctatggggcgtcatgacggttgaagttcctccatagcgtgcttgggaggggacgacaatgacgagtcatgacgtaccgagagaaccccaacccaggttgggggagagagccagcaagagcggagatgcttggtataccaagctagcagagagagggttgaagaggatgactactgggctcagagtcatctcaccctaaaaggcggtggggcatcggttgaacacctacccataccgggatgggaggtggtaggccgaaaaagaacaggaagatggtggagtaagttgagagcggttgctcgggaagttatgttgtgataactccattaaggccggtgggcatggtgcggataatggaaactataaaaacaataaaaagaaagaccaaaaaaatgttctgttatgatgccttacacatgtctgggagaccccataagggtctccccttatacttcactgggaaaccccataagggtatccccctatatttactgggagaccccataagggtctccccctatagatgtagagcgtaaggggtctccaaagtaccggccgatatggccttatggcaaactctggtggtagggacaaggaggtaagggcagtgccaacccctacttgatcgggaccatccagggaatgccatcctcccgcgaaggtgatgtggtgaggtaaggggggagcccgtcttcgagtttccccaacccctacccacaggtgagaggaggagaagaggaatctgtccccaacgggaggagggtgaggtgtaagggggagaccttctagtagggtcttctcagtcgcctgacgtcctgactgtggggtggatcagtaccctacaggtgagaccggtgaggtaagggtgtggccctcttgagggctgcgccaacccctactcgaggtaacctgagggagtggtggaatggcggcatgttagtgctgggacttgattgcgagggtttaatgagagtggcctgctgagagcaacacttgtggtgcttaaagcggggcggcccatgaccaccgtgagataggacactgcacagtgcagccatgaggttcctggaggatgatgcgatgaggtgggggcctcatcagcccctcctggcagggcgtcggccagggaaactaaatgtctctagcatgtcagtgcagtgaggtaaggggagagcactctagtagggctcttccaacccctacctgtaggtcacctggtccaggtgtcgatgatgtgaaaacaagagctactttggtaccggtctgttgcaaaaagggttctgcagaggacgacggctatccctatcgggagggaatagtcggtcccaggtagtggaaaatggggctttccactgagcatgaaaatgtggtagaggttgcgtccaacccaatgatttgcagcagagctcttggacacgaagtctgtatagtcccatgcaggcagccaaccagagaatggtggcaagaccccagctccgtatgggaggggagggccaagatatacggaacggctgctaaagcgttctgccggtgtcagtctaatcacagacagctgtgacgaaacaaagtatgggttccgacatgcttggtcagctcttagccgcaaggcttaaatcgaacgcagcccgccgagagtgaacattaaacggggatggaatgtgtctagcggttacgtactaccagggctcaggttcgcctgagccgaggctctacacgtcatggtgggagttctccccacgctcgtgagggcatgtagtgggatggcatgtggcggaccatcagctggcactaccaggcctcgggcttgcccgagtgcgggacctcacacattgtaggtgtgcttgtcccccctacgttcgaagacttgaggcggagaatactcataggccccacggcaaagggacacaacacggaggcttgtgtccgacgagccgtggactcctatagacagcccgggatatcactgggcacgctcatactgaagaaattcgatgaaccgggcctaccggagcaaatgcactctaatcgcctttgtgggcgactgtggccccctcatgcgagtgaggaatatcataaactgcaatggttcaaaaagtgattcctatggctcgtcggggagggctgactggggcaagcaaatgattgaaaggggaagaacctttttcaactgtttcttgccaagcccggttgatggtggcgctagtaattgcgacgggaaaatgcggtttaagtctccgaagtagtgcgtagcaccggatgtcgaccgggtgtaaaagcccttcgtaaagtccctggggaggtcagtcctggggctactgatgcgcagtatgtaattcgcagaatagggccatcgataccgcctgcgtgactcgactgggtttccacttgaggatatccgaccgtagcgtgcaccctcttgtagttgcgccggaaacggctgtgttccctcacgtatgtgaggaaactcaacaatgtgagtgggtaaacggcgggacgaactatggctctcgt

SEQ ID NO: 1342 - DNA, 155 bp, Tribolium castaneum
  source 1..155: mol_type = unassigned DNA
tgaaaagagtggcagttgtggagacttccttcggacgtcgggtcggattttcggacgccagggtacctccaccgctgggttcacaaactaggcgaacatctgccgataccctctttaggtcataggaccacatgtctctgcacgagattaaccca

SEQ ID NO: 1343 - DNA, 398 bp, Tinamus guttatus
  source 1..398: mol_type = unassigned DNA
  misc_difference 100: note = a, c, t, g, unknown or other
tagggggcttggcatttctcattgcctgctcctgaaaggatatgggtcctgcgtcgcgtggtaggcagacccattcgtccgagtagggggcttggcagtntccattgcctgtgcccgaaaggacgtgggtcatctggtctgtctgcctacacctctctagacttgtaacatctagtctgtcaacaagatcaaaattcttcacacagacgaccgagcttgctcagtcttcctgtacccgcagaattttgctcttgctctcctttggctgtgtcctggacgtgggactattccatctcgtcccaaatgccgcgtccaattataccggatttgacaaagcggacggcccgctttataagccggaaaaggtgccttgtaaaattgcaaggttcattaaatag

SEQ ID NO: 1344 - DNA, 304 bp, Trichinella spiralis
  source 1..304: mol_type = unassigned DNA
tgaggtttttgttttcttttttccttttaccattcttgttccattgttgttatttgctttaatcctgtattttaccgccggcaattccattgttattattactgttactgttattattgttactattgtttttacttttacttactactgttattatactttaattcgttaacttacgttattgttaccactacttactttgctctctcgcaaacgttcgttgttgtttcttttggaccaggtttagagaaatcgcacgcacagcggaactggaccgcttaagccagaaatagtaaagtaacaa

SEQ ID NO: 1345 - DNA, 155 bp, Tetranychus urticae
  source 1..155: mol_type = unassigned DNA
tgatgtatcccttcaatatattgtaatcctcattcgtccctatcctttcatttgataaaagaaactttgttgctccttttaatagttggtccctcctgtcccttttctggaacctggttgtatcgattattgaaagttgcaataaacggatttaa

SEQ ID NO: 1346 - DNA, 235 bp, Drosophila willistoni
  source 1..235: mol_type = unassigned DNA
  misc_difference 217: note = a, c, t, g, unknown or other
tagatgtactaacctctagtttctctatacttttgcctgctaccttggcattacatctaaaaaggtacaaacatcgcattggcaaaaagaggtggttttagtacataggcgctgtgggacttcattgtcccgatgatgcagcgaatcgtgcatacgagattgtccagtagttggttgctcgtatctttagaagatttccttcctcggcgatcaaaanaaaaaaaaaaaaaaaaaa

SEQ ID NO: 1347 - DNA, 162 bp, Petromyzon marinus
  source 1..162: mol_type = unassigned DNA
tgagaataatgaggtgctaacctccctgggcctgaccaaacccagaacacatcactggccaagatgatttcccgcagcacgttgcttttctctctcgatacccgagaatgttctgcggaactacgcagtctatgaacagtcacagacaacctctgatccaag

SEQ ID NO: 1348 - DNA, 257 bp, Schmidtea mediterranea
  source 1..257: mol_type = unassigned DNA
tagaagggaaacaaaggaaaaacgaaatgactggaaactatgaaggatatagctgaaagccgcaaggaaggctaagtcctgaaaccgatctacatcttcgatcccaagaggaactgtgggttaagcttgagccgacggaaaaagcgaatgcatgttagacgacgaggtacagtcacctcctcgtggtatttggcgggcaatgctcactaaattaactgtgagtagctgagaactgtatgtgtatcatgaaaaaaaaa

SEQ ID NO: 1349 - DNA, 233 bp, Tribolium castaneum
  source 1..233: mol_type = unassigned DNA
tgatgctcctttggttttaccatctgtgggggcatcggtcctcacggtttcctcgggtttcctattgtttttcctaaacccgacaaggagccctttggccctcctccttaaacacctctccttcatcctsttagtccattccggctaaaatgatgaagaccgaggagtgtcactctcttggcggggttaacccgtccaagtgtaaatgtgacctcgccattcgggctctgata

SEQ ID NO: 1350 - DNA, 214 bp, Megachile rotundata
  source 1..214: mol_type = unassigned DNA
taaatgtcgaaccgaattttgggtaacgtgcaccccaccatccttaatcggcagcacgcaataaagccgtgggcagtggttttagtgggtagtcattaggagtcccacagtacccagcgaacatcttagtgggtctgcgtaaacgcatttccactgcctatcctccgggaaaaaaaaaaaaaaaaaaaaaaaaaaaaaaaaaaaaaaaaaaaaa

SEQ ID NO: 1351 - DNA, 508 bp, Apis mellifera
  source 1..508: mol_type = unassigned DNA
tgatcgttaaaagtaaaaatctatttatttatttttattcctatattataacacattatttatttatttacttattgttttaaagatgacgaagccgcaaggccaatccaaatttaacaaaagaacgagactactggtcgacattaaaaagacgaagcagctgccagctgataaacaacagagcccgtctcggcctttacaccgagcggtgcaagtcctgacgtactattgtacgtctagggcgcggggcagattctaccgtgtagaatctggggcgacgcctccgcgaggcactccctggacaacgtacgctaaagcgtacggctaagtgcgcctcccgaaagggtccccgttcctaatttttccgagcccgcgggcagatctcgtggcagtgacgctagaaagttaagtccgcggacatataaaattacagccttaaataatgaaccccacgaaggaggtatcctcgaaattccgccacgatccttctgatcgtaggcgcaaaaca

SEQ ID NO: 1352 - DNA, 696 bp, unidentified
  source 1..696: mol_type = unassigned DNA; note = Description of Unknown:Nasonia vitripennis sequence
tgacctgaacaaaacgtgttgtcttgtcttgtctaaaactatttattcgaaataaggggaggctaactgcctgcaagttgaacgcgaaagttagaccttcccacctaaagcccaaaagtgatcggggaatgaatccgcgggtgaccccagagttgggtaaacccttgaaacgttggagaagcggaagagagtcccgccaccgagcatcgagtgctgcggcgcccgaatgaaaccgatcgcggatggtgcaagtcgtaggacggggcacgacctaagcctctgtcacggcggcgaagccaggaatcaccatgcaaaggtgtgaactggggcggatacctccacggggtttccctgggcatcgcgcgagcgatggccaaagtccgctttctcagctacaaaacaaaaatggtatgagacttcgttaacactaatttttccgagcctagcaggctcccttgacaacgcttatgaatctggaaaaggacacaaagtggaaaaagcgctgatggtggacaaaagtcagttgagacttgatatcagttgttttgactaagaattttattatcgttgacttttaaatattttattattgactgttaatatactgacttgggaccaagtcatctctgttacccggtaccggttcctgtcatcaaaccggaaagtccgtcccacgtaatgtggtagacgcaggag

SEQ ID NO: 1353 - DNA, 122 bp, Ciona intestinalis
  source 1..122: mol_type = unassigned DNA
tgacagtaatatgaaaacatcacatctgaccggcacagaatcaccatgccgtaatgcacccaactaaggattccaatgggtaaaaaaaaaaaaaaaaaaaaaaaaaaaaaaaaaaaaaaaaa

SEQ ID NO: 1354 - DNA, 112 bp, Nasonia giraulti
  source 1..112: mol_type = unassigned DNA
tagcggactggactgtctggaggagtgtttaactcgggttctcatgggaacccgacaacgttgttatcttgtatgacaattcataaaaaaaaaaaaaaaaaaaaaaaaaaaa

SEQ ID NO: 1355 - DNA, 345 bp, Lepidurus arcticus
  source 1..345: mol_type = unassigned DNA
tgataatcgctccatcctgcaactaattatgaatgcaaatctgttaagtgacattagtgatacttacctgatacttaccctggtatttatttgacctatacttaccctggtatctacctgacatatatttatctaaccacctacctatgatgactcccgcggaaactctcacttaccttattacccacttggtcttttattttctcgttccttattactttgttcctttggtgtagggttctctggtttttggaacggcttccttagccggaattttgtctgatgtatcttgcttgtgtccttgaaatatacgacccaggcttgcgtcatttaggctctgggaaa

SEQ ID NO: 1356 - DNA, 380 bp, Lepidurus couesii
  source 1..380: mol_type = unassigned DNA
tagtgcttgagtgatgcctatcctttctttgattaactcttaccatatacttaccagttcttacccgtacttaccctgtatacttacctgtgtgcgtacctgtgtacttgtcctttagccgccttgtgtttttaccattggtacttaccttgtgtggttgcccgatacttaccttgtatttgccttgtaattctgcatgatatttattgtgtaggttcctgatgcttacctgatttgtccccctcatcatctttagtttcgttctatttcactccattatggagttccgtttgttttttggtggaggtacagcaccctttaagctggaattgagtgagtttatgtactttggatggttgtaataaactacccggaggcat

SEQ ID NO: 1357 - DNA, 345 bp, Lepidurus couesii; identical to SEQ ID NO: 1355
  source 1..345: mol_type = unassigned DNA

SEQ ID NO: 1358 - DNA, 324 bp, Nematostella vectensis
  source 1..324: mol_type = unassigned DNA
tgatggtgggttactcgcctctgtgtaacaggcaaatgaaagctgcgcaagcagtcgatgagccaaagccgcacagcccccgactggggtacagggcagccctgggctatgcccgaagtcttttgacaggtccaaacttcacccttgccgccagtagggcaccagggccaggtgcaggtgggcgctttgttctatttggtttcgcttaatttttgttaaatttttcccgtgcgcccaccctttttaacccttttaacaccaattttttttacaaccctctactcaataatccaaatgaataaaagcggcataacaggtgaacac

SEQ ID NO: 1359 - DNA, 533 bp, Schistosoma mansoni
  source 1..533: mol_type = unassigned DNA
tagcccccttcactcttagacattcccccactgttgttgcttatcttcatgtttttgtgttaattgactgctctcttctgggttgatgtctgattgtctctctctctttccatattgcttgctctccccgcttacttccaatagttgtcatattatgtctttgtttacttgccatgtctaacgacaattactttatctaccttagttggtcctcttggtttggttgccttcatgtgttcatggcggaatctgatgtttataatgactattcctactaccaccattacaactattattattatcactattattaacattattattacttctacaattagtattatggctactcctttcagcacaccaataaaatctcaatcaaacatctcacttattaaactctctatttccccttcgttataaacttacaattcagtttaaccgaatatctctcttttacaaatcttaagtatgtaattttgtgccaagcccatttgggtctgtacaatttgatacttaaaaataaatgttat

SEQ ID NO: 1360 - DNA, 314 bp, Triops cancriformis
  source 1..314: mol_type = unassigned DNA
tagatgactgccctacccctttgctgccgaagaactactgaagactattgaactaaccaactgtgttaagtaagaactaatgcctctttttccctgcatgtatcccctgatcagtgacttattttcttttcctgttgcgccctttgtttagttatttcctttaattactagaattatcttttcgttctccgtctaattgctttttcggtgtaggaacggctacctaaagctggaagtgggaagtgttttcaatgtactttgtgattatagaaatatatgacccgaggtgcattgtttggcatttcctcgagaaa

SEQ ID NO: 1361 - DNA, 256 bp, Drosophila ananassae
  source 1..256: mol_type = unassigned DNA
tagccaatgcacgggttccagattaagcttgctgccgaagcataccatcaaaatcggcataaaattcgcttaataaaggaggtggttttagtacgtaggcgtcccgggacttgtctcgggatgaatcgtgcatgcgtataattgggatcgataacaaataccaactaagttattactaatatatcgaaatacataaatatcccgtccttacgtatctttgaagatttccatcctcagcgaacaaaaaaaaaaaaaa

SEQ ID NO: 1362 - DNA, 256 bp, Drosophila melanogaster
  source 1..256: mol_type = unassigned DNA
tagctaaatcgtttggttcaaaacatttgcttgctgtcttggcataacatcaataaaggcataaacatcgcaaaataatggttataattaaatggctatgaggatggttttagtacgtaggcgttgcggaacttcggttcatatagagcaatgaatcgtgcatgctaggaaaactgaccacacacagtgttggcagacctagtatctttcgaagatttccatacctccgcgatcaaaaaaaaaaaaaaaaaaaaaa

SEQ ID NO: 1363 - DNA, 203 bp, Drosophila persimilis
  source 1..203: mol_type = unassigned DNA
tagcctatacactatgttggagagaagacgcttgctacctaggcaaaatgtgaaattaggtataaacatcgtggttgtaaaacttgaggtgggtttttagtacgtatgcgtgattacttcgtaatcatgaatcgtgcatgctagtggggtttggcctccactagtatctttgaagattttccttcctcagcgatcaaaaaaaa

SEQ ID NO: 1364 - DNA, 219 bp, Drosophila pseudoobscura
  source 1..219: mol_type = unassigned DNA
tagcctatacactatgttggagagaagacgcttgctacctaggcataatgtgaaattaggtataaacatcgtggttgtaaaacttgaggtgggtttttagtacgtatgcgtgattacttcgtaatcatgaatcgtgcatgctagtggggtttggcctccactagtatctttgaagattttccttcctcagcgatcaaaaaaaaaaaaaaaaaaaaaaaa

SEQ ID NO: 1365 - DNA, 247 bp, Drosophila sechellia
  source 1..247: mol_type = unassigned DNA
tagctaaaacgtttggttcaaaacatttgcttgctgtcttggcataacatcaataaaggcataaacatcgcaaataatggtaatatataaattggctatgaggatggttttagtacgtaggcgttgcggaacttcggttcagatagagcaatgaatcgtgcatgctaggaaactgaagtgttgacagacctagtatctttcgatagatttccatacctccgcgatcaaaaaaaaaaaaaaaaaaaaa

SEQ ID NO: 1366 - DNA, 258 bp, Drosophila simulans
  source 1..258: mol_type = unassigned DNA
tagctaaaacgtttggttcaaaacatttgcttgctgtcttggcataacatcaataaaggcataaacatcgcaaaataatggttatatataaatggctatgaggatggttttagtacgtaggcgttgcggaacttcggttcagatagagcaatgaatcgtgcatgctaggaaaactgaccacacgcagtgttggcagccctagtatctttcgatagatttccatacctccgcgatcaaaaaaaaaaaaaaaaaaaaaaa

SEQ ID NO: 1367 - DNA, 242 bp, Drosophila sp.
  source 1..242: mol_type = unassigned DNA
tagcttaaaacgtttggttcacatacatctgcctgctgccttggcacaatatcaaaaaggcataaacatcgcacatattggttatttacggctatgaggatggttttagtacgtaggcgttgcggaacttcggttcggatagagcaatgaatcgtgcatgctaggaactgaccaaataacagcagccctagtatctttcgaagatttccatacctttgcgatcaaaaaaaaaaaaaaaaaaa

SEQ ID NO: 1368 - DNA, 221 bp, Kalotermes flavicollis
  source 1..221: mol_type = unassigned DNA
taatgtcccttttggcttgcccccacctgcttaaaggaactggcaggaaagagagtgatccgtgccatagaaatatggttatccggggcaagtcactagcaatatgggacttctccgggtccgtgcggtccttccaacatgagctggacgtagtccactctatgacttgaacgatacgggggcgtatctcccccggaagaggtcgcctaggcgacttagaa

SEQ ID NO: 1369 - DNA, 289 bp, Reticulitermes lucifugus
  source 1..289: mol_type = unassigned DNA
tgagttagatatatatgacgactgattcttccctaactaaaatataatttggaatgtgcattacttatactttattgtatttattgacatccgtagtagtctgtttagtggatttagatcgttaaccattctgtgacgtcgctgatgtctatatgtaccagtggcagaatgctgactaagaacaaaataattttaaacaatagacagcactaagaaattctgcaaactggaacgtggcccacggtaggccaatataccggaaagggaaaatgacacatccccccttaaa

SEQ ID NO: 1370 - DNA, 289 bp, Reticulitermes urbis
  source 1..289: mol_type = unassigned DNA
tgagttagatatatataacgactgattcttccctaactaaaatataatttggaatgtgcattacttatactttattgtatttattgacatccgtagtagtctgtttagtggatttagatcgttaaccattctgtgacgtcgctgatgtctacatgtaccagtggcagaatgctgactaagaacaaaataattttaaacaatagacagcactaagaaattctgcaaactggaacgtggcccacggtaggccaatataccggaaagggaaaatgacaaatccccccttaaa

SEQ ID NO: 1371 - DNA, 312 bp, Rhynchosciara americana
  source 1..312: mol_type = unassigned DNA
tagaaatgtgtgcgataaggtgtgaatagaagggttcaccaagagggagacctagtttggacctcagaaatggggtcataggagtgataggttgtaaagccgttggggaatccggctacacatggtatctcaggagccattcatgcgctgatctcattaaggcgtaataaactgtgaaacagatcctgataatgccgtgctaccaaatgatgtaacgaggcggaaataaaattaatctggggcgttctgcggaatgactactaaatatagcgatgctatatatacaaacgactgatggtaacaccggcctta

SEQ ID NO: 1372 - DNA, 1206 bp, Ciona sp.
  source 1..1206: mol_type = unassigned DNA
  misc_difference 1079: note = a, c, t, g, unknown or other
  misc_difference 1181: note = a, c, t, g, unknown or other
taagatccgcggctgtggcgccgaacgagcacctgcccattcttcttgtagggactttttcaccctcactccccccaatagttttttttcgttttttcgttttttcacccccaccccactcgcctctgggctgcacatcccacacgtagggacctgtttatattatttgccttttatatgtaccactttttaaatatatttttgtaccccacaagatgcttttcgccaaaaaaaaaaaatttttgtatcacatttttatattttgtaaaacacagatttttataaactttgcactatttttatataaacttcgcacttatttaaaatgaatcgcatcttttttatatacaccaacacaaacaggatgtgcagctcaggggaaccaatcctgcgtccctcctagcggcgggaggggcgcccacctacccccacgctcctcttgagcaccaacagggactcccttccggagcccctgcaccctcaacttttcttatttttaaaaaaaaaaaatcatatatattgatcttgacgacgggggctacattcagcccccaaaaacccacccaccatccccaacgagtgccggggcattgaagagctccggcacaattagcacttagcttatttattattttttgtcaacatttttgttttttcaaattttttcacccctcacccccaccctaataggtccctcgggcttgggcccctttttcgtgctcgagaagcgtcacatcgccccactgaccacgaccttccccgacattggagtccttggcgtctcccaggtcgaaacagtcccaagtgatagcacctaatgctcgacttgtttcggcctgggccgccgaggattcccagaacgaccattcttctaaataatatttatatttcagaataaaactatatatatatcgttggcgggacttgtcccgcctcgataccgagtgctgcagagcggcaaaataaagaagaaaccgacgtcgctctgcagccaaggaccacccaaactcaagccagcaccgtcgacaaccaacatcctcaagtcggcggttgctggaacaactcataacatcttcaanataaattatcaccctgtgcagcaggaggccgtgcttttaaaactactctgtagtggctcatgataatatttcgctccttttttgccccgtgtaaacttagtngatgcgaataaaatcagttgaatca

SEQ ID NO: 1373 - DNA, 128 bp, Bombyx mori
  source 1..128: mol_type = unassigned DNA
taaaaactagcataattattaactcataactaatgtatattacttggccaaaagcccgtatatacagttccaccggctctgtcgacagactgaactgagaaaggggaaacatatggaaataataataa

SEQ ID NO: 1374 - DNA, 204 bp, Anopheles gambiae
  source 1..204: mol_type = unassigned DNA
taacatccggtgcaaactcattaacattaagaaaagagagaggagaaatgagaatgagattcattcacctttggcatttgaatagcccggggtaggtgaaaagttcccagcatattgctgagaagtgacaaaattcggataataataataataataataataataataataataataataataataataatatgcataataata

SEQ ID NO: 1375 - DNA, 474 bp, Bursaphelenchus xylophilus
  source 1..474: mol_type = unassigned DNA
taagaaaagcatgaaataataagaaatcagataagaataacaagaatactaataagtatatcatgtaactatgacaaaaagaacgcaccaataagaacatgcttgagtggccagctctgcaggcaaaagtcgaatttggaacagccggtaatggaagacctgcaacaaacgtggggtagcaggcaatatgtaactatgacagaccaaaactccgaaactctggtaatgagcccgtgccccccaagcatgtggtctcgttcgatgtagttaggaacagttctctttaacccgtgatgattacgccctgtcttaaatggcaggtgccaccaaataccgaacactcgttgaggtatggtggtccgaatgtgaagctgggagtacaatttggtacgagagcaccagcgcccccgatctaagtgatgacgcatgcgtcggaacaatgaagacggctggcaaacattcaggagtcgcaaa

SEQ ID NO: 1376 - DNA, 31 bp, Heterodera glycines
  source 1..31: mol_type = unassigned DNA
  misc_difference 11: note = a, c, t, g, unknown or other
tgaggactcanaattgacaatacacctcaga

SEQ ID NO: 1377 - DNA, 106 bp, Parhyale hawaiensis
  source 1..106: mol_type = unassigned DNA
tgagccttaggtcgcgggatgtgacccggcgccagagtgtagagctgaacatcgctcaaccgatccaatttgggtcgtgaaatcccctcgataataataataataa

SEQ ID NO: 1378 - DNA, 651 bp, Bursaphelenchus xylophilus
  source 1..651: mol_type = unassigned DNA
taacaagtgtaataaaaaccacccatgcgtagtaaaccgatcaattatctagcaaaatcgcaggtcagaagaccaaagaaccgacccagaggaataggaccagagctgaaactctcagatacgccaacggtcctaataaaacgtcgttaagtaaagcatcgttaagtacaaaacaaaagcactgtaaacgcgaggccccctctttgccaaactccggtaatcctcgtagtacggtgctttttcccgcttcacgaatcagaacgctgccagatcttgtccgacatgggccgtagggtttgggagtaccagcgtggggcggagagcgtacctgggtacactgcataatcgggtctcagaaaaccacctatggtttattattctgtctcccatctgcagggtagcttttcgttgggccataggagcctaggggcaagagtgcatgtagtcttcaacggccatgccagggaaacttgtgagaggtgagggataactagcatcagataatatcagtcatgaaattagtaacaaccaacgttcaccgtcgttggcaaaacaccgactaacgatgctagttagaaagagtcgggtcttcccaaagttaggtgcttgcaccgaagccgatccgctctacccacagctctgcccagcgtt

SEQ ID NO: 1379 - DNA, 406 bp, Heterodera glycines
  source 1..406: mol_type = unassigned DNA
tagtcgtagcccagatgtcgacagcccctacaccggtagatggaaggaggtatgtatctaagcccacggcaagccaccagtggaaacggtgaccacctctgttcgcggaaatgccccgtagagtatatgaaggtcggagcattgaagcacaagtgagaaccctggaagtatggtggtgagctggtaacctcgaattcctcctatgggtgcttgcgcccgtaggtcatttgtgtatgtagggatggaaggaatctcgatagcgcaaatcgggataccgcactggcgatcatgctgccagtgggccctgctgagttgggcgggttagcaacccgtccagggacgcagatgccaaaagcctggtgacactctaaagggagtctacggcgacgagaacatcccctaagtc

SEQ ID NO: 1380 - DNA, 99 bp, Strongyloides ratti
  source 1..99: mol_type = unassigned DNA
taattagatttatatgtgccactttacctcaaagatatattaatactaacttaattataatttattatgaattataatataataagttttaaaataaaa

SEQ ID NO: 1381 - DNA, 587 bp, Bursaphelenchus xylophilus
  source 1..587: mol_type = unassigned DNA
tgagaccacccatgcgcagagtatccgaatcagtgaaagtccaagtttcaggacagaaacgtcagataagtccaagagaaacgagaaaacaagttcaagtatgcaagagttaatcaataagagagtaccgtaaatgtatgacccccccctttgccaagtcgacaactgtcatgcaggtgtctctcttttcacccgccatatggaccaaacgctatccagcctcgctcagaagagccttagggctggggagtaccacatgtggcggaaactgaatctggatgcgatgcataccgggagcgcagcgaaatcacttaacgctggtgcacctcctgctatcgtagtacttcctagatagatgagtagggtgggctaaaggtagtcgtcttcaatggcaataccgaggggtctcgtgacaggtgagggataactagtatcagataatatcagtcatgaaattagcaacaaccaacgtcaccgtcgttggcaaaacaccgactaacgatgctagttagaaagagtcgggtcttcccaaagttaggtgcttgcaccgaagccgatccgctctacccacagctctgcccagcgtt

SEQ ID NO: 1382 - DNA, 364 bp, Bursaphelenchus xylophilus
  source 1..364: mol_type = unassigned DNA
taattaggcagtgctcctagcggagtgccgtgaagtggtgtcagtacccgtcgtgtggaaagcccaggagggttagtaccgacagtgggaaacccgctgcacgcaacctaaagacatttgcccttcgggggagaggtatgagaccacactagtcatggttgcttgcgcaagcatgactcattcattgtaagttcgtattatgaggcctcgcggaatgcgaaagtccaagagcgccaacttgtctctttgggaggttcctccgggttccttagggttggcgtaccatgcttcgtgtgagacctaggccgcttggacctagagttaagctgttgcatgtttgaggatgccttaggcggacgccatg

SEQ ID NO: 1383 - DNA, 177 bp, Ascaris lumbricoides
  source 1..177: mol_type = unassigned DNA
tagtcgctaaggggtccggaaatggtccggtcctgcgctacccggttctggtagcacgttcaagcgctcaatcgcctgccttgtaggcagtccatctgtggaagtcgcgctcttgatacagatgtggacggatggaagcagatgatagagccggtgacggccctactagccaaacgc

SEQ ID NO: 1384 - DNA, 160 bp, Heliconius melpomene
  source 1..160: mol_type = unassigned DNA
taacttattgtcagaattccttactagtaataataattatcgctgaaaatctccacccaaatattgcttggctatatgctcgcaatttttggttaacgtaccccaatgatttgggagaacaaaaatggtaaaactataataataataattatattaatat

SEQ ID NO: 1385 - DNA, 84 bp, Takifugu rubripes
  source 1..84: mol_type = unassigned DNA
tagaggacccgagtctgaaggaaggaggcaccgcccaggagggcgaggaagagatttttttttatatatatatatatatatata

SEQ ID NO: 1386 - protein, 1365 aa, synthetic construct
  source 1..1365: note = Description of Artificial Sequence: Synthetic polypeptide
VGLCPSPGVDGTHQPNDSFQNFGETNFSVQVARLVTRNLAPRSVRGNGFGSGMATHPVPADESGHESDPFLVGRSCGQPARLTRQSVGTQTSRDDILPSKTTKLTENELDLLVNFSLELYRSDLQGFVQEGIHFSVNREVLEGFPEVYEQPAPQPAVGDDLNTSLPPDNNICVLEKGSSEAVEDGTPEVAHPVPETQGKESPNNIVMVTLPNKNPPCPCCRVRLHSVLALIEHLKGSHGKKRACFRCVKCGRENFNYHSTVCHIAKCKGPKVEKAPVGEWICEVCGRDFTTKIGLGQHKRLAHPLVRNQERIDASQPKETSNRGAHKRCWTKEEEEMLIKLEVQFEGHRNINKLIAEHLTTKTSKQISDKRRLLPRKQLTDLSKGVAGQKVLDPGLSHQPQLGVVDNGLGGGHLPGGPAAEGRTIEPLGHHLDKDNGHREIADQHKAGRLQAHYRKKIRKRLSEGMISNFPEVFEQLLDCQEAQPLINQAAQDCFGCLDSASQIRKALRKQNTQKDQGDQPKRPAQKWMKKRAVKRGHFLRFQKLFHLDRGKLAKIILDDVECLSCDIPPSEIYSVFKARWETPGQFAGLGDFEINRKANNKAFRDLITAKEILKNVREMTKGSAPGPDGIALGDIRKMDPEYTRTAELFNLWLTSGEIPDMVRGCRTVLIPKSSKPERLKDINNWRPITIGSILLRLFSRIITARLTKACPLNPRQRSFISAAGCSENLKLLQTIIRTAKNEHRPLGVVFVDIAKAFDTVSHQHIIHVLQRRRVDPHIIGLVKNMYKDISTVITTKKNTYTDKIQIQVGVKQGDPLSPLLFNLAMDPLLCKLEEHGKGFHRGQSKITAMAFADDLVLLSDSWEDMNANIKILETFCDLTGLKTQGQKCHGFYIKPTKDSYTVNNCAAWTINGTPLNMINPGESEKYLGLQFDPWVGIAKTSLPEKLDFWLERIDRAPLKPFQKLDILKTYTIPRLTYVADHSEMKAGALEALDRTIRSAVKDWLHLPSSTCDAILYTSMKDGGLGVTKLVGLIPSVQARRLHRIAQSPEETMKDFLEKAQMEKMYEKLWVQAGGKRKRMPSIWEALPEVVPSIDTATTSEWEAPNPKSKYPRPCNWRRKEFKKWTKLIAQGWGIRCFKGDKISNNWIRHYRYIPHRKLLTAIQLRASVYPTREFLARGREDNCVKSCRHCEAAEESCAHIIGMCPVVRDARIKRHNRICERLMEEAGKRDWTVFQEPHIRDVTKELYKPDLIFVKEGLALVVDVTIRFESTKTTLEEAAAEKVNKYKHLETEVRNLTNAKDVIFMGFPLGARGQWYNKNFELLDTLGLPRSRQDIIAKTLSTDALISSVDIIHMFASRGRRQHA

SEQ ID NO: 1387 - protein, 1343 aa, synthetic construct
  source 1..1343: note = Description of Artificial Sequence: Synthetic polypeptide
NKFLGKSRVAYCLKPGPPVSDRGKEFGSGLTTHPEPESESGHDPTVPNPGPSLGAGEGAQPLPLLRVSVGTQTCEEDFITSRPTKLPGIESELGPLVKFSLEVYRSDLKGDVQFEGIHFPDNWGVLEGFPEVYEQLAPQPNGGDELNHSLPGDREGDVLEKDSSEKEKEAAPEALPSVQRARSEQLPDNIVKVTVPDKNPPCPCCGVRLNSVLALIEHLKGSHGRRRVCFRCAKCGRENFNHHSTVCHYAKCKGPQIERPPVGEWICEVCGRDFTTKIGLGQHKRHMHAMVRNQERIDASQPKETSNRGAHKRCWTKEEEELLMKLEVQFENHKNINKLIAEQLTTKTAKQISDKRRMLLKKGRGTTGNLETEPGMSHQSQAKVKDNGLGGDHLPGGPVVDKGTIGKPGQHLDTDNSHQITAGKKKGGGLQARYRRRIMKRLAAGTINIFPKVFKELINDQEARPLINQTTEDCFGLLDSACQIRTALREKGKSQEERPRKQYQKWMKKRAIKRGDYLRFQRLFHLDRGKLARIILDNTESLSCDISPSEIYSVFKARWETPGHFNGLGDFEIKGKANNKAFRDFITAKEIEKNVREMSKGSAPGPDGIALGDIKKMDPGYSRTAELFNLWLTAGDIPDMVRGCRTVLIPKSTTPERLKDINNWRPITIGSILLRLFSRIITARMTKACPLNPRQRGFISAPGCSENLKLLQSIIRTAKNEHKPLGVIFVDIAKAFDTVSHQHIIHVLQQRRVDPHIVGLVNNMYKDISTYVTTKKNTHTDKIQIRVGVKQGDPLSPLLFNLAMDPLLCKLEESGKGFHRGQSSITAMAFADDLVLLSDSWENMKENIKILETFCNLTGLKTQGQKCHGFYIKPTKDSYTINNCPAWTINGTPLNMINPGESEKYLGLQIDPWTGVAKYDLSTKLKIWLESIDRAPLKPLQKLDILKTYTIPRLTYLADHSEMKAGALEALDQQIRTAVKDWLHLPSCTCDAILYVSTRDGGLGVTKLAGLIPSVQARRLHRIAQSPDETMKDFLEKAQMEKMYEKLWVQAGGKKKGMPSIWEALPMTVPPTNTGNLSEWEAPNPKSKYPKPCDWRRKELKKWTKLESQGRGVKNFRNDTISNDWIQYYRRIPHRKLLTAIQLRANVYPTREFLARGRGDNYVKFCRHCEADLETCGHIIGFCPVTKDARIKRHNRICDRLCEEAAKREWVVFKEPHLRDATTELFKPDVIFVKEDRALVVDVTVRYESAKTTLEAAAMEKVDKYKHLEAEVKELTNAKDVVFMGFPLGARGKFYKGNFNLLETLGLPKTRQLSVAKTLSTYALMSSVDIVHMFASRSRKPNV

SEQ ID NO: 1388 - protein, 1193 aa, synthetic construct
  source 1..1193: note = Description of Artificial Sequence: Synthetic polypeptide
MESTAKGKSYWMARRPVEGATEGSLGRVPFVTRDPKRKPEAKRTLTHGLGLRECSVVLTRLIEGRRGRDHTPSGWNAQRGMPNDESSVEEPNGPIPSNPIPTGTQALPEPMADGEQGEHPGVVVTLPLRDLNCPLCGGSASTAVKVQRHLAFRHGTVPVRFSCESCGKTSPGCHSVLCHIPKCRGPTGEPPEKVVKCEGCSRTFGTRRACSIHEMHVHSEIRNRKRIAQDRQEKGTSTDGEGRAGVERADAGEGPSGEGIPPKRPRRARTPREPSEPPANPPILSPQPDLPPGGLRDLLREVASGWVRAARDGGTVIDSVLAAWLDGNDRLPELVDAATQRTLQGLPAGRLARRPATFVAPNRRRGRWGRRLKLLAKRRAYHDCQIRFRKDPARLAANILDGKSETSCPINEQAIHEHFRNKWANPSPFGGLGRFGTENRANNAHLLGPISKSEVQTSLRNASNASTPGPDGVGKRDISNWDPECETLTQLFNMWWFTGVIPSRLKKSRTVLLPKSSDPGAEMEIGNWRPITIGSMVLRLFTRVINTRLTEACPLHPRQRGFRRSPGCSENLEVLECLLRHSKEKRSQLAVVFVDFAQAFDTVSHEHMLSVLEQMNVDPHMVNLIREIYTNSCTSVELGRKEGPDIPVRVGVKQGDPLSPLLFNLALDPLIQSLERTGKGCEAEGHKVTALAFADDLALVAGSWEGMAHNLALVDEFCLTTGLTVQPKKCHSFMVRPCRGAFTVNDCPPWVLGGKALQLTNIENSIKYLGVKVNPWAGIEKPDLTVALDRWCKRIGKSLLKPSQKVYILNQFAIPRLFYLADHGGAGDVMLQNLDGTIRKAVKKWLHLPPSTCNGLLYARNCNGGLGICKLTRHIPSMQARRMFRLANSSDPLMKAMMRGSRVEQKFKKAWMRAGGEESALPRVFGANQYQEGEEVANDLVPRCPMPSDWRLEEFQHWMGLPIQGVGIAGFFRNRVANGWLRKPAGFKERHYIAALQLRACVYPTLEFQQRGRSKAGAACRRCSSRLESSSHILGKCPAVQGARIRRHNKICDLLKAEAETRGWEVRREWAFRTPAGELRRLDLVLILGDEALVIDVTVRYEFAPDTLQNAGKDKVSYYGPHKEAIARELGVRRVDIHGFPLGARGLWLASNSKVLELMGLSRERVKVFSRLLSRRVLLYSIDIMRTFYATLQ

SEQ ID NO: 1389 - protein, 1454 aa, synthetic construct
  source 1..1454: note = Description of Artificial Sequence: Synthetic polypeptide
MLRGGVGTPPAGGAGAVGPGMASPGGCSVRFSPGGRRLLGHRTGGLSPSVSWRLKRLSVSLRRWSGPGLLGADGAGGGAAVASPRGTQVLGSGAGRRWLGHGSRGSSPSAARGLRRLTVRLKRLSGGLLSPKACRDAEEGSSSSPGFRNPKGLGGRGLTPLGSRRFCRLTVSLNRWRGSLVKLNASSRASGRRTPVKPACDSRAGRGSEHAEGGGVSAAPMVLRSRRKLTFSVDGDSNSGDRARSGSVSAARPGHLLVDGESASSRSGPAGDARLAGPSTRSRRKGCLPPVDFENPKKRTRLMAKMTNGNPTSHVPCPAPCSNGHEGGGRVAVIEGRLPELSGSRISGIQPALPVETSFVGQSTGRGADGDANANSSPPSPNLGGSVGMVPAVRDGTPPLGRPGEDHSRECAGGNTPLWMLEDSFRCDYCPREFGTRAGRSLHMRRAHLAEYDGAGFCWGERLSEFAATRLWSTEETKKLAVFCERGVPSPSECRAIAASLGAGKTHHQVRSKCRLVFEAIRRRELLEVAAATERLEKSARRKQPAVPPAPVHGVRGVLRGLLGKRVPREGGTTGSTSARIVRRDDCRQGAVASASLNLIRRLGRKATGRSGRRRVLGRPPRMDVRRSVRMRRMRRFLYRLARLGWAKLAMFVLDGQMGASCPVPLVEVSAVFRERWSIVRAFLGLGQFGGFGTADNAGFGKLIDPAEVRAHLQSIKNRSSPGPDGITKVALSKWDPEGIKLAHMYSTWLVSAGIPKVFKKCRTTLIPKTGDVSLHGDVGQWRPITIASLVLRLYSRILTERMTVACPSHPRQRGFIASPGCSENLMLLEGCMSLSKAGNGSLAVVFVDFAKAFDTVSHEHLLSVLVQKGLDQHMVELIKDSYENSVTKVHCQEGCSTDIAMKVGVKQGDSMSPLLFNLALDPLIQQLEREGRGFPVNGKSITAMAFADDLAIVSDSWEGMRANLDILVDFCELTGMRTQPSKCHGFLIEKSGSRSYKVNRCEPWLLNDTALHMVGPKESIKYLGVQVNPWTGIFAEDTVAKLRQWVVAISKTPLRPLDKVSLLCQFAVPRVIFVADHCMLSAKALTEMDRSIRQAVKRWLHLARCTTNGLLYSRKSSGGLGIPKLSMIVPAMQARRLLGLSRSKDETVRWMFLETTDHVAFERAWLRAGGSPDEVPELGPDLVEGSPAEGNADPVSTVRPRKRIVPCDWRQVEFDRWAGQLVQGKGIRTFEADKISNCWLYDYPPNKLKPGDFTAAVQLRANVYPTRELAGRGRTDTIDVCCRHCGEAPETCWHILALCPKVKRCRIQRHHKVCQVLVAEAERHGWEVEREKRWMLPSGECVAPDLICWLDELALIVDVTVRYEFDEESLERARIEKECKYRPLIPVIRASRVQTKKVTVYGFPLGARGKWPAKNELLLADLGLSKARTRSFAKLLSRRVLLHSLDVMRTFMR

SEQ ID NO: 1390 - protein, 1114 aa, synthetic construct
  source 1..1114: note = Description of Artificial Sequence: Synthetic polypeptide
MMASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAVEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPILIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGKQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 1391 - protein, 1160 aa, synthetic construct
  source 1..1160: note = Description of Artificial Sequence: Synthetic polypeptide
MNLLIVTSSIKESDVPSSGKGGVAVNNITAGASGKDTCVIIHPGTDGIWCCTECVEIHNSGKDLKRHLAKRHPSVTISGYKCNLCPFVSERQLSVGTHLRYCRGVKEVVKREFACASCSFSSDTFSGLQVHMQRKHIAEWNDQLKEKTEFAWTDRELRELAEKELTTPSFRYNKIFYAALGTSRTYDAVRKIRYNDRYKSAIAEMRSQIADAAAAAQERDVERGLVSAHSDRGKEMLPVVETKSDIQVNNDIKKDIELTPNSRQKQTNLALARPAVIEVEEDLGRQDVKQYLASLRQDDYTSPAERSIFAYCREETNWSATKRQVLKISRTTRGLRQPKKVRPFEFPEGFKPNRNMRKWRKYRFLQECYREKRAETVSKILDGTFIDEPEEEIRPELEEVQRMYIDRLEKRTQLDTTKIVQTDEVFCLQSYGRITIGEVRDALGASKKDSASGPDGLLLQDVRRLGPLLLCNIFNMWYLHGIPVEENRCRTILLYKSGDRHLASNYRPVTIGNMLNRLYAKIWDKRIRKNVRLHVRQKAFIPVDGCFENVKTIQCVLQSYRKRKLEHNVVFIDLAKAFDTVLHDSIRKALWRKGVPSGVVKVVDSLYAGAVTSISVGKTKTRSICINSGVKQGCPLSPLLFNLILDELAERIEATGCGLDLDGHVLSSMAFADDYVLLAKDSVEMNELIRVCSTFFKEKGLSVNPGKCQSLRVLPVKEKKRSMKVLVRPHRWWRIKDQDVDIPSMTYDSLGKYLGVSIDPTGKIALPIEEWKNWMTKLKECKLKPEQKVKILKEVVCSRVNYVLRMSECGISELRSWTRFVRNWAKNIIHLPTWCSSDWIHSIKGLGIPDVSKGIVIQRMRASEKMSTSEDGIVRVVGARLVQKNRVLWEKAGFEGIELKAARRHCEVERLNNIGNITNGVALKTIAAVSSVNRYWMIEDNLKSGNKILVWKAMAGAIPTKINLSRGVADQTLKKCRRCGLTAETDGHILAGCHTSSDAYSKRHNMLCDKLAKELKLNGGPNRRVWRERTCFTSTGRRYRPDIIVKDDSKITVIDMTCPYEKSEGHLIQCESAKVTKYEPLKLDKYWTRELEGANGIVAEKVELMGLAIGAIGTIMRSTLRKLCELKSGRIVRRLQMIACNNSAQIIKGHLSRATRRNLR

SEQ ID NO: 1392 - protein, 1158 aa, synthetic construct
  source 1..1158: note = Description of Artificial Sequence: Synthetic polypeptide
MSNRITIGDVPSVGKGGLTVNKQTAGADGAEACVVIHPGAKGIWSSPACLRKFTIGKELRAHLAQIHKLAPSAVRYRCNKCPYEGDVQLSVGTHLRYCKGIAGVVEEKKQFACAICNFSSDTFSGLQVHKQRKHVVEWNEQLKEKTEFAWTDRELRELAVKEVTIPFSVVNTETFAVLDITTRTKDAVRKIRYTDRYKSILAEVRAQVNAVAEEAPQASDESQITLLVNTGRGAELQPAVINITDSIELVTDVNEVEMVTSNSTNEEQPINAPVEPAVIEADLGRQDAKLYLASLRQSDCTNASDRWTLAYCRGEVDWCKTKSRLFKVSRHARGLRQPQRVENWEFPEGFRPNRNLRKWRKYSFLQSCYRTKKKETVSKILDGTFKDTPEEEIRPELEEVQRVYVDRLEVRTQLDTTRTVHIDERFDLVSYGRITIREVQDAISASKKDASGGPDGLLLQDVKKASPRQLCIIFNMWYLHGIPVVENRCRTILLHKGGEKHLTSNYRPVTIGNMLNRVYAKIWDRRIRKNLQLHVRQKAFVPLDGCFENVKTIQCILQSYRRSRREHNVVFVDLAKAFDTILHDSIEKALLRKGIPRSVIKVVDSLYAGAVTSITVGKTKTRPICINSGVKQGCPLSPLLFNLVIDELAERLEATGCGLDLEGHVISSMAFADDYVLLAKDSVEMNVLMNVCNTFFEEKGLAVNPAKCQSLRVLPVKGKRSMKVLTRTHRWWKINNQDVEIPSMTYESVGKYLGVMIDPAGKIALPIEEWKLWLTRLRECKLKPDQKVKVLKEVVCARANYVLRMSGCGICELRKWSRFVRGWVKSIIHFPAWCNSEWMHSSKGLGIPDVVSGIVIQRMRAAEKMAKSTDGVVRVVGARIVQTNRVLWKRAGLAGIELDAARKFCEVKRVNKIGNQTNGGALKTIAESSVSRHWLLEKNIRPGNKILVWKAMAGVIPTKINLSRGVADQTLKKCRCCGLTAETDCHILAGCPTSRDAYSKRHNLLCDKLAKELRLNGGPSRRVWRERMCLSGNGRRYKPDIVVKDDGVITVIDMACPYEKSERHLSQCEDAKVAKYEPLRLDRSWTQELEGNNGRSANEISVVGIAVGAIGTITRKTQRILSKLKLAKVGRPLQIIACNESAQIIRRHLSGSRLRNLR

SEQ ID NO: 1393 - protein, 1102 aa, synthetic construct
  source 1..1102: note = Description of Artificial Sequence: Synthetic polypeptide
MNLPIREHAVSVHNINKFNYLCQLCSKSYDTINSVKAHYVACRRQKNASSTTAVPTNVINNNQLAINTNQVISRNPLQCVECLMKQVDFYAKDTKALVTHMRTKHAAAYEESKKVATRRVAWSPDEDQILAELEVKLKKIQKGQLLSRLVVEYNKCADKSKAPSRSKDAIRTRRQQHDYKLLLRSLQSQQPPVGSEDSDSDISSSNNNPLTTTHNVTPTPDSSNVVLLIQKIRESVDSIVKITNLKLNTNMLNAASAFINQNNNMDPLELSMRGIEEDVKAIRDKELQKPTRNVPSSTTSRKPTRNAKRLEKSKKYGYYQHLYYNNKKKLVAEILDGETSGAKPPPMNLVEDYYRNIWSRSTIDDSPVNNIKTVNSDSIFAPISRDEIKLALSNTKKDSAAGPDAVTIKEAKAIIDNLYVAYNIWLGVQGIPEQLKLNKTILIPKGNSDLSLLKNWRPITISSIILRVYNRLLAYRMNKIFKTNDKQVGFKPVNGCGINISWLHSLLKHARLNKNSIYACLVDVSKAFDSVSHQSIVRALTMNGAPSLLVKLIMDQYTNVNTVITCSGSISNKINISSGVKQGDPLSSLLFNLVIDELFDVIKDQYGYTIDNIGTTNARCFADDLTLISSSRMGMNKLLELTTKFFKERGLNVNPSKCMSIGMSKGYKGKKSKIESEPLFSITDAQIPMLGYIDKTTRYLGVNFTSIGAIDAKRIKKDLQDTLDKLEHLKLKAQCKMDLLRTYMIPRFMFQLIHTELYPKLLIKMDILIRKLAKRILHLPISTSSEFFYLPFKEGGLQLTSLKEAVGLAKIKLHKKIMSSNDPMLCYLIESQRSRIVEHFMKDLKLGDSLTLNEMNNIKECFMKEKRISFAQKIHGVGFEVFSSSPLTNQWINGEIKTMTTKTYINSIKLRTNTLETRVTTSRGLNIIKTCRRCHVADESLMHVLQCCSSTKGLRYSRHHKICAKVANKLVMNGYGVFREKSYPDPNNSGSYLRPDIIAVKNGHVIVLDVTVVYEVTGATFINAYQTKINKYNAIMVQIEQMFNCVNGELHGLVIGSRGSIHHSQLHIWHQMGFSSIELKYVAIGCMEDSLRIMSTFSKAIT

SEQ ID NO: 1394 - protein, 1276 aa, synthetic construct
  source 1..1276: note = Description of Artificial Sequence: Synthetic polypeptide
MGTDTVYVGQDYPSGLSKRVPARLVAGPMLRERSCHAHVFRAGHMWNWRTSLPSGRWDQPALEKSRVLTRSVATATDPEITSYPGKSVSTSTQVQEEDWCSRESGWISPGLAPEEPSVVSEITASMVATMRVATEEVVLEPQPEQVVTILPEHGRNVPPGLAEQDTASPIEVSVLLPDLAENCPLCGVPSGGLRLLGKHFAVRHAGVPVTYECRKCAWRSPNSHSISCHVPKCRGRARMPSGDPGIACDLCEARFATEVGVAQHKRHVHPVEWNKVRLERRGARGGGIKATKLWSVAEVETLIRLIREHGDSGATYQLIADELGRGKTAEQVRSKKRLLRIDTASNSPDDAEVEEERLESLAVRSSSRSPPSLVATRVREAVARGESEGGEEIRAIAALIRDVDQNPCLIETSASDIISKLGRRVDGPKRPRPVVREQTQEKGWVRRLARRKREYREAQYLYSRDQARLAAQILDGAASQECALPVDQVYGAFREKWETVGQFHGLGEFRTGARADNWEFYSPILAAEVKENLMRMANGTAPGPDRISKKALLDWDPRGEQLARLYTTWLIGGVIPRVFKECRTKLLPKSSDPVELQDIGGWRPVTIGSMVTRLFSRILTMRLTRACPINPRQRGFLASSSGCAENLLIFDEIVRRSRRDGGPLAVVFVDFARAFDSISHEHILCVLEEGGLDRHVIGLIRNSYVDCVTRVGCVEGMTPPIQMKVGVKQGDPMSPLLFNLAMDPLIHKLETAGTGLKWGDLSIATLAFADDLVLVSDSEEGMGRSLGILEKFCQLTGLRVQPRKCHGFFMDKGVVNGCGTWEICGSPIHMIPPGESVRYLGVQVGPGRGVMEPDLIPTVHTWIERISEAPLKPSQRMRVLNSFALPRIIYQADLGKVTVTKLAQIDGIVRKAVKKWLHLSPSTCNGLLYSRNRDGGLGLLKLERLIPSVRTKRIYRMSRSPDIWTRRMTSHSVSKSDWEMLWVQAGGERGSAPVMGAVEAAPTDVERSPDYPDWRREENLAWSALRVQGVGADQFRGDRTSSSWIAEPASVGFAQRHWLAALALRAGVYPTREFLARGKEKSGAACRRCPARLESCSHILGQCPFVQANRIARHNKVCVLLATEAERFGWTVIREFRLEDAAGGLKIPDLVCKKADTVLIVDVTVRYEMDGETLKRAASEKVKHYLPVGQQITDKVGGRCFKVMGFPVGARGKWPASNNTVLAELGVPAGRMRTFARLVSRRTLLYSLDILRDFMREPAGRGTRVALIPAATGAAN

SEQ ID NO: 1395 - protein, 1168 aa, synthetic construct
  source 1..1168: note = Description of Artificial Sequence: Synthetic polypeptide
GIDGYMFGYARASGSTSVSIQSSSMTEGETNERATPRASDSSSVSIQSSCVTEGECLPPTDNCNPSVENQLPCVTEGRFERVGSLVTVRLPFRKVACDLCSKEFLTYSKFAVHQANFHNSETQACCTYCGKSDGNHHSIACHVPKCPWRRTVTFAANLSNFLCDLCNDSFKTKSGLSQHKRHKHPCSRNAERILSLGVRTPSARPRQVVWSEEETRTLREVEVVYSGQKNINVLCAGHLPGKTSKQVSDKRRDLHRIRSSNVHGTPTTQSRGDPVEQVEEYEELDWEGMHPFPDPDSKFCSYLDQLRDQKGLTEPVWQEIEIVAQEWVENLAHVQSSWNHERTTKQVPENNTPARRPFKRRLHRVERYKRFQRMYDLQRKRLAEEILDGREAVTCNLKKEEIKDHYDQVYGVSNDRVSLDDCPRPPGANNTDLLKPFTPTEVMDSLQGMKNGAPGPDKITLPFLQKRLKNGIHVSLANVFNLWQFSGRIPECMKSNRSVLIPKGKSNLRDVRNWRPITISSIVLRLYTRILARRLERAVQINPRQRGFVPQAGCRDNIFLLQSAMRRAKRKGTLALGLLDLSKAFDTVGHKHLLTSLERFAVHPHFVRIVEDMYSGCSTSFRVGSQSTRPIVLMRGVKQGDPMSPILFNIALDPLLRQLEEESRGFMFREGQAPVSSLAYADDMALLAKDHASLQSMLGTVDKFCSGNGLGLNIAKSAGLLIRGANKTFTVNDCPSWLVNGETLPMIGPEQTYRYLGASICPWTGINSGPVKPTLEKWIANITESPLKPHQRVDILCKYALPRLFYQLELGTLNFKELKELDSMVKQAVKRWCHLPACTADGLLYSRHRDGGLAVVKLESLVPCLKIKTNLRLVHSTDPVISSLAESDGLVGAIEGIAQKAGLPIPTPDQRSGTYHSNWRDMERRSWERLALHGQGVELFKGSRSANHWLPRPVGMKPHHWVKCLAMRANVYPTKRGLSRGNLSKNKDSAKCRGCTSMRETLCHLSGQCPKLKSMRIRRHNKICEHLIAEASFKGWKVLQEPTLVTDNGERRRPDLIFHRDDKAVVVDVTVRYEISKDTLREAYASKVRRYGCLTEQIKDLTGATSVVFHGFPMGARGAWFPESSDVMADLNIRSKYFEEFLCRRTILYTLDLLWKSNNEQYLERLAP

SEQ ID NO: 1396 - protein, 1687 aa, synthetic construct
  source 1..1687: note = Description of Artificial Sequence: Synthetic polypeptide
MLRRKGRHRMVMVNSVKWQPSAHAEAIGTGKSWAPQRSQASEHGWQSNAMFDPPNRILFARDSWSLNQSTHLQNQRSGSGLGIRPGQVRNNMVGGGPHRAGDPKRRVELVSIQGSEVTVRTIYPSDEIFSCYSKSCDIKTKAGYGPEDLKHLTRHIKNEHGLKARWAYQCGLCNEKSDPSVSEGHKWMEAHMVAVHQSSAEKRIKSYQKCTGARVAEQLQAAAPSLTVPGKHKSGSRDAAKDSMTPTKDDDPKTRIYQTRSVVKKSTQKTAEPTDEGSRGPKYASIFQKSVKARKSLALLCELSSPKPMNPLPTNELTLKEGNSRELAKEEAPSEGIDDIVIIDLDESEESPPRRKRFNTWCLDHESSREAWLDDTAIFWYISYLCRGSTKYSALDPCLWSMYKVKGSRYILDRLESSITYFFPICEEDHWTLLVLKDNSYYYANSLHQEPRGPVRDFINDSKRARKEFKVQVPLQRDSFNCGVHICLMTNSIMAGGKWHSEEDVRNFRKRLKKTLQEEGYELYSVNSLGIPFQAPTTEQMDYKETRCKRSYASVLTQISPPAKRPDCKPDNNIFVPTKDCAAEGNPQEKGRNESPEEINTEHIVVAGKPANNISPRCRSTSEMLFEMVKATTSSGRSSLGTMTQDEFIRTSTIAEAVPLMSIKLPPMELPRKILPPIPPRKPTQTNGGQKGKQQRVPTGKPDTLNAKVRNWFNNQLESYAMEGRSFQRLEWLTEVLTASIQKAAAGDEGIVDIICKRNPPLEVAKGEMCTQTENKRKTTNNAARIADPIQSSKGAGDVKASYWKERARTYNRIIGSKEELCKIPIDQLEDFFKKSTSRTNVQESIMKEKSSKIPALKIGNWMEKKFIGKEVAFALRKTKDTAQGADGLRYHHLQWFDPSGELLAKVYNECQRHRKIPKHWKEAETILLFKNGDQSKPENWRPISLMPVIYKLYSSLWNRRIRAVPNVLSKCQRGFQEREGCNESLAILRTAIDVAKGKRRNLAVAWLDLTNAFGSIPHELIEYALTAYGFPQMVVDVVKDMYQGASMRVKNATEKSDRIPIMSGVKQGDPISPTLFNICLETVIRRHLESANGHQCLKTRIKVLAFADDMAILTDSPDQLQRELSKLDNDCTPLNLIFKPAKCASLVIQKGVVRSASIKLKGNAIRCLDENTTYKYLGVQTGSAARISAMDLLEKVTKELECVVKSDLTPPQKLDCLKTFTLSKLTYMYGNSIPLITEIKMFANIVIRGVKVMHRIPVRGSPLEYIHLPVKDGGLGVACPKTTCMITFLVSTLKKLWSDDEYIKTLFTSLAEEVVKKESKKSTVTMDDIADYLNVEERINRSEFGYNSITRLRDVMRNLAITGDSPLYRLKMVVKNGKIALLVQATSESMERIYTEEDAKKLQRSLKDQVNKALKHRFNTTKVVKSKVVRVVQQHPASNRFVTKGGNLSLACHRFVHKARLNLLACNYNNYDKSKSKVCRRCGKDLETQWHILQNCPFGFSKKITERHDAVLHKVKTLIESGGKKNWTMKIDEELPGFSRLRPDICLKSPDEKQIILADVACPYEHGVEAMERSWQAKIDKYETGFAHLRKSGTKLTVLPIIIGSLGSWWKPTGDSLKELGIKGSVINSAIPELCATVLEHSKNTYWNHIFGEAYIPNPMRNGHAKPAGNGWKKERLQKAPVRPTN

SEQ ID NO: 1397 - protein, 1059 aa, synthetic construct
  source 1..1059: note = Description of Artificial Sequence: Synthetic polypeptide
MSLQRAKNARGDPGRCNLCSADYRDLKDHLNKQHSTHFFVPSDLRGSSLVACPRCGTPCSAGTGLSRHQSRYCGLTAPRIRRNRVGNSTNTSRCPPSNTAASPIVPSPSPERPSPPQPAEVVASLEPLSEAEEVLEVAQVDAETVDTLEGTRRAPESVPRSAEEGSTRVRELNMTAPEEEHRGEEESSHTNPTAPAGLENAVSSTLGPSPGTLPSLLPSQECANERFLYLAHLPVRSKPLPNNLVTDFMDAAERCALAYIAQPSDSTLLAFLALPKVGLTQALAPEQPLRPSTFLKQFPHIPWPEQPPARRPPSNIRPDTTKQVIKLVENGRLGAAERVLEEDASVAELDQGVIDQLITKHPKGPSCPFGNAVGPTPGKAPDIDTIQKALDSFKPDTAPGVSGWSVPLLKTAAKREPVKQFLQLLCAAIANNTAPGRSMLRTSRLIPLKKDDGSIRPIAVGELIYRLCAKALIISHFQPDFLLPFQLGVKSIGGVEPIVRLTERVLEGSAGAEFSFLASLDASNAFNRVDRAEMAAAVKTHAPTLWRTCKWAYGDSSDLVCGDKILQSSQGVRQGDPFGPLFFSITLRPTLNALSQSLGPSTQALAYLDDIYLFSNDSQVLSKTTQFLADKQHIIKLNEKKCKLISFDEIRQEGFKMLGTMVGGKEKRAEFLEGRIRKEMAKVGKLKDLPHQHALLLLRFCIQQNLRHLQRSLRSDDLVDLWERLDTMLWEEVKRMRMRQREDTAEEEALGRSLTKLPARLGGLGLLSFKDVAPLAYRSAAEASDTLLDNLGLLSSPEEPPTPIPQRTRCAELWESQQEAILHNLGDTERKRLTENASRLGRSWLSVIPYLQPLRLSNVEIASGLHDRTLVGSSIPVCRFCGSDSPLGHDELCRARNPWTQRRHNAINRVIYQHLKQIQGATVEIEPHTLSGQRRNDLRVRGSSALAFTDYDLKVYSLGDRDARSTVTPCAPNGKLADFCLDRCVNWLDKVGQVVSKNAPKVTGGVFKPIILSTGGLMSRSTADEWKDWRDAMPVGGFEKMEKRIGVELVKARARTLVL

SEQ ID NO: 1398 - protein, 1024 aa, synthetic construct
  source 1..1024: note = Description of Artificial Sequence: Synthetic polypeptide
MSQPNISSAETPLSQLPTPVPTPPSPSNPSLSLPTVRDLLLCPIRSSHVYSSIPSSCLHSFTMLLIKTVRAASATMTPTESHRAFIHLHILPIAVLRRSFRGETGWRSRTGQHHALRQRIRRASSGRHWAALWHEALAAHQVDLDYRTRHSRRYQASATSRHRIGRAMRLAADAQYGRAMSALKAKPLPDLHAAATRDTLTALHPPPASPVQPLSPTDLPPVPEITEGQVLRAARALNPTSAAGPDHLSPRILQLLARTTISPEAGVTGLSALTNLVRRLARGDIPDRTAPLLAAATLIPLQPRPHKIRPIAVGQALRRLVTKVLLPPAIQDTRDHLLPEQLANSVASGMDAIVHDTRMLMHRHGRNPDYIMVSVDARNAFNTFSRQSLLDRLPLQTPSLARFLNLIYGRTVPDLVLPSSPRFLMKSQEGTQQGDPASMLLFSLAIQPLLRRLTRECRLDLNRWYADDGTLVGPISEVIKALRILRDDGPQSGFHVNINKCRAYWPTVMPEKLSELLRIFPLHVECGEGGVALLGAPLGTDAFVRRHLMNKVQSCHASLSLLDEIPDARTRFHLHRVTGSVCKVEHVFRLTPPHLSLPAATKFDEQQIAAYSRLNDVAVSTSMATQIGLPFRLGGHGFTPLSPFIHASYAASLIEAAPVRVKGPHNPSESFYRRMARRHIVHVLGALNPEVRTRGILGTHSPLGPFEPEALLSRPERVHHTLIQAMQGATSRLYWEHTAWDLDPLPRNHSAASVRRRARYNSLRAPGAASFLCSHPSLTSRVPSAVWSCMLRRHLDTPVYCDSIRPLICSHCCKPMDARGDHAAICRHGFGVVHRHNTVRNLLARHAFRAAGLCCDLEVPSLLPNTANRPADILVQPAPPPSGALPDRPTAYDVTVRSPYCRSTMSLAAKGLAGAAEAADLDKLRVHSRTVRDAFHLQPDSPLPLLDWHFVPLAFDTLGATSSRTMAVLEYLAHRIANRTYSSYGTAKIRLLQRISFAVWSSLASATLSRMPYHGAALSSPAQV

SEQ ID NO: 1399 - protein, 1353 aa, synthetic construct
  source 1..1353: note = Description of Artificial Sequence: Synthetic polypeptide
  VARIANT 3: note = Any amino acid
  VARIANT 4: note = Any amino acid
  VARIANT 6: note = Any amino acid
  VARIANT 31: note = Any amino acid
  VARIANT 32: note = Any amino acid
  VARIANT 33: note = Any amino acid
  VARIANT 34: note = Any amino acid
  VARIANT 46: note = Any amino acid
  VARIANT 52: note = Any amino acid
  VARIANT 59: note = Any amino acid
  VARIANT 79: note = Any amino acid
  VARIANT 85: note = Any amino acid
  VARIANT 92: note = Any amino acid
  VARIANT 96: note = Any amino acid
  VARIANT 98: note = Any amino acid
  VARIANT 100: note = Any amino acid
  VARIANT 103: note = Any amino acid
  VARIANT 122: note = Any amino acid
  VARIANT 140: note = Any amino acid
  VARIANT 163: note = Any amino acid
  VARIANT 170: note = Any amino acid
  VARIANT 188: note = Any amino acid
  VARIANT 193: note = Any amino acid
  VARIANT 199: note = Any amino acid
  VARIANT 207: note = Any amino acid
  VARIANT 209: note = Any amino acid
  VARIANT 220: note = Any amino acid
  VARIANT 257: note = Any amino acid
  VARIANT 274: note = Any amino acid
  VARIANT 276: note = Any amino acid
  VARIANT 292: note = Any amino acid
  VARIANT 298: note = Any amino acid
  VARIANT 303: note = Any amino acid
  VARIANT 306: note = Any amino acid
  VARIANT 307: note = Any amino acid
  VARIANT 309: note = Any amino acid
  VARIANT 333: note = Any amino acid
  VARIANT 344: note = Any amino acid
  VARIANT 353: note = Any amino acid
  VARIANT 368: note = Any amino acid
  VARIANT 382: note = Any amino acid
  VARIANT 383: note = Any amino acid
  VARIANT 391: note = Any amino acid
  VARIANT 476: note = Any amino acid
  VARIANT 480: note = Any amino acid
  VARIANT 573: note = Any amino acid
  VARIANT 591: note = Any amino acid
  VARIANT 620: note = Any amino acid
  VARIANT 669: note = Any amino acid
  VARIANT 678: note = Any amino acid
  VARIANT 707: note = Any amino acid
  VARIANT 709: note = Any amino acid
  VARIANT 728: note = Any amino acid
  VARIANT 759: note = Any amino acid
  VARIANT 780: note = Any amino acid
  VARIANT 791: note = Any amino acid
  VARIANT 799: note = Any amino acid
  VARIANT 845: note = Any amino acid
  VARIANT 857: note = Any amino acid
  VARIANT 860: note = Any amino acid
  VARIANT 878: note = Any amino acid
  VARIANT 880: note = Any amino acid
  VARIANT 882: note = Any amino acid
  VARIANT 896: note = Any amino acid
  VARIANT 939: note = Any amino acid
  VARIANT 959: note = Any amino acid
  VARIANT 1030: note = Any amino acid
  VARIANT 1038: note = Any amino acid
  VARIANT 1066: note = Any amino acid
  VARIANT 1139: note = Any amino acid
  VARIANT 1153: note = Any amino acid
  VARIANT 1155: note = Any amino acid
  VARIANT 1217: note = Any amino acid
  VARIANT 1253: note = Any amino acid
  VARIANT 1262: note = Any amino acid
  VARIANT 1271: note = Any amino acid
MAXXPXISPPGAPPAPLRYRMLQCPPPLPKXXXXPVPHPMSSPIRXRLPHRXMRGPPSXTPPRDMHRPHGTPGPHSHRXCGRPPXHCTHASXQPRXAXHXLQXPKLRSPPPHPHVSPLILCXGPLPTPMTQPRMKRALSXSAKAPPTKRPSASQGPAASSHDXPRTPPPXPPRPPPYRFPPPTLDQHXFALSXAYPHPXPRRPPSPXRXLRHSFPPRFGXQTFSSIPGPRLHSTVLLLIRLVRAATAANTPETTTLXSCTFTCSRLPFFERPSXAXLAGGPRAVNFMLSACXYGERVXDESGXSYXXKXHCITSHPPRPRRYSRQHSRNHHTXFLHLHLLPTAXLREAFRGEXGWRSSRGQLHALRLXIRRACTGREWGLLXXEALDAHSXRTEWQHTHARRPSPPVSPSARAARAMRLASQAQYGRAMRTFTNPPLADLNDPATMERLQALHPTPTVPVVPLPPSAQPRPPEVTXEAVXRAVRRLNPNSAAGPDRMSPKLLHLLAHTPISPEAGVTGLSALTNLVSRLARGSLPPCTIPLASAATLLPLQPRPGKIRPIAIGQALRRLVTKXLLPAAIDDCRDHLAPEQXANGIPNGIDAIVHDARMLVRRHGNDPHYXMVSIDASNAFNNFSRQQVLDQLPTRAPSLSRYLDMVYARAPSPLVLPSXPPTILHSRXGSQQGDPASMLLFSLALQPLTRLISRECXLXMNRWYADDGTIIGRIDEVXKALDIITKEGPRFQFFLNPSKTRVFWPSRQXDLLSPLMTVGPLRVIDEGGVXLLGAPIGSPSXMAQYIREXLNTCKTALAHLDHIPEARMRFHLHRVSASACRLQHLFRLVPPDFAXPFAQQFDRDQLXAYXRFNSVTMSPRIVPKYGCXFXTXATASPHWHLPYTPXTLLASSIPLQHGYKVPTFPPSLSISVLHEARCGSFFEIYLHSXNPHTSRCDYVAKNRAQIRLXFSHGGHGLTSLASTIHASYAASLIDTAPARLQGPHFPAVSQYQRFARGPLRVVLRNLPSFVQPAHFSMTEXDLGCLEPXALLARPERIHTFLLQAQYSAAASSYWQXPLWESFPNPGDHSAASLRKRVRYNSLLAPGATSFLTAHPAATSRVHNATWSTMLRRHLDAPVTNDSISPLRCXHCSKPMDARGDHAXIXSHGFGTLHRHNTVRNVLARQLFRVAGLAYSLEVPFLIPNTAARPADILVQPPPPAPGLPPDXPTAYDVTICSPFRRGMLYHAARHRGGAADAASVRKXKALERTIRXALLIEDDNXPPPLDWHFQPLSFDALGAPSQSTVHVIEDHAKLMALRNSCTIATAKSRIQQRLSFAIWSSAAAAILSRLPTHAADISYPIEV

SEQ ID NO: 1400 - protein, 1473 aa, synthetic construct
  source 1..1473: note = Description of Artificial Sequence: Synthetic polypeptide
  VARIANT 144: note = Any amino acid
  VARIANT 216: note = Any amino acid
MATTTISRSPSSSSSSSSARSRASASTSASVASIPRLFRDGRFHCPLAHCQTRTSTWQDLSAHLTRMHDGDVPRDVAAACGIVQCLHEGCRKWFRGAAGLASHRGKARHAPPPAPRAALAVAAVPRADSRGRTPAPTPSVAPPXAGPPPRAAPRAAPSPLPCPPALPHPPPSASPPTSSVTSPCSPPTTPPSQPSPDLFSGFANAPTTPSPPSTPXSSPAGSPIPAARRFVLPVATPYPAPAPRANRPKLSPVARPFVPKARAGAIPEASSPVTPQDRAVSRREDAAAAPSSAPGLGLADEHEDDDTYGGDTIALTAPHAPRETRAPFEFEACFLEEEAPATAGDLPPYARAFLACPSARLQEIPRRLKSAWQAAAKTIAEAALDCHTAGDTQGYNAHLRLFIELPARGLAVPTNCRGAARTKLQRERLLDIAAGRIPAIPDPPCDAPGADDALRGFPVSGTTAGDVSNDDDSGGVHDRPAATASARQAKRLVEQGLSSRALRALERGEPAVASADTLGRLEALHPPNPTDRGLWPGAPKAAIPRVTAKHLAQVAKELPRGSAPGPSGWTFELVQAAIDRQPTGTVAAFLIDMAQRALRGTLHWRGLLTASRLVALKKPDGGVRPIAVGEALYRVIGRLVLKADRVMSSADATQYVGRHQYGVAYPGGVEAPVHAVRELHDSGQLRAVVSLDWRNAFNSLDRVHTALLIADRAPALARLYEWSYREDSVLVLPRAFEKAGLPASLLSQAGVRQGDVLGPLFFAIGAAPVLDEIDAIPYVTPRAYLDDIFVTIPHGVTDAATKAAVAATFATAEREGAAAGLRLNRCKSAVWAADAEALLPPHAAGAREDVESCAPVREGLKILGAPVGSPAFVAKSLDGIIKRAIGTLDLVADAELPLQHKLVLLRQCVAQIPTFWARAVPDAGPALAVWDTALLRRTGALVGLDVRDGSLQADIARLPVRLGGLGLRSMKDTAPRAFVASILFAAALANTRRSELTCSASTARRLRAALPELARTDACNDEAAWRRSIARGVFPDVDKLGTTQLQRVLQGMADSKSAHRTRRQVPFLFAAVFEDAATPGSGAWLAAIPSDPTLVLPDAELAEAVRIKLLTTTANAAGVCPACHKTGIDPSHAYTCVSLSHLRTARHDVVVRRVELACKTEKPVREHVLAIPPVAPTDNNNNGDEDGSPVTTADDNADGHAVATKRRPETRASARAAAAAATAAAAAAIINDNSLLSDDDDDDDHDDNCHGEERGEGERNVTCPGHYTATPFAADDTLDNSDEDNEDNAHEDDDEDGKDDNDDDVYNNCNSSSSDGDEGGDDLDYEYSDQSVTRSVDAATGESPNPERPTTPTRALLRADLWLPATSTAVDVMVAAACRRSRAKAFDRAVSRKAAKYGPAVADGSIAKVVPFVVSPFGVLSRPAKAFLKRAMGDTTAAKQAKARLRLAVAAVRGTARLSYAWGACAALIVGGN

SEQ ID NO: 1401 - protein, 1220 aa, synthetic construct
  source 1..1220: note = Description of Artificial Sequence: Synthetic polypeptide
MAPLPWNAATSSPPSPVPLTNDKKKDSTLPTATSKNLSKNNNNKNNNTNRINNIKNNDNTNDGSNKINLKLPPAAVKITNPYKNKKKNKKKNNAGKSNPKTNQNPNSSPLSDNDDDDTDSSNITINRRLKFGTDDLAPPNPPSNTNTIGTATAATAATATTTATAATATTATNTTTTTTTTNNTTGDNLASNINNNNNNNNSGSNNSNTNNINNTDGNGSNNRPPPRVYTVDPRSDLPGAEISAANKMLDEVYGDHVHDNPGSHLSGLISSSQDQLWQGYFRRLIPHNQSLYDCPKGKLGKDITNEYSNLFEAIMNGKCNMEKLLVFPVVVLQRRHGVTKNADVKRRLLSRLTAWKEGKFKYLVEDTHRDLIAKQSKARGDTTPAHRAKVYSSKLMRGHLQSAVNYITDREGGGILYPYDVDEKSGHTVSRVLQDKHPSMRDPGPTAMPAYESVPELPTLEITADTVEIVAGKLSGGAGLSGVDSIQLKHLLLHHGQASQRLRNVCAKFGRWLANEHPPWASYRAMLANRLIALDKMPGIRPVGIGDTWRRFFAKLVLAVSMSYATDCCGSDQLCAGLRAGVDGAIHGLSAMWREMESEENTGFVLIDADNAFNEVSRINMLWTIRHEWPAGARFAFNCYRHHSLLVVRNPGGKPFTFFSKEGVTQGDPFAMIAYGVALLPLIRKLKELNVLLVQSWYADDASAAGKFDEILRLFQDLLRMGPDFGYFPNASKSILITHPDNVVAAHHFFNETHGLGFKISTGSRFLGGFIGDTTSRDEYVSTKIADWIHGTKELAAVARLKYPHAAYTGITKCLQHKWSFTQRVIPGIDDLFQPLEDELTNNLLPALFGDPPSTMDDKLRLLTALPVKHAGLALPNPVTSSATNYKNSTLMSSHLLLAVQGKINFSLQDHRDTCQSSLSASRELRQTENDSSLTNLLAALPPAAAGQPSTTRAIKRAGETGLWLTTIPNHINGNILGCDEFIDAIRLRYQKVPHNLPAKCDGCGSAFDVGHALQCKSGGLIIRRHDELNLELASLAKMALRESAIRAEPEINPSASIMDSPTTITAIDTNGDRGDLLIKGFWDNGMDAIIDVRITDTDAKSYRTRDPKKVLQSQEKEKKKKYLDQCLLQRRAFTPFVVSVDGLIGYEASNVLKQLSKRLADKWNKPYSVTCGIVRSRISIACARASNQCLRGSRIPFKTMSRQIQWEDGAGAGLYRIVR

SEQ ID NO: 1402 - protein, 1027 aa, synthetic construct
  source 1..1027: note = Description of Artificial Sequence: Synthetic polypeptide
MNMVSICKRCDRSFTTLKGLNIHKGQCKIFVSNTNKQINNVVNNELTTPNKNKVEINTILNCDEISVEHYSTNTPYLPKINICESIIDPNDYLWGHMPFSFLLNHVNTIYDEIVFYHKNLFKVPSGKGGKMFIEELTFWLKQFNNRTKLNGIAMKCFMIVPSLMLQKPSIRSKAKEHAECLVRRITLWRNGNFSELMREIRYIQSKINTSKKKRTFEDISRIFAKLMMEGKVAAALKVLDRESSGILQCSESVLKELKSKHPDETPVQDNCLLYGPLQNTPECLFDSIDEISIFNSALQTKGSAGPSGMDADLYRRVLCSKCFGPSCKTLREEIATFTKNIATKSYQPDIVQPYIACRLIPLDKNPGIRPIGIGEVLRRIVGKTISHHCQKEIKEAAGPLQTCAGHGAGAEAAIHAMQKIFHQEDTDGVLLIDARNAFNCLNRSVALHNIQITCPILAMYLVNTYRKPAKLFIYGGETIFSKEGTTQGDPLAMPWYSLSTVTIINTLKLVIPDVKQVWLADDATAAGKLQSLKKWYKCLEDVGGLYGYYVNQSKCWLIVKSDNQAEEAKLIFGNSINITTQGKRHLGAALGSEAYKKVYCEDLVSKWSKELNNLCEIATTQPQAAYSAFIKGYRSKFTYFLRTIEAFENFVTPVEKILSEKLLPVLFGTDCSIIKENRDLLALNPSEGGLGICNLITEAKEQHTASKKITNLHIKSILDQSDVMKEKDDFGKTFSEIKTKTNMDKSKKKKEEVKKIHAGLPENLKLLVEQACDKGASSWLNTLPIKEQHLDLNKEEFKDALRLRYNVPLANLPSYCACGEKFDELHAMSCKKGGFVCNRHDNIRDLLTVCLNKVCTDVQAEPHLIPLTNEKFNFKTANTNDEARLDIKAKGFWRKGETAFFDVRVTHVNSKSSKKQPTKHIFRRHEDAKKREYLERVLEVEHGTFTPLIFGTNGGFGDECKRFTALLAQKLSLKMGERYGAVINWLRTRLSMEITRASLLCLRGSRTPFRHYNTDDVGLENVQCGLI

SEQ ID NO: 1403 - protein, 1068 aa, synthetic construct
  source 1..1068: note = Description of Artificial Sequence: Synthetic polypeptide
  VARIANT 33: note = Any amino acid
  VARIANT 100: note = Any amino acid
  VARIANT 350: note = Any amino acid
MASSSTSSSDICLCPFRSFHCCPNGEVGSKGIXRMISHIKRHHLLTEDRKCVLREALSSDVGLFMAVEETLKAFGQWMCGKCMTLHALSRYCHHPDGRVXFVTGADGSSRYIVGILKPSTKESVTNALGGLVFDVGLLDRVFKEPITTVKSIPHSCRLAFSQALKTALYKVIAQPGSVDAWICLLLLPRCTLQVFRPKNRQECRSGNRKSLQQSSILKSLDTWGKEDGIRKLVQNMLDNPEVGAMGQGGGILQKESTSSNTNIRQCLRKVADGHFTAAVKVLCSSGVAPYNGDTIKALEDKHPFRPPPSMPSPIISEPPLVADFDCVFGCIKSFPKGTSCGRDGLRAQHXLDALCGEGSAIATDLIRAITSVVNLWLAGRCPTILAEFVASAPLTPLIKPDNGIRPIAVGTIWRRLVSKVAMKGVGKEMAKYLNDFQFGVGVSGGAEVVLHSANRVLSEHHADGSLAMLTVDFSNAFNLVDRSALLHEVKRMCPSISLWVNFLYGQAARLYIGDQHIWSATGVQQGDPLGPLLFALVLHPLVHKIRDNCKLLLHAWYLDDGTVIGDSEEVARVLNIIRVNGPGLGLELNIKKTEIFWPSCDGRKLRADLFPTDIGRPSLGVKLLGGAVSRDAGFISGLAMKRAVNAVDLMGLLPQLCDPQSELLLLRSCMGIAKLFFGLRTCQPVHIEEAALFFDKGLRRSIEDMVVCGGPFFGDIQWRLASLPIRFGGLGLYSAYEVSSYAFVASRAQSWALQDHILRDSGICGMDSDYLCAMTRLRDTIPGFDCSGFTNKDTPPKSQKALACALFSKIVKDMEVDFDMTVRQKAVFECLRAPHAQDFLLTIPIDGLGQHMSPVEYRTILRYRLMIPLFPIDEICPVCRKACLDTFGEHAVHCRELPGFKYRHDVVRDVLFDACRRAGISAKKEAPVNFLTDPQDGRSTLRPADILVFGWVGGKHACVDLTGVSPLVGLRSGGFTAGHAALKAAACKVAKHENACIENQHVFVPFAFDTFGFLAPEAVELLNRVQRVMHSNVISPRSTDVVFKRISFAIQKGLAAQLVARLPSIDMY

SEQ ID NO: 1404 - protein, 1461 aa, synthetic construct
  source 1..1461: note = Description of Artificial Sequence: Synthetic polypeptide
MATESGGEDSWTQVRGAKRPSAESPPSNTTTSPSQTHRSAKHTKHGSARHDRNHVFPDPMTTPLRPHARHSVPTARASSHVPSTSPAAGATESSARAVVPAAEPVTRTSNGGGEQHPIIGNTSNASPRTPRTPSSPRSFAQVAAAMPAAATATSSAPMTEDLSASVPSEPNGSGEQQPSPESTGQTHHSIPNTPSDFLTMSSDESDSPPRSTALRAPTPIAPPAHDGDGDTNGSATPEPLVQSPTPAQMVLPYPSGTQQTHSDPSPPSASPPATTILPAAISHPVEHSEHANSAPLGEVSESETHNTAGEHSESEQDVLLSDPAPPIAANVLDAQRKVLLKTSGHRQLLACPFGLCKCKGPRLDRKAWVNHVLREHPYDEQATDLVKQVMEAKLVAQCNKCHLFFEAAGISQHRSRCGANLKRATEALFHAAGHDLLEIMRGAWPQQCVGSRISVCELLKLARHPLMQRSRYPSNATETKLMAATLSQLYWSAVHSDYTAEEREMCWALILALPSMLLSAPSTALSTIDLRNMFHDRLRWLVTGQLGRVVDAMRKAVARKQSRRGQLNAGAGAHPNDAVDQSLRSLVRDPDLADEAWANHVTNRLNRGQIAKAFDADKARAVIGNSEVQAVRDLLVPPGLTPYIASTPASTSTLAPATAVSSPTVSFTKGELPKALAATKGVTDPYGWSGELLASIYRIKEHFSQVLGPRQGSTSDPTAPSDGDAPQGPTTATGGPQVALNKIFHHIANNTVPESIRHALCSINYTILEKANGKFRPVGTDSIFNKVVNRALLEQQQPHIAHLLQASPELAVGVKDGISAAVGMAFGELQACESTPGWTMLSLDFKSAFNYTDRARLHEIVADKVPGLLRAFERHYARPTTHCIVDKFFKVIDIDVGQGIVQGNELSPFFFALYSCEVLGLLDATTDYRCKVIKYLDDIVLMGPAEDVAADVEIVKARAESAGLHLQPSKSRFYMPRHHSASITAIKSVLPDAVRETANTGMTVLGTPIGRREWMKKQLNDKAKHIAGKLNDMLTTGVSLQALLTAMQYVPSLINHLYTLPPSLTSGLSELLNRACKDTFVKAFFAKVNLSAPAGAEGHDVTLEQLLEARLFTRANTGGFGLHDLVERGPVAYVCNMAKLATRYPRVYDRLLEDASRAADFEAHVQRAGFQMATVKDAATQRPAEIIALRSKAALDDLMAKCALDLQQAYLASREWGVSTVLTMRGRDKLRRLSDTTFAIAVVSMMGFGLHELINVKPTDKCPLCSSKTPQPRLTREHLLTCRPIKRHNALRDEMGRLLRYATLSHVWVEKSGYNANGQSCRIDLHCRNPFPGGALGPALPDLGIDVTVRTAQPPTTSQACIKVGAALRRAEKEKRDYYTGFNHGKTLIVPAAMTTTGGFASSFVDLLGQLARCAEARGVYQPGLDEAFVPRWKGRFAALVHQMNADHIQRHFGGVCLRSS

SEQ ID NO: 1405 - protein, 1095 aa, synthetic construct
  source 1..1095: note = Description of Artificial Sequence: Synthetic polypeptide
  VARIANT 276: note = Any amino acid
MSSCKVTIPHVCPYCKVELKTICGINRHILKCKKNPLQIPSLQKTNTSLTLEPNTKVIPSITKQNDIIIASTSSNNLAFNQKKDYTLTPTYSRKTTPVSILSSMKMTPISITSHIVRRKLPELPSQTTNHLFNENFINVPFLPEIMNHLPVPNNNVMWGVYSYQQFKLFVDSTYDEIVNYRRNIFNIPSGKAGKEFIEELTFWLRKFNSTSSLNSIALKVTMILPNLLLQKPSAKSKSKEHTLCLTRRIDLWKKGDTSLLLKEVRNIQKKFVNSKXKRSMDDISRIFAKLIMEGKITAALKFLEKEASSGILPLSDNTLKDLKSKHPEPSRVEDYSLLFGPIDLIPKCFFDCIDEQLVMKAAFATKGSAGPSGMDADIYRRILCSKNFIKEGKELRKEIAKMTQNLLTETYEPTFLEAFTACRLIPLDKNPGIRPIGVGEVLRRIIGKVISWSFNSEIKEAAGPLQTCAGHGAGAEAAVHAMKEIFDNVQTDAILLIDAKNAFNCMNRQVALHNIQIICPLISIYLINTYRNPSRLFVAGGKEISSQEGTTQGDPLAMPWYSCNTTIIIEHLLVNYPQVKQVWLADDAAASGSIANLHSWYQHLIDEGCKHGYYVNQSKCWLIVKSPSLAENAGIVFGKSVNITTEGQRHLGSVIGSQNFKNKYCTEKVAKWLTELKQLCKVAETQPQAAFIAFTKGFRSKFTYFLRTIPKFEQYLAPVDEILSHLLLPTLFGKDTPFEDHIRKLFTLTPRDGGLGIPILVEEAPHQFLSSVKLTKNLVQQIIDQDKILKTKNSSGNVLEDLEKILTTDRLKHRKEKIIAVDSMQPDSMLRNIQQTRSECASTWLNALPLENQGFVLNKEEFRDALCLRYNFDLKNIPRICECGEPFNVTHALSCKKGGFISSRHDNIRNLFTTLLKRVCINVQSEPHLIPLDNENFYFHTANKSNQARLDIKANGFWRNGQTAFFDVRVTHVNSMSNKNLDIAAIFRKHEKEKKREYGERVREVEHGSLTPLVFGTNGGMGKECHRFVRRLAEKLAEKQNEKYSVVMTWLRTKLSFEILRSTILCLRGSRTPWTKKNDFEIGVDFKMDALEARI

SEQ ID NO: 1406 - protein, 1070 aa, synthetic construct
  source 1..1070: note = Description of Artificial Sequence: Synthetic polypeptide
MVCPTCNGVYADYNDHIRKKHPDERYTALQLQPLGLTPCPICKTACKNDLGVKTHLSKIHKISGASKISTQPRIRTENTDNTNSVPTSSFNPVLPEIQTLTPGLNNSRWADNPRKRRADTPSPTRGRNTRPRRFSYTDIDLTNDEPADNPRANNPRVNNPRVNNEPPSSPNSLPSISEFHTPGTLPLTNSNISLKDQHDKITGPILQKPLIQKLIEYSKIPIPEHHLHARQAKIFADAANRIAKNFIQSPTEKTLFNLLILPRIFGIGLINGKVTKIMQNFPSQIPPIPKIDFPSEKTDSDPVLNAKKLLEKGYIGRAAKAIIDPTPVAPETPESLNILREKHPIGQNNPFNTKSQPISGRQITEKAILLAISSIGREKAPGLSGWTRSLLDAAIKIPTQNDVIPALRLLTDMIRQGTAPGRELLCASRLIGLSKPDGGVRPIAVGDLLYKIAFKAILNTLWSPNCLLPYQLGVNSIGGVEPAIFTLEEAIMGPNINGIKSITSLDLKNAFNSVSRAAIASSVAKYAPTFYRSTCWAYNQPSILITENGSVLASAQGIRQGDPLGPLLFSLAFRPTLETIQKSLPYTYIAAYLDDVYILSKTPVKDKIAKIIEKSPFTLNSAKTTETDIDTLKTNGLKTLGSFIGPTELRKEFLQNKIQNFESSINALKKLPKQYGLLILRKSTQLLLRHLLRTLNSQDLWELWEKTDKLIADFVINLTVTKRKKRPITDFVTPLITLPIKDGGFGLLRHNGIAQDIYFAAKDLTTEIRHKIQRISNDFPQNQSPTATEILHLLHNGVLADCKNGLTNAQLNALTENASYLGRKWLNILPIQKSNRLTDWEMAEAVRLRLLAPVKPLTHPCNHCGNRTNINHEDVCKGAVRKYTARHDQINRSFVNSLKSRPEIDVEIEPDLNNENNVNNANTTTENPTPSPNGQNDTGCLFTTPIRSGTRNGQNGLRADFAVINGVSKYYYDVQIVAINKDSGNTNPLNTLADAANNKRRKYQFLDPFFHPIIISAGGLMEKDTAQAYKQIQKLIGPVAAHWLDTSISLILLRSRTTAAISIAKNRPRA

SEQ ID NO: 1407 - protein, 1101 aa, synthetic construct
  source 1..1101: note = Description of Artificial Sequence: Synthetic polypeptide
MNAVCVCGKVCKNQRGLRIHQTKMACLRRVQAEHRSGAVATTVEPVLSASAPGQTEEDQGPEAPHSARNLRATPAPPQGRKSDHHRVKWPAANSKEWSQFDEDVDMILESVSRGSTDQKLQSMCTVIMSMGAERFGTIGQRKPTDTMKPNRREVKIRQLRQELKSLRRSFKASTSGEERAALAELTHHLREKLRTLRRAEWHKKKGKERARKRSAFITNPFGFTKRLLGQKRSGNLTCPVEEINLHLSNTFSDASRDVDLGPCPLLVTSPEPEVHFDISEPTLKEVRETVKAARSSSAPGPSGVVYKVYKHCPRLVVRLWRILKVVWRRGKVAADWRQAEGVWIPKEEESSKVDQFRLISLLSVEGKIFFKIVAQRLIKYLLDNQYIDTSVQKGGVPGVPGCLEHTGVVTQLIREAKENRGDLAVLWLDLANAYGSIPHKLVETALTRHHVPESIQNLILDYYSNFWLRAGSSTATSAWQRLEKGIITGCTISVPLFALAMNMIVKGAEAGCRGPVSRSGTRQPPIRAFMDDLTVMTATVPVCRWLLQGLERLITWARMSFKPAKSRSLVLKKGKVAERFRFTLGGTQIPTVSEKPVKSLGKVFNSSLKDTASVQQTRSDLTTWLEGIDKTGLPGSFKAWMFQHGVLPRVLWPLLVYEVPMTMVEQLERTISRFLRKWLGLPRSLSNIALYGRSTKLQLPLSGLTEEFKVTRAREVLMYRDSSDSKVSSAGIHVRTGRKWKAQEAVDQAEARLRHSVLVGSVAVGRAGLGSCPKPRYDKVSGKEKRLLIQDEIRAGEEEDRRCRMVGMRKQGAWTRWEHADSRKVTWPELCRAEPSRIKFLISSVYDVLPSPANLHVWGLAETPSCQLCQRRGTLEHILSCCPKALGEGRYRWRHDQVLRVLADTVSNAIQSSRSQQPPKKSIVFVRAGEKTRQQPTSAGGLLSTARDWQLLVDLGRQLKFPEHIVATSLRPDMVLVSESTRQVVLLELTVPWEERISEANERKRAKYAELVVQSQSNGWRARCVPVEVGCRGFAGQSLAYVLKLLGVRGFRLRKSIRDILEAAEKASRWLWFRRGEPWKPHGHRSGNDQPRLGRPGEGVW

SEQ ID NO: 1408 - protein, 1087 aa, synthetic construct
  source 1..1087: note = Description of Artificial Sequence: Synthetic polypeptide
MTHANEQTTNKIYVTCICGKLCKNHWGLKIHQARMKCLEQESKVQRTGPEPGETQEEPGPEATHRAKSLHVPEPQTPSEVVQQRIKWPPASKGSEWLQFDEDVSNIIQAIAKGDADSRLKTMTTIIFSYALERFGCIEKGKTKPTTPYTMNRRATQIHHLRQELRSLKKLYKKATDEEKQPLAELKNILRKKLMILRRAEWHRRRGRERARKRAAFITNPFGFTKQLLGDKRSGRLECSIEEVNRFIEETVSDPLREQELEPNKALISPTPPAREFSLRGPSLKEVKEIIKASRSASTPGPSGIPYLVYKRCPGLLLHLWKILKVIWQRGRVAEQWRCAEGVWIPKEENSKNINQFRIISLLSVEGKVFFSIVSRRLTEFLLENNYIDPSVQKGGIPGAPGCLEHTGVVTQLIREAHENRGDLVVLWLDLANAYGSIPHKLVELALHRHHVPSKIKDLILDYYNNFKMRVTSGSETSSWHRIGKGIITGCTISVILFALAMNMVVKSAEVECRGPLTKSGVRQPPIRAYMDDLTITTTTVPGSRWILQGLERLIAWARMSFKPSKSRSMVLKKGKVVDKFHFSISGSVIPTITEQPVKSLGKLFDSSLKDSAAIQKSKKELGAWLAKVDKSGLPGRFKAWIYQHSILPRVLWPLLIYAVPMSTVESLERKISGFLRKWLGLPRSLTSAALYGTSNTLQLPFSGLTEEFMVVRTREALQYRDSRDGKVSSACIEVRTGRKWNAGKAVEVAESRLQQKALVGTVATGRAGLGYFPKTLVSQVKGKERHHLLQGEVRASVEEERVSRVVGLRQQGAWTRWNTLQRRITWANILQADFQRVRFLVQAVYDVLPSPSNLHVWGKNETPSCLLCSGRGSLEHLLSSCPKALADGRYRWRHDQVLKAIAASLASAINTSKNHRAPRKAVHFIKAGEKPRALPQLTTGLLHKASDWQLEVDLGKQLRFPHHIAATRLRPDIIAISEASRQLIILELTVPWEERIEEANERKRAKYQELVEECRERGWRTYYEPIEIGCRGFAGRSLCKVLSRLGITGVAKKRAIRSASEAAEKATRWLWIKRADPWTAVGTQVGT

SEQ ID NO: 1409 - protein, 1001 aa, synthetic construct
  source 1..1001: note = Description of Artificial Sequence: Synthetic polypeptide
MALPAVRSGPASTWTLLITLVIVAAKGTDGFMSFKLPLLSTDTWSGYNNDVKTLLGPLHHELATNEMSPKLAGEGFSDIMCDFMASKPEFSHTTEESHSEGYISHEPQSLAQVKRLKNKLRKKAFRADATPEDRKAFRDAIKTYSFMKRQQKRKETTKSAAHQEKEYHKNFWKFAGKCAKGQLDIPPVKPAFSVYYANEYYKNKYSHPTRVDFNKLLWFPHLPVEEQLPANSFDMSPVRPKDIKAVLSKRCATSAPGPDGIMYGHLKHLPACHLFLSTLFSKLLESGDPPTSWSSGNVSLIHKDGSPEAAENFRMICLTSCVSKIFHQILSERWAKYMTCNDLIDPETQKAFLTGINGCVEHVQVMREILAHAKKNRRTVHITWFDLADAFGSVEHELIYYQMERNGFPPIITTYIKNLYSRLKGKVKGPGWESDPFPFGRGVFQGDNLSPIIFLTVFQPILQHLKGVEQQHGYNLNDKHYVTLPFADDFCLITTNKRQHQKLITQISSNTKSMNLKLKPRKCKSMSIVSGKPSDISFTIDGDPVKTTKDAPEKFLGGYITFLSKTKETYDILAKTIETTVENINKSAIRNEYKLRVYMEYAFPSWRYMLMVHDLTDTQLQKLDSIHTKAIKTWLRMQPSATNAILYNTRGLNFKSISDLYLEAHALAYSRSVLKADEKVKHALQAKLDRESQWTRKMQKWGIGKCHTIHQQAIHVAKDSEWTSVRKHVKQQVTDMRHDVWTKHQENLLQQGQMLQLLEEEKCDLTWRSAMYNLPRGILSFAVRASIDALPTLCNLTTWGKRNTDKCKLCGNRETLHHVLNHCGVALQQGRYTFRHNSVLKHITDTIIESIDTSRINATIYADIQGYTTNGGTIPVHTIPTTQKPDLIIYLPEQKTLHIHELTVPFEKNIKTSHDRKVNKYSTLAADLETAGISATLTCFEVGSRGLVTPENKTRLRTLFKIVKAKPPKTLFTDISRIAMLSSYAIWNSRHEPYWESETLL

SEQ ID NO: 1410 - protein, 1074 aa, synthetic construct
  source 1..1074: note = Description of Artificial Sequence: Synthetic polypeptide
MTTHRAEVTTSGKTQEEPGPEATHSAQSLLVSPTPAAGRSPATQSCPQVTAAHNSPQSPQSQQVAVTRSDCVPLAQPRIQWPQSSKKAEWLQFDKDVNQILEVTGKGGVDQRLSTMTTLIVNIAAERFGTVTPKPTPSTYTPSHRVKEIKRLRKELKLLKRQYKAAGEVERAGLEDLRGILRKQLVNLCRAEYHRKRRRERARKRAAFLANPFKLTKQLLGQKRTGKLTCSKEAINNHLKATYSDPNREQPLGPCGALLTPPEPTSEFNMKEPCRSEVEEVVRRARSSSAPGPSGVPYKVYKNCPKLLHRLWKALKVIWRRGKIAQPWRYAEGVYIPKEEKSENIDQFRVISLLSVESKIFFSIVAKRLSNFLLSNKYIDTSMQKGGIPGVPGCLEHTGVVTQLIREAREGRGDLAVLWLDLTNAYGSIPHKLVEVALEKHHVPQKVKDLIIDYYSKFSLRVSSGQLTSDWHQLEVGIITGCTISVTLFALAMNMMVKAAETECRGPLSKSGVRQPPIRAFMDDLTVTTTSVPGARWILQGLERLVAWARMSFKPAKSRSLVLRKGKVRDEFRFRLGQHQIPSVTERPVKSLGKAFNCSLNDRDSIRETSTAMEAWLKAVDKSGLPGRFKAWVYQHGILPRLLWPLLIYEVPMTVVEGFEQKVSSYLRRWLGLPRSLSNIALYGNTNKLKLPFGSVREEFIVARTREHLQYSGSRDAKVSGAGIVIRTGRKWRAAEAVEQAETRLKHKAILGAVAQGRAGLGSLAATRYDSASGRERQRLVQEEVRASVEEERTSRAVAMRQQGAWMKWEQAMERNVTWKDIWTWNPLRIRFLIQGVYDVLPSPSNLYIWGRVETPACPLCSKPGTLEHILSSCSKALGEGRYRWRHDQVLKSIAEAISKGIKDSRYRQATAKVIQFIKEGQRPERTAKNCSAGLLSTARDWVMTVDLERQLKIPPHITQSTLRPDIILVSEATKQLILLELTVPWEERMEEAQERKRGKYQELVEQCRANGWRTRCMPVEVGSRGFASYTLSKAYGTLGITGTNRRRALSNNVEAAEKASRWLWLKRGEQWGQ

SEQ ID NO: 1411 - protein, 1085 aa, synthetic construct
  source 1..1085: note = Description of Artificial Sequence: Synthetic polypeptide
  VARIANT 172: note = Any amino acid
  VARIANT 744: note = Any amino acid
  VARIANT 910: note = Any amino acid
  VARIANT 944: note = Any amino acid
  VARIANT 1056: note = Any amino acid
  VARIANT 1068: note = Any amino acid
MTPAMEMTTTVTCICSKLCKNQRGLKIHQARMKCLEREVEVQRTGPGPGETQEEPGQEATHRSQSLHVPEPPNPNRVVQQQRIKWPPANRRSEWLQFDEDVSNIIQATAKGDVDSRLQAISTIIVSYGSERFGRIEKGNTETTSYTMNRRSFKIHQLRKELRTLKKQFKRAXDGDKQALKELYNILRKKLKTLRRAEWHRRRGRERARKRAAFIANPFRFSKQLLGDKRSGRLECSREEVNRFLQNTMSDPLRGQDLGPNRALISPAPPSAEFKLAEPSLKEVEEVIKAARSASSPGPSGVPYLVYKRCPEILRHLWKALKVIWRRGRVADQWRCAEGLWIPKEEDSKNINQFRTISLLSVEGKVFFSIVSRRLTEFLLKNNYIDTSVQKGGIPGVPGCLEHNGVVTQLIREAHESKGELAVLWLDLTNAYGSIPHKLVELALHLHHVPSKIKDLILDYYNNFRLRVTSGSVTSDWHRLEKGIITGCTISVVLFVLAMNMVVKAAEVECRGPLSRSGVRQPPIRAYMDDLTVTTTSVPGCRWILQGLERLILWARMSFKPTKSRSMVLKKGKVVDKFRFSISGTVIPSITEQPVKSLGKLFDSSLKDTAAIQKSTEELGGWLTKVDKSGLPGRFKAWIYQYSILPRVLWPLLVYAVPVTTVESFERKISSFLRRWLGLPRSLNSAALYGTSNTLQLPFSGLTEEFKVARTREALQYRDSRDCKVSSAGIEVKTGRKWKAEKAVXVAESRLRQKALVGAVATGRTGLGYFPKTQVSHARGKERNHLLQEEVRAGVEEERVGRAVGLRQQGAWTRWESALQRKVTWSNIMQADFHRVRFLVAAVYDALPSPANLHAWGKSETPTCSLCSGRGSLEHLLSSCPKSLADGRYRWRHDQVLKAVAESIALAISTXKHHHAPKKAISFIKAGERPRAGPQITTGLLHTAXDWQLHVDLGKQLIFPQHIATTSLRPDMIIISEASKHLIMLELTVPWEERIEEANERKRAKYQELVEECRGRGWRTFYEPIEVGCRGFAGRSLCKAFGRLGVTGTAKKRAIKXASEAAERATRWXWLKRADPWVATGTQAGS

SEQ ID NO: 1412 - protein, 1112 aa, synthetic construct
  source 1..1112: note = Description of Artificial Sequence: Synthetic polypeptide
MATTQASVKPTAVATCVCGKICKNPRGLKIHQTKMGCLASVQPEQRARFSLSESREVPARAEPYGPQQPHSPEALGETQEERGQESPHSAQNLRAQVAQAPDNPQHHRRVKWPPASKVSEWQQLDEDLEGILESTAKGGVDRKLQTMTTLVISFATERYGTMEKRAAPEKYTKNRRAEKISQLRQELRVLKKQFKGASEDQKPGLAELRCTLRKKLLTLRRAEWHRRRAKERAKKRAAFLANPFGFTKQLLGQKRSAHLECAKEEVDSYLHDTFSDAERENSLGECRVLISPPEPACSFNTKAPTWKEIQTVVRAARNNSAPGPNGVPYLVYKRCPKLLARLWKILRVIWRRGKVAHQWRWAEGVWVPKEEKSTLIEQFRTISLLNVEGKIFFSILSHRLSDFLLKNQYIDSSVQKGGIPGVPGCLEHCGVVTQLIREAREGRGSLAVLWLDLANAYGSIPHKLVEMALARHHVPGPIKTLIMDYYDSFHLRVTSGSVTSEWHRLEKGIITGCTISVIIFALAMNMLAKSAEPECRGPITKSGIRQPPIRAFMDDLTVTTTSVPGCRWILQGLERLMTWARMRFKPGKSRSLVLKAGKVTDRFRFYLGGTQIPSVSEKPVKSLGKMFDGSLKDAASIRETNDQLGHWLTLVDKSGLPGKFKAWVYQHGILPRILWPLLVYEFPISTVEGLERRVSSCLRRWLGLPRSLSSNALYGNNNKLTLPFSSLAEEFMVTRAREVLQYRESKDPKVALAGIEVRTGRRWRAQEAVDQAESRLHHKELVGAVATGRAGLGTTPTTHLSRLKGKERRDQVQLEVRASIEEQRASQWVGLRQQGAWTRWEEAMARKISWPELWRAEPLRIRFLIQSVYDVLPSPSNLFLWGKVESPSCPLCQGRGTLEHILSSCPKALGEGRYRWRHDQVLKAIAESISSAMEYSKRLPLPGRGVRFVRAGEQPPPQPRAQPGLLATARDWQLRVDLGKQLKFPENIVETNLRPDIVLHSQSSKQVILLELTVPWEERMEEAYERKAGKYAELVEDCRRAGWRSRCLPIEVGGRGFAGKSLCKAFSLLGITGMRRRKAICAASEAAERASRWLWIQRDKPWTSASWTQAGN

SEQ ID NO: 1413 - protein, 1522 aa, synthetic construct
  source 1..1522: note = Description of Artificial Sequence: Synthetic polypeptide
MMDSRQLNTPKIRKYQNPKMTNDIMKSYNYAVLSDVTPQETTQTTTHLNVDIDNETTQPKQPLTKSGKPKSKPIAVSYKFKDATFIWDTTPQTNPPRDCTKLIDKTRPRKTIFKKSAFQSYLKKELSNETFVEVKTFLMATHKYRFKDENSRLLAYRIINRYVMETANEFKETEFDMARFAKFFTIPENWLKHLKPYSTATETSPADRIKVQKLVDLTCRYPFKTQEEQTSVANFLHFFTQRSIIGISRDYKFQKFIPFMARKNTRPETTSTMVTTSPTEQNRLPMVIITPLEEPKSEHRRPEKRGASNDTIVLSDEEFPLLKRRTLPTRKSKNPTGAGNVPTETECTDEVKFILNNEYQIECKECGKVWENVRNGLNHLRQKHDFPNRTDVMVSCVRCEVPIKGAECVNHIKNHKKDDKEESEAGSLVANTQDIPNESSLSQAAIEVYLRNILKMKENQERNIQYLEPSTANFLINRNLRAFYQNVKIEKLIGWEQVIWLIHWNKCHWIVYLANCDSKTSVILDSDNQMTLQQRCNIKAKFDKFLEGTFEEKTVLGTLERKVPQQPNNFDCGIYVIQYISDFLKDPQRIDYHTPDSKRIRKEIGELILEEMKNPASKIKNPNKEIQSLLQKFRLLQINVNDVFHWFAAEYQKSLPKIRTKRDGKLNKLSCSYQIQRLFGLAPKRAVKEIYFQETSTADLETRVLNEHFKKDESTMKECKIKNGNHYQDWITKAQIDNKEILEALKNSTDSAPGEDNIPLRQWIIWNNDGVLFDMFNYIKRTHDIPDMWKNYTTTLLIKPGKSQESNIPANWRPISILPTSYRIFMKVLNKRVLEWANRGELISKWQKAVDKANGCDEHSYVIQALIEKANRSYYKNEQCHLAFLDLADAFGSIPFQVIWHTLKNMGMDEETINLLKEIYKDCSTKYKCGKNESEKIKITKGVRQGCPLSMTLFSLCIQYLIQGIAEKKKGATIAGQEVCILAYADDLVIVANTAKDMQMLLTTIENLAKQADLIFKPAKCGYYRDPRDKKSMMKIYGKEISIVDEKNVYTYLGVRIGDTKKKDLNVRFEEVKKKTTAIFKSKLRSDQKLEAYNIFCQSKFVYILQGEDIAKTKIETYDEEIKKMIKEDILKLQDKSPFTDFVIYSPREKGGLGITKIIDEQTIQTINRTAKLLNSSHRAIRAIIYEELIQVANLRGEKEINTIEEALKWLEGTNKYKKNSNAKTTWITRVREAFQTLEKKHKIKVRFVPKENCIGYKIKCDTQEKIVELDNSKELSKSLHWMIKEAYYKEWKALKCQGYIISLKTSEFMEWKMPRGLPDPDWRFLTKVKANMLDVNMKQANQGGRLGSTKCRKCEDKESASHVINHCASGNWSRVEKHNQVQNELAKELTKRNISFEKDSIPKETKESLRPDLVIRLKDKIMIVDIKCPFDEESAIESARNKNIDKYRELAKEIQAKTGLQTTVSTFVVCSLGTWDKRNNELLRQMGIRYEESKEMRINMIQKAIHGSRKTYDHHRNFNNG

SEQ ID NO: 1414 - protein, 1870 aa, synthetic construct
  source 1..1870: note = Description of Artificial Sequence: Synthetic polypeptide
  VARIANT 4: note = Any amino acid
  VARIANT 151: note = Any amino acid
  VARIANT 153: note = Any amino acid
  VARIANT 154: note = Any amino acid
  VARIANT 187: note = Any amino acid
  VARIANT 202: note = Any amino acid
  VARIANT 245: note = Any amino acid
  VARIANT 250: note = Any amino acid
  VARIANT 1545: note = Any amino acid
  VARIANT 1547: note = Any amino acid
  VARIANT 1679: note = Any amino acid
  VARIANT 1774: note = Any amino acid
  VARIANT 1809: note = Any amino acid
MPLXISDCVHLVSAEGDTMNGRSTCGPLSRSSSVVSRSRSSPSPSVPPHPSPSIGPDTGLSAGIIGTSRGCSLWLPEVDNALSQWLRKGLERDHEVLVCGFEAAKPLSLSKARLLRKTPRNTGVVRHILEFDGRLVHTNCNETECVLSTLXSXXAVEVVRISLKCEPREPCEPKCVLSILCSDKIVXISFECETREPFPFFXDRKFREPIPFVFERMYDPRDPIPSFICWMYDLRQRMTPGTLPXNPLSXENKDSWGRPAVIKNEIRSMRSYLEENVKENRLNLLRRLRGGGEGKKMIRKLVAEKKSDTEAVCRILYPLDDRYECFVDGCETTSTMGYGSSDLKYMTTHIKKEHGVKVQWTYECSLCNKQAPFMGGAASKWVTAHMATKHTETVKLKLKPSISTTAKVAAKLDEIAVSLPKPRQVRVLRDPDEVKEKVAKPTLASTREEVKRNALRNMAPLVELSSQNQLTGAERPEETSEAMRLEECRTPEKIAELEGKIQTRTVTKKLSALKESMEKRTREEKVGKPSLAPIHEEVKKTARRSLAPLVEPSTFTHLTGASRLQAVRDAFSKANKDAAAKRRSSLAKPARLSEIMNTTFTKETVNETKEPVNDTDESIATIQPQVRVYRFNTWCLDHETTREAWLTGEVVDWFMGKVTEKKDQYRVFDSLVWSMYKFHGVGYVLDLMRDPLTYFLPICEHDHWVLLVIDEKGIWYGDSKGAEPCREIAKFIEETKRERRMFPVPVPLQRDGVNCGVHICLMVKSIVNGEPWYTEEEVKVFRRNVKRGLKEFGFELYSERIVYVGDDSIKVNDEHDDDVVFLSEETNNTTFTIEQAEDPAEEDAQHLESPVKPVKLMELKIPKIEIKKKEIRRKPKQQIEKKRKVPTGKPDELLVRVRLWLEREVQSYFDSGKRFQRLEWILDVLTAAIHKATAGDEQAIERIEKRSPPLEVEEGEMSTQTEPKKRERKEKESGCEMKASHKEMYFKNRSKAFNVIIGKDSKQCEIPIETLQKFFEGTTAETNVPAEVLKEMGSRLPKLEALDWMEANFIESEVSDAMKKTKDTAPGVDGLRYHHLKWFDPEYKMLTLLYNECKNHRKIPSHWKEAETILLYKGGDETRPDNWRPISLMPTIYKLYSSLWNRRIRSVGGVMSKCQRGFQEREGCNESIGILRTAIDVAKGKRRNLSVAWLDLTNAFGSVPHELIKSTLESYGFPEMVTEIVMDMYRGASIRIKSKNEKSEQIVIKSGVKQGDPISPTLFNMCLENVIRRHLDSASGHRCIKTKVKVLAFADDMAILAENRDQLQTELNKLDKECESLNLIFKPVKCASLIIERGMVNKNAEVVLRGKPIRNLDENGSYKYLGVHTGIATRVSTMQLLESVTKEMDLVNQSGMAPFQKLDCLKTFVLPKLTYMYANAIPKLTELKVFANLTMRMVKEIHEIPIKGSPLEYVQLPPSQGGLGVACPKITALITFLVNVMKKLWSSDSYIRKLYRDYLDEVAETETGMEEMTKEDIAKYLSGDVPIDKKAFGYNTFTRVRDVCNSLTXIXGAPLHKLKIVERDGDFAILVQATKEGMEKIFTCAQEKKLQQLLKAEVNTALAHRFFTEKPVKSAVMSVMRQYPQSNAFVKNGKNVSIAVHSWIHKARLNALHCNFNTYGENKSKVCRRCGKDVETQLHILQXCEYGLPKLINERHDAVLHVVRNLIRKGSKKDWKLKIDETVSSCNQLRPDIYMCSPDGKEVIMADVTCPYESGMQAMQESWNRKVTKYEGGFSHFXKMGKKFTVLPIVVGSLGTWWKPTTNSLVQLGIEKXTIRRVIPELCSMTMEYSKDVYWNHIFGDTFRKPPMRFGVEKPKGNSWKKEGSEPKGAASSD

SEQ ID NO: 1415 - protein, 2030 aa, synthetic construct
  source 1..2030: note = Description of Artificial Sequence: Synthetic polypeptide
  VARIANT 53: note = Any amino acid
  VARIANT 67: note = Any amino acid
  VARIANT 169: note = Any amino acid
  VARIANT 222: note = Any amino acid
  VARIANT 274: note = Any amino acid
  VARIANT 342: note = Any amino acid
  VARIANT 351: note = Any amino acid
  VARIANT 626: note = Any amino acid
  VARIANT 1031: note = Any amino acid
  VARIANT 1077: note = Any amino acid
  VARIANT 1239: note = Any amino acid
  VARIANT 1424: note = Any amino acid
  VARIANT 1437: note = Any amino acid
  VARIANT 1550: note = Any amino acid
  VARIANT 1726: note = Any amino acid
  VARIANT 1745: note = Any amino acid
WRRPAPKQTKNSSLHHLGHEVKRIARLKPGIFEFHAKPKNSSLHHLGHGVKRXARLKPGIFEFHAKXKNSSLHHLGHEVKRIARLKPGIFEFHAKPKNSSLHHLGHEVRRNSRLKPGIFGFYQKSKNSSLHHLGHEVRRIARLKPGILEFHAKNRIKSGLKVTFLSDLXAHAGALACSRFLASTLKTEHCRQKSFKPVGFLLHFLKNSSINEVASLRNVKKXFLEFFSGKPIGGMASFSRTKITFFKLCLKNFVLSAENPPIIRQKTNQNKASXVQIARGGHLSDCLPSQKMAGVLGRLFLSVQSTLSHRPFDTLLRSDDDKRGRKTIKLQFFIKENLVTPXVARDVKILXKQTKNNSGNSDSNSETKNFSKNKVSRQNGPLIGGGNHKKIGENQITRTLEIESKSDDNKVLVLRILYPTNDWYKCYSQWCQHKSLVGYGAHDLKYLTDHIKSTHSKKVEWSYQCSICDAKAEGTGTKAARWITAHMPKVHGIEATHRIKQNSEKTTNVKTANSLQEMALSLQKPKNGPKKVVMATSTTPEKKISELESKIQTREVAKQLSALKESAQKNQQGNKTKNVKSSLKTIAENTNETKKISARKSLINYLKPEDVLNHIPKEPKPASAKXGLQELTGAQRLQETRRRFMAGNRRDSIARRESLSLGKISNSFKIELKNAPEKTTLKKPAVTQKQNTSQNVSSSTVVKENKTGNDVITIDDTETVKRKINTWCLDHESTENAWMADDIIFWYIQKQIEISLDNKKFKVIDPLIWTTYRIYGVECVQDELVGFEKYFFPICENGHWVLLIIDDKRVWYSDSLADKPIEVIEDLINKLNRTQGKFNQTVPKQKDGFNCGVHVCLVAKSVITENFWYTEKDVNDFRKTVKLWLFSEGFELYSEPYKQIQNKNISVNSEKNQISDNEKNWGDKTQTVNESTLKERDEDIFLLRPHISVGVALKTEDEKNQKAENLKAPQKLKAIRRLKILKTCLKKLTAVKGKPEETERAAIPNLMAIKLKTPPKVEPVRRNPEKGENYXKSQPNKKRQIPTGKPDELVKKVREWFEIQFQAYFEDGKSFQRLEWXTGLLTAAIHKASAGDEQAVGKIIKRCPPLEIEEGEMATQTETKQKPKNQKSTKGANSSSSIREAYAENRARTFNKIIGKDDKCEIPIEKIEKFFENTTSNTNVPTETLARITSDLPKLEIGSWIEEEFREKEVAEALKKTKDTAPGVDGLRYHHLSWFDPKXKLLTKLYNECREHKKIPGHWKEAETVLLYKGGDETQAENWRPISLMPTICKLYSSLWNKRIKSVTGVLSKCQRGFQEREGCNESIAILRTAIEAAKGTKKSLSIAWLDLTNAFGSVPHESIEATLIAYGFPGMVTEVIKDMYNGASIRVKTKNEKSKQILIKSGVKQGDPISPTLFNICLESVIXRHLKSADGHKCIXSNIKLLAFADDMAILSDSKTKLQQELQKMDDDCTPLNLIFKPAKCASLIIEWGKVQKDQKIKLKGQFIRSLAEQDTYKYLGVQTGIETRVSAMQLMKKTVSELDKINCSALAXWQKLDAVKTFVLPKMTYMYANTVPKLSELKEFANITMRAIKVMQNIPVKGSPLEYVQLPIGKGGLGVACPKTTALITYLVSTMKKLWSTDDYIRKLHTDYLKMVAIKETKTKEVTLEDLASYLSDDKTVCKKAVGYNSFTRVREICKTLSKNKGALLSQLKIIAKDGKLAILVQAXKDGKTKIFTHDHVKTLQKXLKKEINEALLHRFTTEKRVKSEVVRVVQEYPQCNSFVRDGGKVSIGAHRFVHKARLNLLACNYNTWQDAATKQCRRCGYEKETQWHILSSCPKSMGGKITERHDSVLKTVKEMIQTGSLKNWKLKLDHELPGSTRLRPDIYLRSPNGSEIILGDVTIPYEHGIEAMQTAWQKKIEKYEEGFKYLRSTGKKLTIVPIVVGALGSWWKPTTDSLVSLGIDKNTVKRAIPEICSTVLEYSKNIYWNHIFGDSYQKVPMFFGGEKPKGQSWKKVKPPEGKTASNHEPPG

SEQ ID NO: 1416 - protein, 1719 aa, synthetic construct
  source 1..1719: note = Description of Artificial Sequence: Synthetic polypeptide
  VARIANT 138: note = Any amino acid
  VARIANT 766: note = Any amino acid
  VARIANT 797: note = Any amino acid
  VARIANT 966: note = Any amino acid
MTVFIDRGIGERGQMAVCSLHRYFSFSPFSPIPPYVNNGSFGENGCGTDKSLLPVIEVVVREVKINWSENILVVECLIMVKSGERVVVKRQNLEKVIQNLARINSTLFSNLGNQIFCVVPRIKDSTNKEQGYRKEKQXKFHVSFRSIKSQVPPYLRGGGDVMEDTEIRGIRKLEPEAQLDSSKPLICRVLYPTQGYMYKCFYPKCKGHSNGSTDLRSLKKHMVDKHFTNIEFAYKCATCMFLTTGKSATALKSIKAHMASHHKVTMEPGKKSLVQKLNARLEEAAPSLPMPRNRSKVIQLTPEKSISELEKKKQTRSVAKQLSTLKESAQKKEEEVKIAEVKKREPRLSIIPESNVRRSLAAGLEQCINPEQSVAQRIREKREEYAKASREAAAKRRSSLAMKPARLPDKENEITLQETKKIDDPIVIDLEKECILTTVLQVPRNQFNSWCLEHETTIDAWLTDEVIHMYMCTITENRKYFMAIDPVLWPVYVRNGAEDLLRRTSCPGTFFFPICESNHWVLLVIEHDVYWYLDPKGEEPKGNVEILLESMKRKRQYYEFPPPSQRDNVNCGVHVCLMAKSIVDECGYNWYSEEDVRSFRTNMKDILKSKGYELCPEPYNRQNLLKTEKQKEVILEEMIDSFVVEDDMTFTVHRDSDHGDDEVEHLKTIEQEPENEISEIENVEGSVDSVIPKLMEMRVQTPPVINEKRGKKRVSAKEKPRKQKEKEQKVPTGKPDELVKRVRVWFEKEFKSYVEDGKSFQRLEWXTDVLTAAIQKASAGDEKAVELIEKRCPPLEXEEGEMCTQTEKKKKPKSGKGNGGQESMKSLMASYSENRAKTYNRIIGKHSKQCEIPIAKVQKFFEGTTAETNVPKETLKEMCSRLPKVEVGTWIEGEFSESEVTEALKKTKDTAPGVDGLRYHHLKWFDPELKMLSQIYNECREHRKIPKHWKEAETILLYKGGDESKXDNWRPISLMPTIYKLYSSLWNRRIRAVKGVMSKCQRGFQEREGCNESIGILRTAIDVAKGKKRNIAVAWLDLTNAFGSVPHELIKETLESYGFPEIVVDVVEDMYRDASIRVTTRTEKSDQIMIKSGVKQGDPISPTLFNMCLESVIRRHLDRSVGHRCLKTKIKVLAFADDMAVLAESSEQLQKELTAMDADCSALNLLFKPAKCASLILEKGIVNRLNEVVLRGKPIRNLMENETYKYLGVQTGTETRVSIMDHITEVSREIDLVNMSQLAMHQKLDILKAFILPKMTYMYQNTTPKLSELKVFANLVMRSVKEFHNIPLKGSPLEYVQLPVGKGGLGVACPKNTALLTFLVTIMKKLWSSDSYIRKLYTDYLEEVAKVEIGKFEVNLNDLAEFLSDERAVDSKLFGFNAFTRVREVVRSLCKNKDSPLHSLKIIEREGKLAISVQATEESIEKIFTEDQEKKLMYLLKGELNTALQHRFFTQKVFKSEVMRVVQQHPQSNSFVRNGGKMSFSAQRFVHPGRLNQLPCNYNTWAKGRTKLCRRCAKNENETQSHILQVCDYSIGNIIKERHDAVLYKFRELIKRGSKGHWLERTDRTVPNTGSQLKPDLYLESPDGKHVILADVTVPYERGIEGMQKAWNEKINKYTDGYKEIFRRQGKSLVVLPLVVGSLGTWWKPTEESLIKLGVEKTTVRRIIPETCGMVAEYSKNCYWRHIYGEKYVQTPMINGGKKPEGNDWKKCEKGIEVPKVTN

SEQ ID NO: 1417 - protein, 1888 aa, synthetic construct
  source 1..1888: note = Description of Artificial Sequence: Synthetic polypeptide
MIPVLGTGGPEKLPLQSYVYCGNTAITDSFTPTAKTILKPEEQNLDIVLKNIAALNPENYSDLIRSLSKMEFRLDYPKEIENYWISEKLFSQSIASLPISLLVASMFSPEDRDLSTEPFHCNADGCNFHCDNCERMVEHIREHHNTDPMINTFETTEDTFRRITAIKIDKTGIEELNPLKYRCSYCDELFTEAEDHAIHMISHLTEKLSPDISFFFNDILRLYKTIDKPTVQNLFPETQVAIFDTLEETNRFRLIVGREAIETIEEAFPPSPPGTDRKPSIIITDTCQLRFVPCMDEPPKGDLGILTLLLRDFSAHNIPIKSLNNKELIADKDIDYSPDFVEGALANAEEHDTTNSQNNNGRYINSAEKLTEFLIQCEDYLTNIKTLEDLERFYTTIKDYRVNKEVIAEDTPIFVYFLVEEGKLPKPGLRCPLESYEGHEDKAFESLRKLCDHFKGEIAKTSFDPKVHTIDIWVEFLAQAYGTGTFVYKDENGNIDLDTHVFKCPYADCSYTNNDRSKLMDHMKTKKHAKNVYIERYGFFWGIVIEGVNRPKGIVYPTLKDIKEHACRKCPEAGCNTYVTELSDIKEHLKKKHKSTTAGVDGEIAHTDATYCWITKEELDALHAERARERAEQVDNTPVQQIINADNNEENNENQEDNGNNEEADALDPPNNTTETEDEAVHAVIINPPATEEEEVAIIAEARRNIPELQQAEERGCVTPKMTSLVRLKLLKGGGELFNKKLTPLATRYAATGNTEADKIKVDYLTLKCNAALREMIYTNNHSESKFMTAENGEDTAPPPRISEDTRDRIQKAANEIKGTLIKVVKHISHARCLKDSTRDDEHNKFVEMIAKIKNDLRDNKFEQYNIEEIFQGPISDQSILNIVNTEDNNEFIKKMDYINRILGTPQDASPYARKKLQACFADNPTKTLRNIILADKVPQQSLKPSEYLDYYGPQWANEAEGYENFLHHDYALPERYGQVFANDFLDFMTNESKIIEVIRNKNHLSAHGLDGIPNSVYMLFPVSAAKFLSILFRSIIISGHIPDCWKLSKTVMLFKKDDPSLAKNWRPIGITSCTYRIFMTLVNKALQMIPMFHAMQKGFVRGATLSEHIAVANEVLCQSTRTQSEMFQTAIDFTNAFGTVPHQLIFDSLEAKKVPDSIINLLKDLYKGARTAIYTRHAHSEIVPVRRGVIQGCPLSPILFNCCLDPLLYAVQRRHFEDGYRFQDKAGQYSIAIQAYADDVLVISPTHEGMQRILNTVDEFQKIAKLKVAPQKCVTLAKTSTAIQPFRIGPDEIPIKTSMDNITYLGIPISGTKTSRFAAATGILEKVKAQIRVVFASHLALSQKIIALRVFILPQLDFYMFHNVFRVNDLKATDQMIRGLIDKEAPTSNIPVSFFYMPKNKGGFGLVKLELRQPQLVLTKFARLWLSQQAETKAFFHTMAQEEKSFRKVVEDQENGFLGIKMENGKIVQKNERSKRTNCFITQAAKAADKLEVRFKEWDKGGIQVRGVGENATDWYRSKHIGQISPLIGRVIQQRQYEEFKKDETHSHTFCEPAALAESHDIMKRPQAVPNNLYSAAIALRTNTAPTPANMHFHNPEVLANCPLCGCQSCTLFHTLNMCRNRFSLYKWRHNIICDDIYQFIHDHYPGVTIKCSARITSDGYQTTGPELDDTVKDLLPDLVVYDEANKMIKIIEVTCPYGTDNNVGNSLDAAYDKKVNKYKSLAEQTERLFNWTTTLSIIVVSSLGVIPLRTKLDALRISPADHIQLLKRLSMHAIAASACIVFEKVPEFFGMRCRPLPGRVTAPNAAIPPNNNENNNDTDHGQENQQATSEEQPTNNGNAQEDNGQGEQINNSTEQTISVDQIIEEDAENNAIEQALDQPDEDEFLN

SEQ ID NO: 1418 - protein, 1734 aa, synthetic construct
  source 1..1734: note = Description of Artificial Sequence: Synthetic polypeptide
  VARIANT 5: note = Any amino acid
  VARIANT 8: note = Any amino acid
  VARIANT 11: note = Any amino acid
  VARIANT 17: note = Any amino acid
  VARIANT 22: note = Any amino acid
  VARIANT 51: note = Any amino acid
  VARIANT 59: note = Any amino acid
  VARIANT 62: note = Any amino acid
  VARIANT 73: note = Any amino acid
MRYHXSNXPAXRTSDNXWRSIXKDVRRPDPSTIEEKSRYNRSIGIPDSLKXRSSAVRSXSSXPPSGPQDVRLXNSPSLDDRRRLVDCETTLGSYREWTDKPMMGKMTYAAVTKRAPPRPQTGGARLSTNLLADEMEIKYRDTNDIRLVIDLPNPHLIKCPLCKSCISARGRGANALKYMKRHIADAHHLNADFVYKCSRCQEHEPENVCGAKWIVNHLKRVHGYTLEDAVSTAKPSTRQQIANAFNDSAPFIDARKTSDVPEKKSREAGLEKFLAPTKSEDTREKTPPSTRKSSESSEASIQSTIQETLSESSDTLTVQEIINISSEDEMDEEPPKRRVNVWALIHENGKDAWIDSDLMVIFLESRARGYESCSIIDPLNFICTDMSYLTTIVRRRMEEGYKKIIFPLCANDHWTLVTITGSTATFYDPMGNEPTETVKKMIDELDLEMQLAPSNSPRQRDSWNCGVFVMKMAEAYIKDTQWDLTDVDTDVKTFRRSLLTELKAKFNIFAEDIQTYRPPSRKALTRNSQSPVVVCHKCSRPATPIQDVSRMEVEEAPVLVPTPEEPPQEWTFVGKNRKRGVTSRTPNTSPEAKRPAFPPVPLKPSANRWHFPEEETEKMEVSSADEVKNSTPPKPPKIPNLLAMKIASPVPLKRGNPSKKHGKGHMMNTARKGPTKKEMPKGEPANLIVKIRSWFDEQLKMYKDEGSNLQRLTWLSDSLTAAIGKAFNGNKYIVDQIIKRNPPPLVEKGAMSTQTSRKRDEFKPRERMAQEPNEPLRIQYAKNRQKTFFKIIGKQSEQCTINIETVEQHFRKTLKAPVVSENAIKTVCGSIKKVLMPKTIEDPISSVEVKSILTKVKDTSPGTDGVKYSNLRWFDPEGERLAKLFEECRKHREIPSHWKEAETILLPKDCSDEEKKKPENWRPIALMATIYKLYSAVWSRRISGVQGVISPCQRGFQSLDGCNESIGILRMCIDTASVLNRNLSCSWLDLTNAFGSVPHELIRRSLESFGYPQSVIQIVTDMYKGATMKVKTADQKTQSIKIEAGVKQGDPISPTLFNICLEGIIRMHQMREKGYDCVGHKVRCLAFADDLAILTNNKDEMQEVIDKLDADCRSVSLIFKPRKCASLTIVRGAVDKYAKIRINGDAIRTMADRDTYRYLGVKTGVGGRASETEALIQVVKELQKVHETDLAPHQKLDILKTFLLPRLQHLYRNATPKLSELREFENVVMKSVKRYHNIPIKGSPVEYVQIPVKKGGLGVLSPRLTCLITFLTSTLCKLWSDDPFISSIHKDALSRITVKAMGLTTQSATIKETCEYLNTRKAVTKGGYSLFCRMNESLRTLSVIQGAPLKSMEFIPVNNEIGIAVQATKDSEIKVFTKADSLKLMSKLKDLVRSAMLKRFLEEKSVKSRVTQVLQHHPQSNRFVRDGRNCSIAAQRFVHPARLNLLSCNANTYDVNHPKGCRRCQADFESQQHILQNCHYSLAGGITQRHDRVMNRILQEIGNGRKAHYKIMVDMETGATRERPDIIMEERDGPEVLLADVTVPYENGVQAVERAWDKKIEKYKHFLDYYRKIGKKATILPLVVGSLGTYWPDTSHSLKMLGLSDGQIRNVIPEICQIALESSKNIYWKHILGDSYKTVEGLFCQRNNKEVRFEGKGEKHHVSQRFQPLKCEKVRTMKSTKEEGRSRSNAKKGPNWRRSKSESDGRSVSKGRYWRDPSNKPPHSKMTQSALAKR

SEQ ID NO: 1419 - protein, 1723 aa, synthetic construct
  source 1..1723: note = Description of Artificial Sequence: Synthetic polypeptide
  VARIANT 255: note = Any amino acid
  VARIANT 658: note = Any amino acid
  VARIANT 1425: note = Any amino acid
  VARIANT 1494: note = Any amino acid
MTNVYLKPVNDNQTNKTGDNSRNTMSNSQCEMTWKPVARTYAQAASTNPADDKTVTVLGCKYNLLKLGNTPQTSKRSPPKPSRGGARISSVYTLTDELEITHREEGKITFAIDLPNKNNILCPLCRECTQTRGRGSSFTKHMKLHVKEKHQLDATFIYKCSMCNEYEPEKKCGTKWIQTHLQKVHNYKYDESAIVVPVPPNTRQQIANELNNAAPFVDIRKPKAAAVEEKKTENGALLKFLTKSNKDDQVKSPSXDIPDAESPEKETQALTIDPKGNNSPSKSSIRSSQSSASSVCQEIQEIITLSEDEDPKGARPKPGINVWSLINETGKDAYIDTDIMMAFLKMRVENCDSVNIIDPLNYQFPARVDLVPLIQRNLEDGKKRVVFPICADEHWTLLTISNGIAAFYDPTGSRMSSYIEELVNELGLIIPKEQDEQPRQRDSYNCGVFVMKMAEAFIQDTEWEMEEVEEDVKNFRRNLLEELKPNYEIFAEKIKYYNSPGKSFAQSRPTSRSSQCAVCPTCSRSATPMMDVGNMEVDPVPQQQETPKSREPEQDEGWKVVGKARKRGVVTERSPNISPEAKRQFTGPEIKVVSPGKFHPLVGETEEMEVTCDSPPTKEPTTEPKVTPSLPAMKIASPEVTKKQTSKKKGKYGKKKQXTKKAQPPKGEPTKKAQPKGEPAKLIEQVRTWFDKQMKSYQEQGSNIQTLTWIADSLTAAIFKANSGNKYLVDKITARCPPPLLNEGEMATQTSRRTEAVKPKDRFVKESNEPLRIQYAKNRAKTFNVIIGKHSARCEIDINVVENHFRQTLKAQPVTEEALNTVCSGIKKAKVDPSIEGPISSGEVKAILAKIKDTSPGTDGVKYSDLKWFDPEGERLALLFDECRQHGKIPSHWKEAETVLLPKDCTEEERKKPENWRPISLMATVYKLYSSVWNRRISSVKGVISDCQRGFQAIDGCNESIGILRMCIDTATVLNRNLSCSWLDLTNAFGSVPHELIRRSLAAFGYPESVINIISDMYNGSSMRVKTAEQKTQNIMIEAGVKQGDPISPTLFNICLEGIIRRHQTRKTGYNCVGNDVRCLAFADDLAILTNNQDEMQDVLNQLDKDCRSVALIFKPKKCASLTIKKGSVDQYARIKIHGMPIRTMSDGDTYKYLGVQTGNGGRASESESLTQIAAELQMVHDTDLAPNQKLDVLKAFILPRLQHMYRNATPKLTELKEFENTVMKSVKMYHNIPIKGSPLEYVQIPVKNGGLGVMSPRFTCLITFLASTLFKLWSDDEYISSIHKKALSRITAKVMGLKTQKATLQEQCEYLNTKKAITKGGYSLFSRMNEAIRTLSVNLGAPLKSMQFIPENGEIALEVQASENSQIKVFSKADSMKLVTKLKDLVKSAMLKNFLENKKVKSKVVQVLQHHPQSNKFVNDGKNXSISSQKFVHPARLSQLVCNGNSYSKDLPKNCRWCGYECESQAHILQHCTYSLSSGITQRHDRVLNRILXEVIKGRKNNDYYDIMVDTEPGPTRERPDIIMIQKDGPEVLLADVTVPYENGVVAIEAAWDWKMEKYSHFIDYFARLGKRAVILPLVVGSLGTYWPDTSNSLRMLGLSDGQIRNLIPDISMIALESSKQIYWRHIFGDSYRIVSDLYCRKDQQEIRFGDEPMENVQVSDRFQPFKTREREKKSEEEKKRRSKSKKGKTWRGSKKQTDSRQSGKSNQNQGFQRSVGQGVSR

SEQ ID NO: 1420 - protein, 2017 aa, synthetic construct
  source 1..2017: note = Description of Artificial Sequence: Synthetic polypeptide
MTKTEWSWRHRSRSRSVGIVVKIDTSDYANVRVHVAADLSNEDGHTSHNNGIILPIPMKPSVDRFCQIQYPPRGYYVPHPQSQKGHDAKPSRHWNEEAQPPYYHNNNHGRRGRSAKPSGRRPPRKPILQEESLAAHPQIPGDTASAVPLYSDVVNNENKSQGKPPQGSHRRSGRPGTKPSVPVGEAEQETNSRPIAPEPIVKFKHDKHGWTTVQGSHSSGRPVPKPSVPVVSEANRFQLLQEGDFPPLTTSESSQEEIKVPNYQRIVSPIPLPSEEDSKLPTKSNYRAPKGRKSRNYKKPQQQNPKKYQQRLPYQPKVNNAPTDRMAPEQLKGGGGKTAHNDIEEMEIEEDTDEKIIQVKRIKIVNKLTPHHFVCMMTYPTDNIYRCFVKGCTATSQGGWGAEDLKYLTVHIRQEHKIKVEWTYECGICGDLSGGAGKHISKWIKPHMRKKHNRDAPTNFKMGSRSSGKPKITELLEESAPSCSNPRRKTLNQKKTAIITQVTPEKLKTGYQTRSVTKALSVLKESRQKELEVLREEEKANAKQKSKLHPFFTKAPHIDGVKPTVRRELSKMITPGGEHKGTKIPMVHTKRGLIQKINRKAKKAKPMHLDESTIIEASQLDVITIDDDDEDDNMTPMRRRFNTWCLDHETTQEAWLTDDVINWYLKDLCFGNEQYMLVDPLVWLIYKMGGMAGVEQRFKSKKTCLFPICEADHWILLVFDETNLCYANSLGSQPNGQVKNFIQQLNRKLCSFEKEVPLQKDSVNCGVHVCLIAKSIVNGQFWYDDSDVRTFRTNAKAALKAQGYELFSEAPKQIENPDSSHREDIKENSMEMCSESLMIVATPQRSEAPMELVDTEPSDLESPKSDRVVYEDCITALSDVSEPRMTPEKSETPEVPVVEERDLDWPKLESPKSDRVVYEDCITDLSDVSEQRMTPEKCETPEAPLVVECVELERLPKDLPVTDRSTVVAIPEAVKLEEKSEVVIPRLMELSYTVPPEPSPVVEYTQPYTHTHTKPKVKATCQMGKKRKVPTGKPDELIQIVRQWFEKEFNDYVTEGRNFQRLEWLTNLLTAAIQKASAGDEETIEKIRKRCPPPEVRENEMSTQTSQRQKPTTTNQKKRSRNTTQSDTQANTYWRNRAKTYNQIIGQDFKQCDIPIAILEEFYKKTTSVTNVPQETLVKVTSRLPRLDIGKWIEDPFTEQEVFGALKKTKDTAPGTDGLRYYHLQWFDPDCKMLSSIYNECQHHLKIPAQWKEAETILLFKSGDESKPDNWRPISLMPTIYKLYSSLWNRRIRTVKGIMSKCQRGFQEREGCNESIGILRSAIDVAKGKRSHLSVAWLDLTNAFGSVPHELIESTLSAYGFPEMVVHIVKDMYKDASIRVKNRTEKSEQIMIKSGVKQGDPISPTLFNMCLETVIRRHLKESSGHKCIDTRIKLLAFADDMAVLAESKEQLQKELTEMDEDCTPLNLIFKPAKCASLIIEFGKVRTHEQIMLKREPIRNLNDDGTYKYLGVHTGADARTSEEELIISVTKEVDLVNRSALTPPQKLDCLKTFTLPKMTYMYANAIPKLTELSAFANMVMRGVKIIHYIPVRGSPLEYIQIPTGKGGLGVPCPRITALITFLVSTMKKLWSDDEYIRKLYNSYLKKVVEAETGIVEVSTKDLAEYLSNKVPSRKHEFGYNCYSRIREVCNGLALNQAAPLYKLEFIEQDNELAVVVQPTEESKERIFTKDHVKKLQSLLKASVNDALLHRFLTTKPVKSEVVQVLQQHPQSNSFVRMGGKVSISVHVWIHRSRLNQLTCNYNIFDPKQPKNCRRCGYKNETQWHILQDCTYGWAKLIRERHDAVHHKVVTMICAGAKKNWGRKIDQELPGFTSLRPDICLTSPDGKEVIFADVCVPYSRTRNIEFAWKEKIRKYTEGYSHLVAQGIKVTVLPIAIGSLGTWWTPTNESLYQLGISKSDIRSAIPLLCSTVMEYSKNAYWNHIYGNSYTSVPLRYGHQKPDGDDWKKELSCEPVLALQQ

SEQ ID NO: 1421 - protein, 1560 aa, synthetic construct
  source 1..1560: note = Description of Artificial Sequence: Synthetic polypeptide
  VARIANT 326: note = Any amino acid
  VARIANT 367: note = Any amino acid
  VARIANT 588: note = Any amino acid
  VARIANT 755: note = Any amino acid
  VARIANT 909: note = Any amino acid
  VARIANT 1171: note = Any amino acid
  VARIANT 1315: note = Any amino acid
  VARIANT 1389: note = Any amino acid
MNVDLDATIKSIGMNTKETTYPNSQLRVETTPCTSTTIMHASCNTTSTISYSPLPSAVSLPESPASSITITTTDDNCDIIETPYPLPQTNGDLSEILKDIEANKDTTMSNKVLDCDSDSGDDRDMIIENDRESDMDLFSQSLLNTNQSDERREKNLTENAPTEITTEKSYFDIISKASDNTTSKKLLNVKNELTAGLPPMPPVTNTAKFIRNVRPEDIADPTLYRLDSRGKLGCRTQYKKPGCGDIAVYDYEAIVEHAAFIHTIPFNEQNNVDCQPCHPKKGKDVHTIVLIKYADIFNHIEAHSHVVQTAITDNMKTYLRLTKENXFYCSYRNNKKKNKCKKAFNLESNMMDITEHMKTHTGYSFDXNLNILCYCGIWKPFTELIAHIKTEHLQEYINSIPNKENIHNTTTIVSPLNFAGILASGETQNIPDEEIIKPRDLPENLAFNRNIENELSWSQHLVKAYIFSYAVKTSTIFINPYTCNALIQCNYKTFFETFPFKDFAKWNEIVLPIHNNTSSWSFFFLNKKKRVAMIIDPTADDSHTLHFELATDILRTILNVQNIFEDLNFPLTEVEYPVCHEANLSAFXVCHFLKCLMSDLPIDIPDIDHMKETMRPIIRKYNCAKFPESDVRNYRVLIEDLIYQLNLDTITCEEILCEIERINGRLNPKRYFKESKPKTDIIHLQKKKSAELLCVKRLKFQISQKTEIGKIWENDDVDHRPPMARFLKTFASQDCPVSNTSSINLPYYMDTDTDXCTDCENLSHIMKNLDSSAPGMDLITGGDWKKISPKHELITAICNCILRNKVCPEKWKLFRTVLILKPGKMSESFRANSWRPLAIMDTAYRIFTTLLNNRLLQWIRNGNLISPNQKAIGIPDGCAEHNATLHFAIDRAKRCKTELHIVWLDIADXFGSLPHDLIWYTLANMGLKNETLTLIKELYKDVKTIFDCQGTLSEPVPITKGVKQGCPLSMTLFCLSIDYILKSILTNYPFLLHDLNISILAYADDLVLLSDSYLEIKKSLESTVELAAFANLKFKPSKSGYLSINNVNSDILKLHLYNEEIPTISENNKYRYLGVDFSYKRNQDVDGRLGSALALTRSLFKSYLHPAQKLNAYKTFIHSKLIFSLRNCVIGHRILDCDRNRVTQGREKQLGFDQEIKALLKTMIGDKFQAXNNYFPYTHCKLGGLGITSAIDEYLIQSITGITRLFHSSNLSFRKMLITELAHSRGGKNFEAGLKWLNCEVNKAFPNTSFFVKFQKSALALKRKFCICVNLKFVEDNFSLEMTYKKRTSYVNHQNLSTLSKELHDFVGLYYAEQXCQMRVQGHIATAIGDSITAKYLIASDILNDAQYYFLVRARNNLLNLNYNAYRLKYNIGTKCRLCHLDEETQAHXFNHCRAKPNARRVKHENVLVSIVAFLEKIGFEIDVEKSPKYISIPTKLKPDMVIRSKRNKDIHVLDLKVPYDSGEGFEKAREDNYVKYKDLAIEIGKAFNQKATISAVVIGCLGTWDKKNNAALSKIGLTKTEIISLARIACPNAVIACYHIYREHVSFTKSAMALPFSLA

SEQ ID NO: 1422 - protein, 1171 aa, synthetic construct
  source 1..1171: note = Description of Artificial Sequence: Synthetic polypeptide
TTGRNLGQWSCYSRSIQQSNYSFKLSSTEVGELVEQSPAPLQSPQFSNNYNNLNINNNLYYSLNTFNQSNNLCCLVNIEFFPTQHLLGDIVNSGCINYMNNYNNFDNINLYINSNVLSYNNYNHSFLASPYTTNITEHADINMHVQEVNMQQDNNTQHAITQQVSLQATSLQHTLDEMIVQFNTAVRLKKKHKVAKIFRGHNHRKDLPTLPAREQYKTKPKLAIREVLHRKTTATSSPSENAIKAFFSSYSRPAELFTGQELLESSWFPVHPEDDFEFRIPGRDQIAKYIKFASKSAAGLDWITYEDIKLGDPSGEILQPIFEYIVQNNICPSEGKASRTIMIPKPGKSDYSDPSSWRPITITSAVYRLLMKYLTWELYNWILLNQMLSRSQKSLGKFEGCHDHNAMLNMLIQDVRRQTNPSNPINKNKRLYIVFLDFTNAFGSVPLDTLMYVPQRFGLGTSALTLIKNLYLDNYTNVTCGESKIENVKLNKGVKQGCPLSMLLFNIFINIIIRAIEAMPDVHGYPLGDMDIRILAYADDIALISDSHKDLQEMVYKAEYIGRILGLLFNPSKCALMDIPHDKKRTPPILVNGEMIKCVGKADPYKYLGTFRSWFRKLDIKELLQMMMDETKLITESNLHPHQKIHAYETFIHSQLPFHLRHSRIPFSDFITNRKTNKTTNNSNDSEKSIQKAYDPESGQLFLNTFALPSGCAKDFFYITKDAGGPQLTSGLDEYLIQSIMYIFRLLGSEDPTLNSAIKHDLISHLNLKGFVNINFSQAISIFNSNFTDRTDHFSHLSRTEWARLQLARKKLKSTLAIQTNVCLINGHLVLTLSLENNVLLIDSKEKGDVKKIHASLMGFLRLAHLIRLQKHGWSKLLFSATTHHEILNKRILNGHVPYKIWYFIHRARLGLLPTKLFSVSNLCRKCGGKKETMSHALVNCPMMQTLINERHDALEISLVQILSSKFQGTVIRQKTYVNELRPDITMESDTQYYLVEVKCPFDTKMSFELRTQQTTDKYNIIIEILEDVHPGKEVRLVTFIVGTLGSWGPQNSDFLRDLGFSKDEIDQVKTRLMLQNINSSCEQWKRFVQYAPTITPGPIPDAESEDDQGTSDNGPTAATVQGPVIGDEEEELQIYDSGLDESSDDEPDPDDAELLFTIDIEQYLNSVITD

SEQ ID NO: 1423 - protein, 1591 aa, synthetic construct
  source 1..1591: note = Description of Artificial Sequence: Synthetic polypeptide
  VARIANT 6: note = Any amino acid
  VARIANT 16: note = Any amino acid
  VARIANT 23: note = Any amino acid
  VARIANT 25: note = Any amino acid
  VARIANT 26: note = Any amino acid
  VARIANT 34: note = Any amino acid
  VARIANT 35: note = Any amino acid
  VARIANT 37: note = Any amino acid
  VARIANT 38: note = Any amino acid
  VARIANT 40: note = Any amino acid
  VARIANT 41: note = Any amino acid
  VARIANT 54: note = Any amino acid
  VARIANT 59: note = Any amino acid
  VARIANT 68: note = Any amino acid
  VARIANT 72: note = Any amino acid
  VARIANT 76: note = Any amino acid
  VARIANT 78: note = Any amino acid
  VARIANT 79: note = Any amino acid
  VARIANT 81: note = Any amino acid
  VARIANT 90: note = Any amino acid
  VARIANT 93: note = Any amino acid
  VARIANT 108: note = Any amino acid
  VARIANT 111: note = Any amino acid
  VARIANT 112: note = Any amino acid
  VARIANT 125: note = Any amino acid
  VARIANT 178: note = Any amino acid
  VARIANT 241: note = Any amino acid
  VARIANT 243: note = Any amino acid
  VARIANT 279: note = Any amino acid
  VARIANT 311: note = Any amino acid
  VARIANT 324: note = Any amino acid
  VARIANT 364: note = Any amino acid
  VARIANT 366: note = Any amino acid
  VARIANT 408: note = Any amino acid
  VARIANT 478: note = Any amino acid
MESPAXIFEKIDAALXIYSAAAXLXXNSLSLSPXXAXXSXXAAPASSTPQKTQXKPIPXTTLGASRKXRTTXKDEXIXXWXKKAPVDTSXGRXSTRRTALRDLTSRSXNIXXALQEEDPRRTPPXSRDQDAERRPAAPEKAATRGAPPTIQDQDADRCPAGRDATGGAPRRPRTRMLXAAPLGRMPPEEPPPTTRDQDADRRPAAPERDAPEGTTSSTPDPETTYHPPVRRRAAPRGTHSXAXDLDAARCPSGQRDIVASESSTPPGATSPPQASLPDXEESPAESAGTTEVRPTEGEAGEDDCIYLQYPXPTGLLLCPFCLPXHGVQTLGALSKHVRKAHNKRIAFRCSRCDAPFETQKKCKXHXATCKGPLTTAKVNPTDTLRVPTPTPTDGPASAPQPASPEPQXVRGDQPPTEGSATPASRTDDATKRTSPASRIPTLDPAVRGITATSQVSDLTRCLSDLIKTIRHNTDTRRXSAPPQVTSCRPAVGATSTAPQAARRDPANGGASRSPQIPRPDPAPGRPNTSSKVTQRDSDRQKPHAPPRTPQPDTTRRRTRTIPSASKHDRAPTKPNTGVSRTPLPPGRSSAASETPRAAPPPPHQDPRLKTHLNTAPQSEGQQGHRLSPQHLNPRRQRSRRNDGREQRVATPWQSAWMEELAKAEDFETFDTLMDRLTAELSAEITARRREPQEASRATRRFPAPTRNNTAREGRRGDVGRRYDPAAASRIQKLYRTNRTKAMREILDGTSSYCAIQPERLYSYFKDVFDHEAQTNLQRPECLLPLPRINLTEDLERDFSPQEVQARLMRTKNTAPGKDGIRYHLLKKRDPGCLVLAAIFTKCKQFHRVPRSWKKSMTVLIHKKGERDDPGNWRPISLCSTIYKLYASCLAARITDWSVCGGAVSSVQKGFMSCEGCYEHNFLLQTAIQEARRSKRQCAVAWLDLTNAFGSIPHHHIFATLGEFGMPETFIQILRDLYKDCTTTIRATDGETDAIPIRRGVKQGCPLSPIIFNLAMEPLIRAISSGPTGFDLHGKKISILAYADDLALVADSSESLQQMLDVTSQAAEWMGLRFNPKKCASLHVDGGARALVRPSRFLIQGEPMASLEEGEVYQHLGTPTGVRVRQTPEDTIAEILRDAAQIDSSLLAPWQKINALNTFLIPRISFVLRGSAVAKVPLNKADSTIRQLVKKWLYLPQRASTDIIYISHRQGGANVPRMGDLCDVAVMTHAFRLLTCPDPTVRSIAQEAVRDVVRKRIARAPSEQDIATYLSGSLEAEFGREGGDLSSLWSRARNASRRLGKRIGCCWKWCEERRELGILVPRIKTPDHTIVTPTARAMLERTLKDAIRCHYAENLKRKPDQGKVFEVSSKWDASNHFLPGGSFTRFADWRFVHRARLNCVPLNGAIRHGNRDKRCRKCGYANETLPHVLCGCKQHSGAWRHRHNAIQNRLVKAIPPSLGKITLDSAIPGTDSRLRPDIVVTDAEKKKVLMVDVTVPFENRSPAFHEARARKALKYTPLAETLRAQGYEVQIHALIVGALGSWDPHNEPVLRACGVGRRYARLMRQLMVSDTIRWSRDIYTEHITGHRQYHTE

SEQ ID NO: 1424 - protein, 1352 aa, synthetic construct
  source 1..1352: note = Description of Artificial Sequence: Synthetic polypeptide
MAAKSVACPHDGCANKYASEASLRRHIKNKHATDEEGDETSHSCPHCHRPFSTARGLSVHIGKSHRQAPPEPTRPPPAPAPADPGLDPDPGPTVTPPSRDDEDREEPDDDPVEIADLSCPHCAQALPSAHGLANHLRACKDHRVPAPGAPRSGPPSSRYWTAVEHHRYVEAMARFADHPDLLARAAAHIGTRTYKQVDSHRTKVIAAEREGRPVRTLDPTMDWRMRPYCASTTARWLAEQGRSPVAPRSPCPEPHAPPPAAALLYIPATPPAPTPRAPVAPPKLAPPAESTVPATPDGNPEAPAPPFSAPGPPTPKALPPPPPSRRNLRPHLVPKDAWQGVADAVAPAASRLLRTPLAHLSTEQWATFEAALAGLEATLHHAARSAEAVPTRCASRAREDAERQLREARKTREIFGKAAALYAAGKDPTATIERIPPEVRLHLPTPGSAEWPARAAAARRVIRRAVARADRLRKRMGILDSDRDLQRLFNANQKKAVRQILAPSTKAPRCQLDPAAVEEAYIQTLAKPPPIDPSPPWKNSVQWPRPPTAADDGGSPFSVAEVRAQLRRLPNGSAPGIDGIPYEAYKRTKLDATLAHVFEVVRLNARLPARWDVARTVLLYKKGDPNDTGNWRPISLQVTIYKIFTAALSKRLISWAGKHNTFSASQKGFLPAEGCHEHAFVLRSVLDDARRHKQNVYLAWYDLRNAFGSVSHDLIAWCAAMLGLPRYLRDAIGAIYRHSALFVQVGDQETTGVIPMRCGVKQGCPLSPLLFNLCVEPALRCLRRTTGYKFYGTSITVEGQAYADDLLTAAPSAYHAARQVATIEEWANWAGVSFVVQALSLDAPAGKCAALAINFEGGLMHSIDPALKVQGAAIPAMSRNNVYRYLGVHVGLTDALGQANELLEKASRDARTICASGLEPWQKVVAIKTFILSRLPFFFHNGKIQRGRCQQFDRELRENLRAALRLPVCTTNAFFHSRVASGGLGILPIAEEQQVYLAAHVFKLLTSPDLSIRAIARHQLAEVTHARHTTPVQDGEASPFFGWLMRGQEVASTTPSGDVSSIWFAAAGAYSRMGWSVRDALHPTLTVGPGVQFEGRFQRANVIPALRASAFSRHAVEWSALRTQGRAAAYQHAVHPATHHWVHNSAGLTTKEYRFAIKCRLGLLPTRAAPHHRNGPTACRACSYARETANHVLGHCPATKAEVIARHNRICRALAQAAEASWTSVLEDVPIPGVDSPLRPDIYCSRPGQCAIIEVAVSYEDAFNASMEGRAKQKTDKYAGLAATVEEQLRLQTRHAAFVVGFSGVVLPASVTATATSLDLPPKTWNVLLKRCVAASIKGSYTAWRRFRRSTP

SEQ ID NO: 1425 - protein, 2004 aa, synthetic construct
  source 1..2004: note = Description of Artificial Sequence: Synthetic polypeptide
  VARIANT 148: note = Any amino acid
  VARIANT 324: note = Any amino acid
  VARIANT 759: note = Any amino acid
  VARIANT 912: note = Any amino acid
  VARIANT 1400: note = Any amino acid
VCSVRGCRREDSRRFYKFKFPLNFVKVPKTIVIGSAFQKSSVSARSQNHSRSTRVPKTRQPRTSNTIGRYTAASANNYLTVIITGNYTVFAQWICYRECTWLLSKFVNFFLTIIGYFFQLRLVVIYEGPVILDTFSNCGSSLFMRGQXSKALLVRLNRSALAMADPQVHYIDYPLPPRVKCVKCFGAEGAGKVKGEYSDPPHLAKHLKKCHPGDTLNYKCSICDLRGTGKYPLRDVKAHYAECHVSPAVDAAGPSTRGSLGECSGAGQPTASRAAKATTRLAETVGGTDKRRAATSGSRQLTLPFAATPSPSTAAGEARAPRSXSTTPTSRSPSYAAVTAGPPSMRSTTTSTTARSKTVAKGAAPNTTTTTTARRSGEAAATRKPPTTATVSKPRVLSVETVRLPVDDIQRAGVQNAAKPARAPSRPPQRTSPEAGGPRTTGAKEKCGEGAYKKLPANSGNPISTRTRRATSVPVEKSEGTARRERVSPHPPPKGIDIILSSTSEEEGTPYQPGGVGRLRLRRKKVTGPPPKMTPREGVVTRARRSTSAPVEKSALDARLTALDRTSSRATGNPTSQIAGGLYTSRGQPERTPPARLPSLSPTTRGSPSGSLGEIRTPISPATSLPATLTTCTVTTTTCGSPITSTGFTGGVGRLITPPSLPQTNILPTIGEEGTSPCVAVVTTHPRPTGEDAPCEAPQPVSDHQRQSIGEPRRDTDTHLACDVATGNAHHLHGDDDHLWKPHNIHGLHRWRGEADNTXEPPPNEHPPDHRGGRNVTVRGGRHHPSLGGRSTSPLILPRPTTPEPERGQEERRLEGAAQPPTTPVVEGDNQWDGQWTVSVRRRARRQQLNDTSPSNSESPPTAGPSRSPRIAPLSALIAASTSRHETSLNLNCTNGNICMDRTPPRNILPVXAERRRETSPQDRVEGDIGYGAGKVSAEHPSAPVNVRGVMSRGRATASSIVPPRANRGEGGRQHHSRRRPDAPVGQPSRDHPAPATVARQRRRERVAARDALLDRAKDVATIADLEAFAASVAAFFGEDASATGAAARARDRSVRSREAGARRGVKGGERPEREGAGRPGSAPADPGASGEARGDWVREAKRLQALYRANRRKAVREVLQGPADQCQVPKRQVQEYFERLYSGGEDLAGAGVEAERPDPSSPREVSAVLGPLAEREVDRRLRRMNNSAPGPDGVSYRDLRGADRGARLLTALYNICLRLEAVPASWKTSNTVLIHKKGDRGMLENWRPLALGDTVPKLFAALLADRLTDWAVTRGKLCSAQKGFLRDEGCYEHNFVLQEVLTHAKRSKRQAVVAWLDLSNAFGSIPHATIRRALIRSAVPRGLIAIWDSMYDGCTTRVRTAEGHTAPIPIRSGVRQGCPLSPIIFNLAIDSVVRVAAEXNDGYSLHGNTWSALAYADDIALLAQTPEGMERMLASVEAEAASVGLRFNPAKCATLHVGAGNGGRVLPTSFQIQGETINPLAQGESYTHLGVPTGFSVDQTPYAAVGDIVSDLRAVDRSLLAPWQKIEMLGTFILSRLDFLLRGARVFKGPLTAVDLNIRRHVKSWLNLPQRASAEGVYMPPRWGGCGLLPLSDLADVLTVAHAYRMLTVRDGAVRELAWESLRGVVGRRIGHAPSCEDIASFLSGSLDGRMRGGGEASLWSSARNAALRQSERLSLRWRWVEATEEMTLECRGPRGAAIKIPPEARGQVVNRLRSAVAEHYASRLLSKPDQGKVFEVSSRSRVSNHFIRGGSFTRFADWRFIHKARLDVLPLNGARRWEANDKRCRRCGEVSETLPHVLCHCGIHSAAIQLRHDAVLHRLWKATRLPGVVRVNQRVEGVSDELGALRPDLVVRHEPSKSVVICDVTVPFENRWTAFEDARARKIAKYSPLAEELQRRGYRVVVTAFVVGALGSWDPRNEAVLRLLRVGNQYAAMMRRLIVSDTIRWSRDIYVEHVSGTRQYLAPSRPSGDLATPPRAVRRRWLAEERSAQDAARRGSDSVSVA

SEQ ID NO: 1426 - protein, 1019 aa, synthetic construct
  source 1..1019: note = Description of Artificial Sequence: Synthetic polypeptide
  VARIANT 52: note = Any amino acid
  VARIANT 652: note = Any amino acid
CHHAGLRPGTPNRTRRPDQTAPLPDPRGHPMPPNRRGSRSRPEEPSRREPPXPRACQGLRVWSPPQQRMPTPWQTLWLEELSRATTFKAFEASVARLTEELSAAARPGQPRGGNNRPATRRDHRLQPQRRPRRQRYDPAAASRIQKLYRANRPKAVREILEGPSAFCQVPRETLFNYFSRVFNPPAEAAAPRPATVEALTPVPPAEGFEDAFTPQEVEARLKRTRDTAPGRDGIRYSLLKKRDPGCLVLSVLFNRCREFRRTPTTWKRAMTVLIHKKGDPTDPGNWRPIALCSTVAKLYASCLAARITDWAVTGGAVSRSQKGFMSTEGCYEHNFTLQMALDNARRTRKQCAVAWLDISNAFGSVPHRHIFGTLRELGLPDGVIDLVRELYHGCTTTVRATDGETAEIPIRSGVRQGCPLSPIIFNLAMEPLLRAVAGGPGGLDLYGQKLSVLAYADDLVLLAPDATQLQQMLDVTSEAARWMGLRFNVAKCASLHIDGRQKSRVLDSTLTIQGQAMRHLRDGEAYCHLGTPTGHRAKQTPEETINGIVQDAHKLDSSLLAPWQKIDAVNTFLIPRVAFVLRGSAVPKTPLKKADAEIRRLLKKWLHLPLRASNEVLHIPYRQGGANVPRMGDLCDIAVVTHAFRLLTCPDXTVSIIAASALEETARKRIGRQPTRRDLATFLSGSLEGEFSRDGGDFASLWSRARNATRRLGKRIGCAWTWTEERRELGVSLQPAPHADRVTVTPRTRTFLERFLKDAVRNKYAGDLRAKPDQGKVFDVTSKWDSSNHFMPSGSFTRFADWRFLHRARLNCLPLNGAVRFGHRDKRCRRCGYVAETLPHVLCSCKPHARAWQLCHNAVQDRLVRAIPAAAGEISVNRTVPGCESQMRPDIVITNEEAKKVVIVDVTIPFENRRQAFTDARARKREKYAPLADILRGRGYDVTVDALIVGTLGAWDPSNESVLHACRVSRRYAKLMRCLMVSDTIRWSRDIYVEHITGHRQYTDPTRRTAAGPDPEGTA

SEQ ID NO: 1427 - protein, 1584 aa, synthetic construct
  source 1..1584: note = Description of Artificial Sequence: Synthetic polypeptide
  VARIANT 117: note = Any amino acid
  VARIANT 118: note = Any amino acid
  VARIANT 121: note = Any amino acid
  VARIANT 139: note = Any amino acid
  VARIANT 141: note = Any amino acid
  VARIANT 278: note = Any amino acid
  VARIANT 328: note = Any amino acid
  VARIANT 409: note = Any amino acid
  VARIANT 490: note = Any amino acid
  VARIANT 529: note = Any amino acid
  VARIANT 688: note = Any amino acid
MTTKKVLGASTTLQTSSTKGKNSGCSKDPLRDAVPGRSWILRPACRDITTRRNIPPAPQQQQPPMESPPTLQLQDALRRPSPTPAAAQVADAGGALAALHTIKRGISVDWTSISPKXXQRXTSASPDACPASETTQRDXRXLLDARPAGPLDPTRPHQDEPASDTADAAGTPLLQGNEDTIYLQYPLAADMLICPICSPPQSFHLLGVVTRHLKRCHSKRVAFSCALCSLPFETQKQCKMHQVACRKCLKGTTQSPAPAPSPPAARRPAAPEPQRRKXTSQAAVKKPAPVARPAERDAAIEKVPAASGNITQVLASRRPVSPSHVAKXISMLRRLSAASPPVQHVPVPRRISAPPRIAARDPVAGRASAAPQTALRTPAAGGASTTPQTALRTPTAGGASAMPQTTLPXPRRPDWRNQPRSHSKAPGLHRQTDQHGPQVHSAGHCLREISRSSSNRLGSSHSAAATHRRTGGVPATPEPDRVSPTTSNAXIPPEIPPQHPTEGNPDPRDRRQADHTAGSEPAPDEVEDXEGQRPMVRAATPWQTAWTEELQAAASFDDFDLLVDRLTRELSAEIAPRRSSNQENAPPAHRTPAPNHNTTTRGARSRDASRRYDPAAASRIQKLYRANRSKAMREILDGPSPYCTIPSERLYSYFKDVFDRIARNDAQRPECLRPLPRVDEAGVLETDXTPKEVMARLSKTKNTAPGKDGIPYSLLKKRDPGCLVLATLFNQCKRFCRTPSSWKKAMTVLVYKKGERDDPSNWRPISLCSTMYKLYASCLASRITEWSVSGGAISSIQKGFMSCEGCYEHNFVLQTTIETARRARRQCAVAWLDLANAFGSMPHHHIFATLQEFGMPENFLRVIREVYEGCSTTIRSVEGETAEIPIRSGVKQGCPLSPIIFNLAMEPLLRAISNGTDGFNLHGERVSVLAYADDLVLTADDPESLQGMLDATSRAADWMGLRFNAKKCATLHIDGSKRDSVQTTGFQIQGEPVIPLAEGQAYQHLGTPTGFRVRQTPEDTIQEILQDAAKIDASLLAPWQKINALNTFLIPRISFVLRGSAVAKVPLNKADKIVRQLVKKWLFLPQRASNELVYIAHRHGGANVPRMGDLCDIAVITHAFRLLTCPDAMVRNIAANALHDATKKRIGRAPSNQDIATFLSGSLDGEFGRDGRDIASLWSRARNATRRLGKRIGCRWEWCEERQELGVLVPQIRSNDNTIVTPSARGMLERTLKAAIHSLYVETLKRKPDQGKAFELTSKWDASQPLPRRGRLHPFRRLAVHPPCPAQLRPAQRSRPPREPRQALQEVRLLQRDPAPRPVQLQAPLQSLAAAPQCHPEPPGESHRTAPGGGRRELRHPRYPASGTPANHFLAGGGFTRFADWRFIHRARLNCVPLNGAVRHGNRDKRCRKCGYSNETLPHVLCSCKPHSRAWQLRHNAIQNRLVKAIAPRLGEVAVNCAIPGTDSQLRPDVVVTDEAQKKIILVDVTVSFENRTPAFREARARKLEKYAPLADTLRAKGYEVQMDALIVGALGAWDPCNERVLRTCGIGRRYARLMRRLMVSDTIRWSRDIYIEHITGHRQYQEV

SEQ ID NO: 1428 - protein, 1420 aa, synthetic construct
  source 1..1420: note = Description of Artificial Sequence: Synthetic polypeptide
  VARIANT 694: note = Any amino acid
MTQDQDADCCPAGKDATRGAPPMTQDQDADRCPAAPERDAPEGTTSSTPDPKTTYHPAVRRRAARRGMHLRAQDLDAARCPSGQRDNVASESSAPPRATSPPQASLPDPEESPGESAGTTEIRPTEGEAGEEDRIYLQYPLPTGLLLCPFCLPVHGVQTLAALSKHVRKTYNKRIAFRCSRCDLPFETQKKCKFHQATCRGPPTTAKVNPTDILRVPTLTPTDDLASAPQPASPESQQIRGDQPPTEGSVTPASRTDDATKRTSPVSRIPTLDPAVRGTTATSQVNNLTRRLSDLIKTIRHNTDTRRCSAPPQVTSCRPAVGATSIVPQAARRDPANGGASRSPQIPQPDPAPGRPNTSSKVTQRASDRQKPHAPPRTHQPDAARRRTRTIPSASKHDRAPTKPSTGASRTPLPPGRSSAASETPRAALPTTPGPPPQDPPEHRSTVRGTTRPQTVPAAPEPAETTQQEERRPRARVATPWQSAWMEELAKAEDFENFDTLMDRLTAELSAEITARRREPQEAARATRRFPAPSRNNTAREGRRGDVGRRYDPAAASRIQKLYRMNRTKAMREILDGTSSYCAIQPERLYSYFKDVFDHEAQTNLRRPECLSPLPRIDLTEDLERDFSPQEVQARLSRTKNTAPGKDGIRYPLLKKRDPGCLVLAAIFNKCKQFHRVPRSWKKSMTVLIHKKGXRDDPGNWRPISLCSTIYKLYASCLAARITDWSVCGGAVSSVQKGFMSCEGCYEHNFLLQTAIQEARRSKRQCAVAWLDLTNAFGSIPHHHIFATLGEFGMPETFIQILRDLYKDCTTTIRATDGETDAIPIRRGVKQGCPLSPIIFNLAMEPLIRAISSGPTGFDLHGKKLSILAYADDLVLTADDPESLQGMLDATSRATDWMGLRFNAKKCATLHIDGSKRDSVQTTGFQIQGEPVIPLAEGQAYQHLGTPTGFRVRQTPEDTIQEILQDAAKIDASLLAPWQKINALNTFLIPRISFTLRGSAVAKVPLNKADKIIRKLVKKWLFLPQRASNELVYIAHRHGGANVPRMGDLCDVAVITHAFRLLTCPDATVRNIAANALRDATEKRIGRAPSNQDIATFLSGSLDGEFGRDGRDIASLWSRTRNATRRLGKRIGCRWEWCEERQELGIRVPQIRSDDNTIVTPTARGLLERTLKAAIRSLYVETLKRKPDQGKAFELTSKWDASNHFLDGGGFTRFADWRFIHRARLNCVPLNGAVRHGNRDKRCRKCGYPNETLPHVLCSCKPHSRAWQLRHNAIQNRLVKAIAPRLGEISVNCTIAGTDSQLRPDVVVTDEAQKKIILVDVTVSFENRTPAFREARARKLEKYAPLADTLRAKGYEVQMDALIVGALGAWDPCNERVLRTCGIGRRYARLMRRLMVSDAIRWSRDIYIEHITGHRQYQEA

SEQ ID NO: 1429 - protein, 1081 aa, synthetic construct
  source 1..1081: note = Description of Artificial Sequence: Synthetic polypeptide
YAPGYEAAQSPCGREPPRDHHRRPRDACGSSHSPEPCLTTPRLLPETVSAEPCDDESQRTRYASPHKQARTLHDAEPRDASREHAPSCAEPRCHRCQWTHWKDCCPHSTNTTDGPEGTDRCADTITSPATAACPQRSPCPLGSSNGCDETAPEKRQPAADLVHTAPFAVLVRAGPFADLVRAGPFADHHQDDDPLPHRSGSLGPLCSKQKDPRKTHQHRHSGQAGNQTHTDIPRAAPSRRAAICLMANAAATREDLLRAATSLSEMAAANQPTRSPTGGGEPTSQGRRGPQALADAAKRIQQIYRTNIPRAMRKVLRTLLTAVFSACLRTGHVPDLCKKSRTVLIHKKGDRTDLSNWRPLSMGDTIPKLFAAVMADRLTAFLTNGGRLSEEQKGFLQHEGCHEHNFVLGQVLEESRRQGKDLVMGWLDLSNAFGSIPHATIMDAVAGMGIPSRIRTIIHQLATGAATTAKTIDGMSEEIPIEAGVRQGCPASPILFNIAIERVLRKIKTVNAGYLLYGSRISPLAYADDLVLIASSPEEMRSLLRAADDAAIEAGLHFNPKKCATLHLTGKKSSRRAVQTGFLVRGTPIPAMTEGDAYEYLGIPLGLKKNQTPRAAMEAIVGDIAKIDDSLLAPWQKIDAARTFVAPKLDFVLRSGATLRAPLRHLDTVIKKHIKKWLYLPQRASAEVVYTPLKKGGAGILPSSILADVLTIAQAHRMVSCPGEVVSRIASEGLREAVKRKINREPSGDEMAHFLSGSTLSGETASFGDAGFWSRVRMATKRQAVHLGVRWAWRGGELLVESRGQRNRPVATDSNSRSQLIQRLRCAAQDEFLTILINKPDQGKVAKLSTLTPVSNAFIRDGSFTRFADWRFIHRARLGVLPLNGAIRWGSGDKRCRVCGYQLESVPHVLCHCMHHSNAMQQRHNAVMDRLAKAGSRLGTPRVNCRVEGVAEDMAALRPDLVWRDERSRKIVIVDVTVPFENGAEAFDNARGEKEEKYRPLAEALRAMGYQVKLEAFIVGALGSWDPKNERVLKTLGVSRFYAGLMRRLMVADTIRWSRDIYVEHVSGIRQFTLPSGAPSN

SEQ ID NO: 1430 - protein, 1258 aa, synthetic construct
  source 1..1258: note = Description of Artificial Sequence: Synthetic polypeptide
MSGPRQAAADPRPSTDPRRQRDSQSPEPRLTRAASRRRTPDPEDAPRTTAEHPERRRTPPDPRGPSATTAGPERRRPPDPGGPEDDPPEGLPTLVEEPRTPPTPDPPDGRPRRGCRRGSAHVPPLPPPCEAAVPDLPPAKAVQVAQRHEQTPTALPPAAPSVLLLPLRHRVRGPEAPEEPPQGMPGPRGREETRHAGEVRRPTTRAAARRPARPAAPPATPPDQTSGDRPTERPAPATPPRRSAPRDPRPDVTPRPDGPPPGPPGPPDAPDPPRIPEPPGEPEPPGALQLPSVPGSPGAETSAQQRMPTPRQALWLEELSRATAFEAFEASVARLTEELSAAARPGQPRRGADNGPTTRRDHRPQPQRRPRRQRYDPAAASRIQKLYRANRPKAAREILEGPSAFCQVPRETLFNYFSRVFNPPAEAAAPRPATVEALTPVPPAEGFEEAFTPREVEARLKRTRDTAPGRDGIRYGLLKKRDPGCLVLSVLFNRCREFRRTPAAWKRAMTVLIHKKGDPTDPGNWRPIALCSTVAKLYASCLAARITDWAVTGGAVSRSQKGFMSTEGCYEHNFTLQMALDNARRTRKQCAVAWLDISNAFGSVPHRRIFGTLRELGLPDGVIDLVRELYHGCTTTVRATDGETAEIPIRSGVRQGCPLSPIIFNLAMEPLLRAVAGGPGGLDLYGQKLSVLAYADDLVLLAPDATQLQQMLDVTSEAARWMGLRFNVAKCASLHIDGRQKSRVLDSTLTIQGQAMRHLRDGEAYCHLGTPTGHRAKQTPEETINGIVQDAHKLDSSLLAPWQKIDAANTFLIPRVAFVLRGSAVPKTPLKKADAEIRRLLKKWLHLPLRASNEVLHIPYRQGGANVPRMGDLCDIAVVTHAFRLLTCPDATVSIIAASALEETARKRIARQPTGRDLATFLSGSLEGEFGRDGGDFASLWSRARNATRRLGKRIGCAWTWTEECRELGVSLQPAPHADRVTVTPRTRTFLERFLKDAVRNKYAGDLRAKPDQGKVFDVTSKWDASNHFMPSGSFTRFADWRFLHRARLNCLPLNGAVRFGHRDKRCRRCGYAAETLPHVLCSCKPHARAWQLRHNAVQDRLVRAIPAAAGEISVNRTVPGCESQMRPDIVITNEEAKKVVIVDVTIPFENRRQAFTDARARKREKYAPLADTLRGRGYDVTVDALIVGTLGAWDPSNESVLRACRVSRRYAKLMRCLMVSDTIRWSRDIYVEHITGHRQYSDPTRRAAAGPDPEGTA

SEQ ID NO: 1431 - protein, 1241 aa, synthetic construct
  source 1..1241: note = Description of Artificial Sequence: Synthetic polypeptide
MSCPREGSDHLGPDPETPALHQGSDIRVTSSRLRGSRGKSSRQPSSRHQVPASEASATAQQTAANECQVCGSSFATSSGLRRHMARLHRAASADPEGAAPASITEIFDYPLPSRWKCSACSENFFNQQTLKRHQTRHHPATTFAYAFRCSSCRSEFDSARRAANHWQVHKKERSQLSGTEPQASSQARVSMAHSPPPLPNTSWAELASNPAEIPSFVWESPPKNRPSVEEFGSSLPTDVTMMSQSPPPQVQSSPVPALTPLSPAATASSSPPGAARQLTPPTQTNTPVTQRARLQPEADVVPELPPSVTEHPVSDAQHWVDAVSSASDWSEFEAVCDQFVIHAVAVSRPNLARPQQQDRQRSGDHPPRQQRGQHRPTFDVREASRIQKLYRTSKKRAIRHILKEKSPSFSGSESDVLDFFREVYSAKEVDEEAVGKLASSLFDVPQGDDSATSLSLPTSAKEIGARLSRMTNSAPGKDRLEYRHIRRADGSFSISEAIFNKCLAEGRIPAPWKTASTILLHKAGPTDDPANFRPIALQSCLYKLFMAVLADRLTKWACENQYLSPEQKSARPCEGCFEHSFLLSAALKDCRRNQKTICIGWLDLRNAFGSIPHPVIKIVLSSLGVPDSLVTLLMDAYNGASTSFTLTGGQTDTVPIRSGVKQGCPMSPILFNLAIELIIRAVKKNASDNHLGVTVQGKNLSILAYADDLVLLSRDTEGLQSLLQVAGSSASTLQMQFKPQKCATLTLDCKRGTNVRQSAHHIQGAAIPSLTEEERYRYLGVPIGLPRLTSLQESSRKLSSDIETISSSLLAPWQKLDAIKTFVIPILQYTLRATEYLKSDLKPLRAAIIKHVKKICHLPVRSSNAFVFASRPSGGLAFVDPGVDADILVVTQAVRTLASDDDTVRAVALGQLTSVVHRTVHSAPSDDCIDKFLSGSSEGPLANSGNSGQASSLWSRTRAASRRLKIRIVGASSGDIKVESGGRAIPSKKVTAGLRSDHHNEMSEKLRSLPDQGKVARALSLDSFANATSWLTSGSFIRFCDWRFIHRARLNCLPTNAAVRRWKQNANTKCRRCDHQLETLPHIINNCRPNMVPIRRRHNSIQERLVKAIHYGDIYQDQHVPGDPNPRERPDITVVEGNKVTIVDITIPFDNGPDALSTAANAKVMKYDTLRQELASRGMDVEVHAFVIGSLGSWHGDNERVLGRLGISRRYRTLMRRLCCIDAIKGSRDIYIEHVTGHRQY

SEQ ID NO: 1432 - protein, 1203 aa, synthetic construct
  source 1..1203: note = Description of Artificial Sequence: Synthetic polypeptide
  VARIANT 3: note = Any amino acid
  VARIANT 213: note = Any amino acid
  VARIANT 235: note = Any amino acid
  VARIANT 271: note = Any amino acid
  VARIANT 328: note = Any amino acid
  VARIANT 347: note = Any amino acid
  VARIANT 372: note = Any amino acid
  VARIANT 451: note = Any amino acid
  VARIANT 463: note = Any amino acid
  VARIANT 770: note = Any amino acid
SGXTGREVKCITVNVLMEQQPHTKAIREGDFIVILLPQSDDETLCCPLCVGRGRYSGKTRVECLNRHVKEVHPDLTTTFRCWGCGFAAPGDKKYPRKIVTQHCATCVPEVSSAPSGRVDGERRVNTRRRLGIAAATEASPVRRTRRNGLASPPVEQNISQSAAPPEPARVPQHPEIVALGESADDEVFRSPVNSPPRDWRAAAPQQAASSSPXAVPGITAATPSNTTRTGNGSAXSILAEHPIPAPPPTNTTEANGRADIPRSGRAPPPGXQAARRRAPTTEQRRIVGLLEAATGREQLEEATTQAMLFLARLTGRRPEPRNAIRPGXRQRHPAQGDVQAQAPDRIXEAKKLQRLYRTSKKRAVQKILAGPXMNCQIDKNTITAHFVELAARRDGGEDWPDVFDREEPTAASGEALCTPITREEVFRRLKGRNNTSPGPDGITYRDLAKAXPGAHVLAALYNXIWRIEATPALWGVSNTTLIYKKGDAMDISNWRPISLGDTVPKLFAAILADRIKRWAVANGRYSASQKGFLEFEGCYEHNFVLQEAIREAKGGRKELVVAWLDLASAFTSVPHSSILQALEGHGLPSKARNIISSLYTGMTTRFHTAEGPTDPILIQSGVRQGCPLSPDVFNLTLEVVLREIQRTGEGYTIEGRRISHLAYADDVAILADSPAGMRRLLFAAERGARAVGLTFNPAKCATLHIAGRGEEAVRPTEFSVQGTPVRALASGEAYEHLGIPTGYQVRQTPINTLRDLLADIGSIDRSLLAXWQKLDAVGTFLLPRLDFTMQGAHIDKGFLTEADKIIKKAAKSWLSLPQRASAELVFLPPSQGGGGLLTVAHSYKMLYSSDVTVSTIAGSTLRRTVSERLKKRASNIDIARFLSGDLDLPRSTSPSTFWTKVRSAALRIKTKLGLRWSWCQGGEVLLMACGDPRAPGTRVSPQTKHLVTTSLRRCLNRHYAESLLAKKDQGKVFEVTRRSGQSNHFLRSGSFTRFCDWRFIHRARLDVLPLNAAKRWQRGMDKRCRRCGSDLETLPHVLSHCGPHSAARQKRHNNIQDRLVKAASRCPGTISVNQTVVGVRGPDAALRPDIVVRDDVNRRVTIVDVAVPFENRLEAFDGVREAKIAKYTPLARQLTDSGYTVTVEAFVVGALGAWDPRNERVLSLLSISRYYAILMRRLMVSDTIRWSRDIYVEHVSGIRQYRE

SEQ ID NO: 1433 - protein, 1458 aa, synthetic construct
  source 1..1458: note = Description of Artificial Sequence: Synthetic polypeptide
MVVSRITARLEATPAPRWDPPLPRRVIASRIADRLVPATAPCRSALNAAFPSPSRDTVTESFTQEDRQLEPLTRHVDEETKDSELPGRAPTVLDEESKDNDATAGEWLLRFDGACRANPGPGGAGAVLFNPSGAASWTCSHFMPGATETNNTAEYTAFLLGARAAADHGATLLRVQGDSQLVLRQVKGIYGAKSTRLRRLRDAVRAELARVGQFSLHHIDRQDNAHADRLANRALDMKSTLVECATHPGRNACTTTLTTSAAAESPASPPPVGARDTPMADAGEERLADVDDGEVYAAMRLGPGEVPERRPRLRLRQLSDEELEAASEMVERLGAALSAKITDAEDWASAEGYITALPYMLYDKLQSYSQAPRGPQQPVLTRSPRGDDRPASSEPNASSTTGGVASEHQPRRRRRRGRRKGRRQRRNPRRSGREGATGGHQQHKKHKPRPPRETQHHREHRLDEALDELHALERTDPHNRPAIAKARRRVGRIRSAINQQLLRHKFDTDEKACVDGILSTARAERAARAATPSPPASGAPTTTVSAPGAIVTNDDGTCPIPSDKLWRHFDAVNTPRLDFDAEAPGSAAFRAAMDHLPAATRLLDLLKEAPSTDEIETQLQHVKASSSPGLDGVGYDVYKRFTIQLLPVLRAAFRCCWLYKKVPQSWKLGVVRLLHKKGPREDPANWRPICLQQAIYKLYTGILARRLTRWMDANDRHAPGQKGFRAVNGCGEHNFLAATLIDNARRKHRPLYEVWYDFRNAFGSVPFALLWDSLQRLGVPPDYVDMCKGLYNQASFVVGNAVDGSTAPVEQRVGVFQGCPLSPQLFNAAISPLLYALRRLPDTGVQLSSVDRPGASAYADDLKIFSGTKAGITQQHELVATFLRWTGMQANPAKCRSMGVRRNTNGAVEADNVHLELDDTPIPSMTHMQSYTYLGIGDGFDHVRRRVELAPKLKTLKHDVTALVESGLAPWQVVKAVKVYLYPRVEYALRHLRPDDQHLESFDLHLRRGLRHLLRLPKNATNEFFYAPVSRGGLGLLPLVELHAALQIAHGWQTLHSPDPAIRRVAREQLYQIADARHRLDKDHWPHRREELCELLLNGELGTSAHAPPKRRNGDIGSLWVDVRKNLKTFGLKVATAPANQETGVPAQPLQLRVPHHAEWLDHGNVLRHVKLHIKNLHWQTWCALSDQGKTARVHGGVGSAFLTRPRGMWESDYRFAVAARLNVVDTVNTLSRRRLRAHDRCRYPACRWKETLAHVLNHCPGTMDAVRGRHDDALKEIEHTLRASSGDRRELRVNQTVPGLPGPPLRPDIQVYNHDKRTVAVVDLAVAFDEQPSEDPESSGLAKAVQIKKAKYAGIKEHLENQGWKVHLSAIVYGSLGSVAASNHKVYTEHLGLLKRDAKRLDRQLSSACIQSSRRIWNFHCAKHRARQHEHQAPPSQATRGRRVTETGGNPSRTDRR

SEQ ID NO: 1434 - protein, 1704 aa, synthetic construct
  source 1..1704: note = Description of Artificial Sequence: Synthetic polypeptide
MLADPAALAAGLARAPPPPSAPQDPSPAFPAGPAGQNPRAAAPARVEVHTVVAPPGRAGGMLPDPGLVEEPIQATYAHDAAQFECALCPYVAESMAVLVQHRRSAHRGTRFKDIFTSGCQCSLVFYARIVAASHAVACARRNQRAVPPAPTPVAPTRPEATPQPTGYLAAAMTAAAAAASSDTVVAAATNMQSAVPAAAKTTGLQLVPPELEPALPQRASCHAGKRRRLNADEAVTPCTPTARVSPQTEVAMAPHDAPQDDTVLQREAAEPQPDPAATPGAQVQRVEDTTAAQDDTVQQDHDADTAQVSPPRRTPTRWGPRPSSTQEPSPMTGEPAATLAARRPLTPAATGTRATRWGPCHRAIGAAAIARLVTGLSTEPAQPQRRQPPPPQEPPSQPEPLAAAATAAADIAATVAADIAAAAANAAMDVDGGPAADETWLLRFDGACRRNPGPGGAGAALFAPSGAVVWTCSHYMPSRSETNNTAEYTALLLGVQSAVHHGASHLEVEGDSSLVIAQVKGTFACRNARLRQLRNRVRHALRSVDTHKLRHIDRQANAHADRLANRALDQRRTSSECGTHGSCMDSCLAVPTALAAQETPPAAPPSTSATPAEGNAMDDIAAEIAARDEGETFPVLPIGPGSAPERQPRLRLRQLSDEERDAAADALQELADTMASKIEDADSWTSGEGYISSIPERIREVLQPYATAPPQPGRSRRQQRRRPPRVTRNQREHRLDEALDDMAATQQATPRDQRAVRRARRRVGRVRASMAQQELRHEFAKDESKCVAKILKTASTETAAEDEHPETCPIDAATLHAHFTGVNAPRTDFDYDATSGREFRAAMSDLPPATVEIDAFDAELTIDEVEDQLTRAAKTSSPGHDGIDYGIYSRFAAQLVPLLHAVFQFCWRHRRVPRLWKVGIVRLIHKKGDPRQPTNWRPICLQPTIYKLYSGLLAHRLSRWLEGNDRLPMAQKGFRAFNGCHEHNFMATTLLDQTRRQHRKLYQVWYDLRNAFGSLPQQLMWRVLRHLGVDSGFIDRCRDIYRDSAFVVANAADGATDPVRQEVGVYQGCPLSPLLFVAALVPLVRRLEKLDGVGVPLADGVRPCTTAYADDLKVFSDSAAGIRKCHDTVAGFLAWTGLRANPGKCASLAVTTNARGNPTRDSSMRLEVHDAAITTLSLHESYRYLGVGDGYDHVRHRLQLEPKLKQLKREAVALLTSGLAPWQVVRALKVYVYPKVEYALRHLRPLQSQLQAFDRVVSKGLRHLLSLPRSATSEVLYAPTSSGGLGLQPLVELHRALQLAHAWQMLHSKDPAIQAVARAQACQVVRKRYRLQEDHWRGRDDELVRSFLNSELAASPHAEVLRRNGDIASLWSDVQRWLRIYHLRFEHCDETEAHGPLSFRVPHHNKWLTHKTVLRHVKLHLKIRHQTRWKGMVDQGKTVRVHGGVGAKFMTTGAGLSDDDYRFGVKGRLNQVDTNSVLKRKRLRAHTTCRDPTCSSAETLAHVLNHCESNMDAIRQRHDDALEQIGSKIRGALDRAKSPTELRLNQTVPEYTGAALRPDIVLRNVAAKTMVIADLAVTFEDQAARARHSSLQLSHDHKTLKYQPIVAELQHKGWRVQTAAIVYGTLGSVQPSNFKAYTEKFKLHKREARQLDLQLSSHCIRASHRIWGWHCRQHRDRQRSGTASRASRGSGGAPRRTSQAPARR

SEQ ID NO: 1435 - protein, 1432 aa, synthetic construct
  source 1..1432: note = Description of Artificial Sequence: Synthetic polypeptide
MCLKSFSSTSGLRRHMARLHRQPSPDASTPSTMTEVFPYPLPKVWPCVVCRENFYHNQTLKRHQKNFHPNVDLTTVYQCSVCGQEFVTGRKASFHFKVHRRMSASAIPTPSAMPSSPMDLIRGLVGEPLPPSPARTPPPLARYISPAPRSSFSPPWNPSPPPRSPTPLPRPLTPPPRSPSPPPRSPTPPPPVTLTTAPVTEPAVPVALTTAQVTEPSAPAVHTAAPVTLSNAPVTEPATPATDPATPVTRLHSPVTHISCSISFTASHAPYSCAAPTSPSVYACSPRRRQCSSTIAAVCNSEASSGNPCLLALPVHRHHLPDTSPQRPGLLFHHPGIPPHRPGRPPHCHGHSLHRHDHRARRPGRQHHLPRSPSPPPRSPSPPSRSPSPPPRSPSPPPRPSTPPPRSPSPTPRSPSPPPRPPILPPRSPDSTHRSLTSHARSPSRPATPPIPVQPRHLRPSTPAHPGVDNAVPPSQQSAIDVWLAELSRSADFESFEDVCDRFVEFAAAEGRNNGRPARPAHQPPRDRGNQGPRPQRPPRPHRPGLGPEFDAQEASRLQKLYRTSKKRAIRTILTGSDVRYSGYRGPHPALMSDTAATEVLTSGFLSLEVFSAREVDTDTIATDTSLLFPNSAQARESGQDLLRPVTQREVSLRLGRMSNSAPGKDRLEYRHIRQVDGAFRVTLEIFNRCLRESRVPSSWKTATTVLIHKKGDATDPANFRPIALQSCLYKLLMAILSDRVTTWALDNDLISSSQKSARPGEGCYEHTFLLSTVVKDARRNQKNMYAAWLDLQNAFGSIPHDAMFTVLTSIGAPEGLVSLVRDVYTDASTDFVTPTGRTAAVPIHSGVKQGCPISPVLFNLTLELIIRAVNASATRDRSAPVVHGQAVPILAYADDLVILSRSSDGLQSLLTTASIMATKIQLKFKPAKCASLSLECRRGTKVRPLEFNVQDKIIPALTEEQHYRYLGVPIGLYRTDDSLETLVAKMTDDIQRIDSSLLAPWQKLDAIRTFVQPCLAYTLRAGDCAKKHLKRLRGQLVKTARKVCNLPTRATTNYIFADRRAGGLGFIDPNVDADIQIITQAVRMLSSPDDITRAIATGQLSSVVHRTIHRAPTQEETDEFLSASMEGDFANSGNSGQASSLWSRARAAARRLKVTISGSLSGSVITKSTENREMAAKSITTALRAQSRAHYTHRLLSLPDQGKVGQSLNQDQYMNSSSWMSSGSYILFCDWRFIHRARLNTLPTNATAQRWKPNTSPACRRCQHPQETLPHILNHCPPNMVPIRRRHNLVQQRIVSAVRHGRVFVDQHVPEDPNPRERPDITVVEGDKVTIIDVCCPFDNGRDALMTAAAAKETKYADLKQALVAAGKDVEVFGFAVGSLGSWLPSNERALRRLGIAKRFRTLMRKLLRIDAIKGSRDVYIEHMCGHRQYT

SEQ ID NO: 1436 - protein, 1216 aa, synthetic construct
  source 1..1216: note = Description of Artificial Sequence: Synthetic polypeptide
MDVDGGPAMPEPWVLRFDGACRRNPGPGGAGAALFKPCGTVAWTCSHYMPNSSETNNTAEYTALLLGVQSAVHHGASHLEIEGDSHLVVAQVKGTFACRNPRLRQLRNRVRHALRAVTSLTLKHIDRKANAHADRLANRALDLKRSLAECGEHQGAMESCLHMNPAAQRQREQPAPPARPACAPTRAESASDHDEDIDAEIAARDGGEAFPTLPIGPGTAPARQPRLRLRQLTEDEQEAAASALQAMAEELACKIEDADSWTSGDGYISAIPSRIRQLLQPFTAAQPHPRPPLQQQRQRPPRVTRTQREHRLDEALDEMAAVQQERPTSRSAVRRARRRVGRIRASMRQQQLRHDFARNESKCVEDILRAASAETAAEEHPETCPIDSGTLHEHFTAVNSPRINFLPDEACGALFREAMADVGTPQERRSALTDELTMDEVEDQLMQAATNSSPGHDGVGYDIYKKFAAQLVPLLHAAFQSCWRHHRVPALWKVGFVRLIHKKGDPNDPANWRPICLQTAIYKLYSGLLARRLSAYLEANGLLLMAQKGFRAYNGCHEHNFVATTLLDQTRRMRRRLYQVWYDLRNAFGSVHQDMLWYVLRLLGVERAFVERCDDIYEDSYFVVGNAADGATEPVRQEVGVYQGCPLSPLLFIAALVPLLRALEKLDGVGVALADGVRPCTTAYADDLKVFSDSAAGITRCHAVVEKFLEWTVLQANPGKCAFLAVTRNARGNPAHDKDMKLSLHDEEVSSIKLHDSYRYLGVGDGFDHVRHRLQLEPKLQQIKREAVALMQSGLAPWQVVKALKTYVYPKVEYALRHLRPLQSQLQGFDRVVAKGLRHLLRLPRSATNEVLYAPTSSGGLGLQPLVEMHRALQIAHAWQMLHSKDPAIREVARAQVWQVARKRHRLREEHWRERDDELVRCFLNSELAASPHAEALRRHGDIGSLWSDVQRWLRIYHLSLVVQDDRNGLDPLGLRVPHHAKWLDHKSVLRHVKLHLKIRHQTRWKGLADQGKTVRAHGGVGAKFMSTWAGLSDDDYRFGVKARLNQIDTNAVLKRKRLRSHKTCRDPTCSSAETLAHVLNHCESNMDAIRQRHDDALEQIGSKIRNALKRGKSTAELRLNQTVPEYTGAALRPDIVLRIVAAKKMVIADLAVTFEEHAAGARHSSLQLSHDHKTLKYQPIVAELQLKGWQVQTAAIVYGSLGSVQPSNSTPTRKS

SEQ ID NO: 1437 - protein, 1417 aa, synthetic construct
  source 1..1417: note = Description of Artificial Sequence: Synthetic polypeptide
MGTQSARERGAPSAPHSHTLGPRTPPRPPACSKHGELESAAGGRDGQCSDGAERERDAERDIRANERDCNGDGDGDDADSDSDDRNDARRRSRRPRATATTTTSAPTTTTTTTTSATTSATTPATDSSPWVLRFDGACRRNPGPGGAGAALFEPGGAVVWTVSHYLPGSETNNTAEYSAMLLGVRSAIHHGATRLRVEGDSHLALSQVRGTFACTNRRLRKLRNRVQAALRELGDYRLVHIDRQANAHADRLANRALDLRKTKVDCGPHATTTDACVQPAEILAPTARLSSSSSSSSSSSSDEPMPGLEEPAADDETDADAEADIAMRDGGEIFPTLQIGPGSAPAQQPRLRLRQLSDDESEAAARTLEHFANDMASKIADADDWRSGEGYISAIPVRLRELLAPYAVPIRSPPRNASSRPPRPQSRPPRPPRVTRHQREHRLDEALDDLAAAQRSTSTDQRSIRNARRRVGRIRTAQAQSDLRSQFATNERACVESILRAAKPDGTEPQASAGTCPIDRATLHAHFAGVNTPRERFDFDDALGADFRAALDVLPPPDQAADAFADELSLGEVEDQLDRVVASSSPGLDGVGYDVFKRFRLQLLPLLHAAYQCCWRHRRVPATWKVGLVRLLHKKGDRAEPNNWRPICLQQAIYKVYSGLLARRLSRWLEANERFTTAQKGFREFNGCHEHNFVASSLLDQTRRLHRKLYAVWYDLRNAFGSMPQPLMWRVLARLGVDTAFLQRCEDIYADSFFVVGNAADGATDPVRQEVGVYQGCPLSPLLFISALIPLLRALQRLPGVGVPLADGVRPCTTAYADDLKVFSDSAAGIQQCHGTVARFLRWTGLRANASKCALLPVTTTARGNPAIDDTLQLELHGDAIARLTLQSSYAYLGVGDGFDHVQHRVQLAPKLAELKRDAVALLRSGLAPWQVLKAIKVYLYPRIEYALRHLRPLQSQLEGFDRAVAKGFRHLLRLPANATNELLYAPVSSGGLGLLPLVELHKALQIAHGWQMLHSKDAAVQAIARAQVRQVVQKRYTLDADHWQGRDDELVQLFLNSELAASPHATIKRRNGDIGSLWSDVQRHLKTLQLRLETREPTADAPDSPNGLLHLRVPHHRKWLSHKTVLRHMKLHIRLCHKHKWQSMSDQGRTVRAHGQAGSHFVSRGVGLWDADYRFALQARLNQLDTNSTLKRRRQRTNATCRAPNCSRTETLAHVLNHCETNMDVIRQRHDGALEQIGAAINAAIKGRRTDTEVRLNQTVPEFNGPAWRPDIQVRDARSKTMVIADLAITFEDQPNDQSASSSLQHSREHKIAKYQPIAAALERQGWRVHTSAIVYGSLRSVHPSNFTVYTELLGLLKRDARRLNTTLSCHCIRSSRRVWNWHCGQHRARQHQRCQEGRAHGSGGNQRAEGGTATT

SEQ ID NO: 1438 - protein, 1369 aa, synthetic construct
  source 1..1369: note = Description of Artificial Sequence: Synthetic polypeptide
MATVRLKYPYPPEGILCGPCAANTNAPQTRPYSDKSGLAKHLKLYHKATLVVECRHCGHEESDLRKMKKHISTNHPVAAAAAPTVPPRLGPTAPPPPRVILRPRFIPRPRTPSPSSSSSSASSPASSRRSVSLPPASPPVSSASSPAARSGRNSPDSQGTAPVTPIGTVRNSPAGSPALSYSTASPIASTITTPRHLSPASPALSAGPGSLGASPPVSPTAATVPPAPPATVPAVMAATVPFVAATTVPSVGSSTVPQRPAGPRRPPPFPIDDWIGRIARVSSLPELDAVSRLLEDEVVKRRPPDPNARPASLHPTRRPPPPSTRPRPCHGTGGTSVSLAALTSSCIREDHRGSLPLLCTSGWDSPWPLSPSPSSHCPSSNPCPSSSTPPSSLLGPPRHSHLTWRGSGSTTPSHRHCSRARYHHLLWRLPYPSSPRLPYPPSALARYPSVPPALDDPLPSLSTIGSEGSPECHLCRNWTPSQGCSRMKWSRDAPLTPTPDPPHSIRHAALPLHLLALVPAMGPAELQSLWRRSRPRAFAKITEGASPFCALPVGTVHGHFLQVHQATAHLPTPVPLPPLRPPRSSDPLVTPISPGEVLDRLRRATDTAPGPDTIIYSEWRAIDPTGRLLSSLFQKVQTFGAPTRWKESTTTLIHKGGDHTAMSSWRPIALLSTVAKIYGSILSHRLTTWAVQNGRLSLSQKGFLPFRGCLDQNYLVQSCLQDARRNKKTLSLAFLDLKNAFGSIPHLTIRHSLEWLGLAPSSIDILEASFLGSSTRVRTETGLTPPISLDTGVVQGAPLSPILFNLAIEPLLRTVPSAHSGFSLHGHVVSVVAYADDLAILAPSTPALQSQLDAISGMADWAGLSFNPAKCATVTLTGKDNSRDTLSLQGSPVPSISDGDAYKHLGVPTGTTTFPSGTDAIKKMTTDLQAIDHSDLAPAQKLDALRTFIMPQLSFHLSHGSVPKAPLTQLDKKIKRAAKHWLFLPQRASNEILYMSHLHGGQSLLPLSVLADIGQVTHAVALLQSRDPAVADLALRTCREVASKRAKKTVNGPELAQYLSGSTDGIYCTPTSDIPSLWTTARAATRRLSSTLPLTWTSPLPSGVPFLSINGSPLSPFRVQSTLTNAIRHNHLSTLIAKRDQGNSYRTSHDPDPSNYWVKGGDFLRFCDWRFIHRARLNLLPVNGARRWDANSIKTCRRCGAPNETLAHVLNVCPVGLPEMKKRHDAIHARIKKALRPSPHTVVHHDRTVPGCGPLRPDILRISERDKSVAIVDIHVPFDNGTDAVERAHETKRAKYELIRRHYEHQGYRVTFDSLVVTALGRLWRGSEAALQALQISSQYSKLLRKLLVADAIHGSRNVYAHHMTGMVM

SEQ ID NO: 1439 - protein, 1305 aa, synthetic construct
  source 1..1305: note = Description of Artificial Sequence: Synthetic polypeptide
MSHSITEVFDYPLPSRWKCTVCLENFFNQQTLKRHQARHHQTTSFLYVFRCSACQAEFDSARKASNHWQSHKRKPILSQPAVNEIPSSGLDPSPPRSRPPVEVIGSSFPDDVSMLSEPSTPSTSLQMDPEVVHPPSRSISFSPMHLSPTQPASPIQIGVEVSFNSSSSLQMDPEVVQPPSPSISFSPMHLSPTQPASPIQIGVEVSFNSSGSLQMDPEVVQPPSPSISFSPMHLSPTQPVSPIQIGIEVSFTSSSPLQMDPEVVQPPSPSMSYSPMHLSLTQPDSPIPVDIDVIPAAEVPLPDIEIPPSPDRHPAAEVPLPDIEIPPSPDRHPVAEVPLPDIEIPPSPDRHPQSPPRPVMMEQPVHTPPPADTQQANGPQHWVTVLANATNWEDFGRVCVEFANHAVEAARSRQDAPQVRPAAQRQPRRPTRPRQPTFDVREASRLQKLYKRSKKRAVRHILRDDAPSFSGSNEQLLDYFKEIYAPPEIDENRAQQLAESLFTDLEEAKESAAALMSPISQQEISTRLSRMSNSAPGKDRLEYRHIRQADGACRVTHIMFNRCLQEHRIPSAWKEATTILIHKSGTTDDPANFRPIALQSCLYKLFMGILSDRMTQWACNHNLLSPEQKSARPCEGCHEHTFLLSSVIKDTKRNQKTANIAWLDLRNAFGSIPHQAIHAVLTTIGAPVSLVMLLKDTYTGASTSFLSTSGETDPIQIQSGVKQGCPMSAILFNLTIELIIRAVKKKATDDGLGLVVHGQRLSIMAYADDLVLMSKTPEGLDAILSVASEQAETLRLAFKPTKCASLSLSCRHGTSVLPREYTVQGHLMPALDEEEQYRYLGVPFGLPRFTNLKDLIGKLKGNIETIASSLLAPWQKLDAIKTFVQPGLSFVLRAADYLKSDLRSLKSAITTNVKKICQLPLRAANAYIFAAKESGGLAFIDPNVDADIQVITQAVRVLSSDDEVVQTIATSQLKSVVHRTIHAVPTEEDIDNYLSGSNEGLLANSGNSGQASSLWSRTRSAARRLHLTLRATTSGTVVVNQQADIDHTRDILPASITRGLRLIQRTTNAEKLKSLPDQGKVARSLSNDPFANGSSWHATGKFIRFCDWRFIHRARLNCLPTNVATKRWKANANGKNGHQQETLPHVLNHCLPNMVPIRRRHDNIQQRLVTAIRHGDVFVNQHVPGDPNPRERPDITVIEGNKVTVIDISVPFDNGPNACTTAAQAKVEKYSALRQALRDMGRDVEVHGFIVGALGTWHQGNERALGRLGVSRWYRTLMRKLCCIDAIQASRDIWVEHVTGHRQYE

SEQ ID NO: 1440 - protein, 1701 aa, synthetic construct
  source 1..1701: note = Description of Artificial Sequence: Synthetic polypeptide
MCSAKTPALKSGRRRGKEVNYEGQIVRVERRRGSRSSTSATDLGTRMVTRGRKKLMEASVREAGHHGGESASTVDVDVVESKKITGKTARRNRRAPSGDGKRRESCGAECGQAVCGNAVADRSEASSPRTPNVSKSGRDKCGQPTIKASTPSPPKRKPTTSSSPRTPCLSKRGARSKIPSTPDTPSTSGGSGKQRVLVSPLLRTEKLPDLEVLQRTEEQVTVRATFPIAQAVVCPLGCEKPYTAVRPDGQFAHQTLTRHFMRVHNCHSVQWHYRCRNCNTDFLPADHRYPLRVVNTHVRSCVSRWEITRKLGESEDLHGVRCDLCDYVGVSKRAVGLHRRRHANENIMQNTGTAAQIEALSKQVGEIRVAGDYSQFKFGKRVRQYVAPTQRRDGLDEEEVHEAEEEEVPAESRTILGEPSTATAIGAEEISATGPVRADTAAQQMICRIGQWCVWPQDYHSIPAPQCWTDTLMDLMIEQIVLQRYPDGAGVSVMSCSAVSAAIHHEISAEFAAQVMSSHDASLYCIIPVNVRNHWQMIVLDVAERVVHYYCSLREHNTVVLSSLLSLVELSGKHTGCTSWKIETHDGAPVQTNAFDCGPFSCLFLKHLLHGIDMNFGDRESAALRTDLKFMIDAVSTPVVPATDKLKKKPDGSATQLTQFQQKFLSASDNWQSPDVDLQAVYDEVVESIVSGHNEPSSRNTSRLQKKSPGKGGKGQVRRRSAVTRDPAWLKSASAVQKAFNSAPARTVNAILRRPNACPSFTATQVADHYFNLRPAVTSLAPEVIDILPPPATDHSMLVAELSESEVWEKMQKAPNSAPGADRITIRMVRMADPGAMILTRFYRACLLRKWVPLQWKQSVCKLLYKDGDKERLANWRPIALEPVLQRVLSAVVASRVTNWARANGLISLEAQKGFQPADGTSEHNFVMEVAIQEARRTNAQLAISWLDISNAFGTVSHQLLFSLLERYGLDPTFTSFIQNLYKDATIVVKGANGTHVTARWSVGVRQGDPCSGILFCLFVEPLLRSVLPSLPCEAETTAVNVLGQPITALAYADDIALFAPSIGVMQQQLCKIQGMASAMGFRFNPKKCASLYLNRAVVNAATFTISGEEIPALVHGDTFRYLGVAAGLGKPQTPFSLLRENLREAELIFRSKLAPWQKMDAYRTYVLPRLTFQLMIAKFNNIKQSAGQYDRAILRLVKRCFQLPVETSTDFIRAPRQCGGLGVPSLRELYATAKVSRALKMLWSPCRVVSSLAASQLQRVASAYFAKRLRDVEAADLSTFMNAARSTPLDRSGYPTCLWMDARKQMSYLTKVAGVDCYFLVGEAGTSFFIRNGLGQTVSVLSPLRKNKVMSVLGGAIQTRHLDAWLQCKRQGKTASCIVLDRSSSRFITTGRYTSFAAMRFALPARLDLLPCRARSSMRSYQNCRRCGYDRETLPHILQHCRQFSAPAYQARHDAVQGRLETVMRRRFPNLRVNRALPEIGSNKRPDLVVVDEEKRLVILLDIAIVFENTAAAFVDARTRKWAHYEKEILAYRLRGYSVTYDAIVVGALGTWDPKNDAILKRIGVVSQRYLRLMKVLVVSEMLEHSSRIYRKHLGLRDLLPDTGTKRRPVGTTETDPPGGDLRQKKRNTISARASGGKCLERRFTSPVGTPSQRGELQCQPCPGPRRPALAGIAPNPPSLQPRKPPPRQHQKPVTKSTAH

SEQ ID NO: 1441 - protein, 1195 aa, synthetic construct
  source 1..1195: note = Description of Artificial Sequence: Synthetic polypeptide
  VARIANT 231: note = Any amino acid
  VARIANT 253: note = Any amino acid
  VARIANT 275: note = Any amino acid
  VARIANT 387: note = Any amino acid
  VARIANT 389: note = Any amino acid
  VARIANT 398: note = Any amino acid
MLQLRLPTPQTLRLLHPSQLPQSHSTKRWSNIYEERARAPKDTTIERVSAASKIPKLDPAKRRIGAPLQLMQGNSISRQLSASSQYVQHNAVVRRVSAPPHTGNFTGSCRRKLALPHRPPSETQPAESYLHCWTTQRDPTLADQHGLQDHPTGLPPEGSHCIKDPRQNSSTEGQRRSGNSQARRIPKRASTAASKTVLPKRTSAALKSVREDTALVLEDPAKWSSQHREGXRQQANPTAVFQPEPAEIEQQPXVRAATPWQAAWMEELARTASFXDFDLLVDRLTKDLSAEIVSGRKGTQENTPTAHRQNQNNMREARRRNISRCYDPAAASRIQKLYRSNRPKAMREILDGPSSYCAIPSERLFLYFKGVFDRVAQNDMQRPECLXPXPRVDYAEDXEQDFTSWEVEARLTKTKNTAPGKDGIRYNFLKKRDPGCLVLTAIFNKCKQFRRTPSSWKKSMMVLVYKKGKQDNPNTRRPISLCSTMYKLYASCLAARITDWSVNGGAISSIQKGFMSCKGCYEHNFVLQTAIHMARRAWRQCAIAWLDLANAFGSMPHQHIFDMLREFGMPENFLQLVRELYEGCTTTICSMEGETPEIPIRSGVKQGCPLSPIVFNLAMEPLIRAISSGLGGFDLYDNRVNILAYADDLVLIADNPESLQQMLDITSQAANWMGLRFNARKCASLHIDGSRRDSVQATSFQIQGEPMIFLEDGQAYQHLGTPTGFRVQQTPEDTIAEILRDVARIDSSLLAPWQKINALNTFLIPRISFVLRGSAMVKVPLNKADNTIRQLVKKWMFLPQRASNELVYISHRQGGANVPRMGDLCDVAVITHAFRLLTCPDAMVRNIAESALQDAVKKRIARTPSNQDVATYLSGSLEGEFGRDGGDFASLWTRARNATRRLEKRIGCHWTWCEERQELGVLVPQVKNTDHTIITPRARTMLERTLKDAIRCQYVENLKRKPDQGKAFEVTCKWDASNHFLPGGSFTRFADWRFIHRARLNCVPLNGAVRHGNRDKRCRKCGYANETLPHVLCSCKPHSRAWQLRHNAIQDRLARAIPPPVGKVAVNSAIPGTDSQLRPDIVITNEDRKKIIMVDVTVPFENRTPAFHDARARKVEKYAPLAETLRAKGYQVQTHALIVGALGAWDPSNERVLRECGIGQRYARLMRQLMVSDAIRWSRDIYIEHITGHRQYQEG

SEQ ID NO: 1442 - protein, 1465 aa, synthetic construct
  source 1..1465: note = Description of Artificial Sequence: Synthetic polypeptide
  VARIANT 27: note = Any amino acid
  VARIANT 59: note = Any amino acid
  VARIANT 61: note = Any amino acid
  VARIANT 425: note = Any amino acid
MQDMEEELLLDVEMETETTEPQTSTAXDATTTTDRPTRWGPHPRAVAAAAIAQLVTGEXAXPALPSRQDRRPAPRSHAPTRSRWGPRHQAVGAAAIASLATGLPASAAPVSRATKHGEGRRRLQTRWGPRVSIPRAARRPGSRWGPPRAAGASGQLPASASGATGQLPEHVEAITTTPRVASDADEGPTPPDPWILRFDGACRRNPGPGGAGAALFKPSGAVVWTCSHYMPSSNETNNTAEYTALLLGVQSAVHHGATRLDIEGDSSLVIAQVKGTFACRNAKLRQLRNRVRHALRSVEKYTLRHIDRKANAHADRLANRALDRRSSSSECEPHGSCMERCCGTDTTPAVQGPTPQAAAAVPVQVWPQWQRQTMVAWTTSHGGRCRDCSTRCGRSLPSLAHRPRLSPRRQPRLRLRQLSDEERDXAADALQELSDVMASKIVDADSWDTGEGYISSIPERIREVLQPYTTRPPRPGHQQQQRRRPPRVTRNQREHRLDEALDDMQATQQAAPRDQRAIHRARRRVGRVRASMAKQELRQAFAKDESKCVSKILAGASAETAAEEHVDECPIDAATLHAHFTGTNAPRTDFDYDAACGQEFRGALDSMQPPTVATDAFEEELTIDEVEDQLTRAAKTSSPGHDGIGYDIYSRFAAQLVPLLHAAYQFCWLHRRVPALWKLGIVRLIHKKGDPMQPTNWRPICLQPAIYKIYSGLLARRLSRWMEQNQRLPMAQKGFRAFNGCHEHNFVATTLLDQTRRSHRRLYQVWYDLRNAFGSLPQQLMWSVLRHLGVDASFIARCKNIYQDSAFVVANAVDGATDPVRQEVGVYQGCPLSPLLFISALVPLIRRLEKLDGVGVPLAEGVRPCATAYADDIKVFSDSAAGIRKCHDAVTRFLEWTGLRANPGKCASLAVTTNARGNPVRDDGVHLELQGEVIAPLSLHDSYRYLGVGDGFDHVRHRLQLEPKLQQIKREAVALMQSGLAGWQVVKALKTFVYPKVEYALRHLRPLQSQLQGFDRAVVRGLRHLLRLPQSATTEFFYTPTSGGGLGLQSLVEMHQALQVAHAWQMLHSKDAAVVAVAKEQVCQVARKRYRLQEEHWRGRGDELVRLFLNSELAASPFADCLRRNGDIGSLWTDVQRTLRLHHLSLTAQDDRDGQDPLALRVPHHTKWLDHKTVLRHVKLHMKIRHQTRWKGLVDQGKTVRVHGGLGAKFVSTGAGLSDDAYRFGVKARLNQVDTNAVLKRKRLRSSKTCRDPTCSSAETLAHALNHCASNMDAIRQRHDDALEQIGSKIRGALERAKSTTELRLNQTVPEYTGAALRPDIVLRNVAAKKMVIADLAVTFEDHAAGARHSSLQLSHDHKTLKYQPIVAELRVQGWQVQTAAIVYGSLGSVQPSNFKTYTEKLKLHKREARQLDLQLSSHCIQASHRIWGWHCRRHREGQRSGNTSRASRGSGGTPRRTSQVRARR

SEQ ID NO: 1443 - protein, 1812 aa, synthetic construct
  source 1..1812: note = Description of Artificial Sequence: Synthetic polypeptide
MLADPAALAAGLARAPPPPSAPQDPSPAFPAGPAGQNPRAAAPARVEVHTVVAPPGRAGGMLPDPGLVDSSPAAATAATPAPVAATATTARAAARVAVEHHAHAEPNQEHLPMARVLVEPMQVDECSSCDRSTLTADDGSGDDVAAPSSMLSNDVAAPMDVDSGTSCPPTLQQPLQRPRALHVGSKRRRLDADDGEEAHQLQEEEEAGIHAPALRLSAASAQPASVLAVYTHNASRFDCTLCAYTAGSFASLLTHRNSRHRRTAFLDRFSAGCACGVPFASRLAAARHAQACASLSSAPSAEASSAAGTSSPTADGADSTVSAVAHAEPGLPHHNDTELTASPPLVSSSDVEVQATKTEATDNRWGAPLPRVLVASRIAGRLAQVPPPRWGPPLPRTTIAARIATRLAATPAPRWDPPLPRSLVVSRIAARLLPALPDAPACEEEAKDSDTMDWAPTWTNEETKESEPHDEAPGQVDEETIDDADGEWLLRFDGACRANPGPGGAGAALFKPSGPVVWTCSHYDPSTTATNNTAEYTALLLGARAAADHGVTKLRIEGDSTLVIQQVRGIFATRSTRLRALRNKVKLELARVGSFSLHHIDRQANGHADRLANAGLDRRRTKLECSVHPDGRGCTNTSVATAAPTAPAAPLPSARPPASTAAPSPDDDHSDQGDIDDGEVYAAMCISPDAVPHRRPRLRLRRLTDEESEEAGNVVERLAASLAAKIADAPDWETAEGYITALPYALYDKLQPYSQSQHQPPRQQQQQQRQRPRQQQQTRQRRQRRCKRGGGSQHRQRKTRRRRPPRVTRHHREHRIDEALDDLHALESRRPQDRTAISKARRRVGRIRSALDQHQLRHRFDTDEKACVDGILAAARDKDRAASVTTTAQTAAPPHSAPASAPSSAVDDGICPIPGDLLHAFFTDVNTPRTEFDADSPIGARFREALAQLPAAIAATELLMEPPSPDEVEDQLQRVRGTSSPGLDGVGYDVYKTFTQQLLPALHAAFSRCWTDQRVPQSWKLGVVRLLFKKGDRQDPANWRPICLQQAVYKLYAGILAHRFTRWLDANTRHADAQKGFRAVNGCGEHNFLAATLTDNARRRRRELHVVWYDIKNAFGSVPHELLWEVLRRMGVPAQFIACCQGIYDAAAFTVGNAADGTTAPIQLRLGVFQGCPLSPHLFTAVISPLLHALKRLPGTGVQLSAVDRPGASAYADDLKVFSDTKDGITRQHQLVTDFLRWTGMVANPSKCSTMSVQRDNRGVLKTANLTLQLDGAQIPALGMTEAYAYLGIGDGFDHVRRRVELAPKLRELKADTTALMQSGLAPWQVVKALKVYIYPRVEYALRHLRPFQQQLQGFDRHLARGLRHLLRLPTSATTEFLYAPTSRGGLGLLPLTEVHGALQIAHAWQTLHSPDPAIRRIARVQLRQVADARHRLDAEHWKERGEELCERLLNSQLGTSAHAPPKRRNCDIGSLWVDVQRHLRSLGLQLQTAPADTHTGAPAQPLQLRVPHHDKWLTHKDVLRHVKLHIKNNHWHRWTSMRDQGKTARAHGGEGSGFLTQPRGMWEADYRFAVAGRLNQVDTYSVLKRRRLRSHDRCRQPGCHRAETLAHVLNHCPGTMDAVRGRHDGALKRIERELHASATDRRDRVELRVNQTVPSLAGPALRPDLQLYNHTKKTVAVVDLAVAFEEQASDDASSSALSLIASHKRAKYDRIKRHLERQGWKVHLSALVYGSLGAVASGNYQVYTTHLGLLKRDAKRLDRQLSVECIQSSRRIWNLHCSQHRTRQHQARPSQGPRGSRATETGGTPSQTSRR

SEQ ID NO: 1444 - protein, 1595 aa, synthetic construct
  source 1..1595: note = Description of Artificial Sequence: Synthetic polypeptide
  VARIANT 337: note = Any amino acid
  VARIANT 1389: note = Any amino acid
  VARIANT 1441: note = Any amino acid
MSGDVVSSDGSSRTTDASGDGDDGAGSSDAAGDVGVVAMDVDQGARRQQPPWQRVGGKRRRLNDVDDEDTRELAELLLEEEDEAGDHAPAPRLSAASARPASVLSVYAHNAQRFQCTLCTYTAASFASLKRHRDSRHRRTAFLDRFSAGCACGAPFASRLAAANHAHACASLNRTLSVAATPAAGELSPTAGAANATVKAATVTPDSPRQDPPELAASPPLASSPDVAVQAADMQAPTRWDPPLPRTLVATRVASRLTDLTPPRWGPPLPRATVVSRIAARLEAAPTPRWGPPLPRVVVASRIAERLAPPELAADDETKDGEEDQSFTEPVAAARSXGGEDANGEWLLRFDGACRANPGPGGAGAALFKPSGPVVWTCSHYMPSSSETNNTAEYTALLLGMRAAADHGATRVHVEGDSTLVIQQVRGIFATRSTRLRGLRKSVKAEMARMEHVTLHHIDRQANGHADRLANAALDRRKTKLECGLHPDGQGCSSTAATTAVPSVVPDRPPSSTAAAPTPSAEPDETEQGDIDDGEVYAAMCIGPDSIPERRPRLRLRQLSETEEEEAGAIVERLAATLAGKITDASDWATAEGYITALPYTLYDKLQPFAQHRHQPRPQHRQQPQRDPPLGTHDGDHGQPSTSRSRRRRRRAKDRLRRRPPRITRHHREHRLDEALDDLRAVEHASPHDRPAVARARRRVGRVNSAIAQQQLRHKFDKDEKACVDGILAAARASRGLATPSASASRHPPPVPSTAADDGSCPIPSDELHAFFTAVNTPAGTFEPMAPVGAPFRSAVAHLPAATSQPELLSDAPTTDDIEDQLQRARGSSSPGLDGVGYDIYKAFAAQLLPALHAAFACCWRHKQVPQSWKVGVVRLLFKKGERTEPANWRPICLQQAIYKLYAGVLARRLTRWLDANGRHADTQKGFRAMNGCGEHNFLAATLVDQARRKRRELHVVWYDFANAFGSVPHDLLWEALERQGVPSPFIACCRGLYADAVFTVGNAADGTTAPIALRVGVFQGCPLSPHLFTAAIAPLLHALKRLPDTGVQLSRVDCLGASAYADDLKIFSGTEGGTKRQHALVADFLRWTGMRANPAKCCTMSVQRDTRGVLKACNLGLQLDGAPIPALTMSASYAYLGIGDGFDHVRRRIELAPKLQELKHDATALLQSGLAPWQVVKAVKVYLYPRVEYALRHLRPFHQQLEGFDRHLVRGLRHLLRLPANATTAFFYAPVSRGGLGLLPLTELHAALQVAHGWQMLNSKDPAIRRIARVQLRQIADARHRIDAQAWQDREEELAQLLLNSQLGASTGAPPKRRNGDIGSLWVDVQRHLRHLSLKLETAPACAETGTAAAMLQLRVPHHDKWLDHKTVLRHVKLHYKNKHWARWAAMXDQGKTARTHGGAGSGFLTRPRGMWEADYRFAVAARLNQLDTHSVLKRRRLRXHDRCRQPGCTQGGDAGARAQPLRRHHGRGPRPPRRRPQAHRARAARVVAGRPGPRRAPGQPDGAVARRPRATARPPAVQPHQEDGGGGRPGRGVRGAGERRPGELGAGTHRRTQAREVCRRQATPRAPRVEGPPLGARVRLARRGAGRQPQGAY

SEQ ID NO: 1445 - protein, 1614 aa, synthetic construct
  source 1..1614: note = Description of Artificial Sequence: Synthetic polypeptide
MDYDDSEFFDAICIPDEDADVLDDGDEGDEGGNDDESSEPLPLAITNAPSAPLHATMLCGTVTQPWLLRFDGACRRNPGPAGAGATLTRPNGIILWTHYRYIPDKTATNNVAEYEALLDGLRCAAHHGVKHLRIEGDSNLVIEQVKGIFACSTSLRPRRDQVREILRHFETYSFRHIDRALNRQADRLANQALDLLKTVSVCALSQTRVQDDTGAAHGCWHWTPPDASPTDDASTSILTQDVPVPMDIDDYDPDEPMNAADDPVSINAEREGGTVYPVLRLGPNVVPERQKRLQIPWLPPREMQKLEKKIEVLGETFASRIRDAPDWFSAEGYITALTSELATLIRQSTAATTGPNAARPCERTISKEKRRARRTTPLQRALAEAKHELQIIQPDASRKSVRKAARRVKRISQAQQRHDLRRLFSTNERRCVEKILRDPPVGPSSTSSSLPATDDDRCTIDPADLFAYFQTQATAPTNFDFDDEGGELFRSVLDELPRADQEVHLLEDEITRDEIEDQLSRISKSTAPGLDGITNAVYVRFKLQLLDALQAAFNACWRYNRVPSMWKAAFVRLIYKKGNRAVPSNWRPICLQQTVYKLYTAILASRLQRWMDANARFTMSQKGFRAFNGCHEHNFVATCLHDQTRRLRKKLAIVWYDLRNAFGSLPHEYLWRVLARLGMPPQFVARVRQLYADASFTVESRDGTTDPVQLERGVYQGCPLSPYLFIAALIPLVRALHKLKDQHGIVLAPGVTDCVSAYADDIKIFARSGTGAKALHEIVVRFLSWTNMAANPAKCALMVTDGARGGDDTDASMTLSIEGETIPRLTGKEGYVYLGVEDGLAHERRATCLRDSLKAASADVVRLLRSDLAPWQIVRAIKSHVLSRFDYVLRHLRPFLSLFDGFDKMLVRGIKRLCQLPQTATSEFLFSPTSAGGLGFLPLKELFAALQIVHALQMLHSKDANVRAIARHQALQVVRKRYALQSDHWSDREEELLEEFFNGTLERSPFALAKKVSGDIASLWTDVRVNLTKYGLKFGEAHGRRLQPLVSHTDKQLAPQQWASAIKTHMRLRHLKRWTTLVDQGKTARMHERIGSAFLTRPSGVYDASYAFAVRARLNQVDTRSALKRKRIVNNSRCRVSGCSELETLAHVLNHCRFGSDSIRARHAETLLLIKTTMERELTRPGRQHQRLLVDATVPEARDPVPSNDAAESNIGAMAPSISHLRPDIQLYDNKTMEAVIIDLAVAFEDQSTDDAASSSSFARVKGVKTKKYEVIKQFLEYKGYTVHVAALVYGSLGSVDTGNFAVYTERLGLRKGAVRRLECSLSARHINFAHRMWRRHAIAHTTGLRLIGTNSVQQQGVQRAPAEKQQHQRPVQRPSRAQAPRDQPSQQQQSQQSFQQQSQQSQQSQQSQQSQQSRQRHAPTPTPVPVPVPVPVSTPTLTPTPTPTRRPKPAPSSTQPQQGAPAQRRQQREQKKQPACRRRHATAVRETPPAAPTAARTATPTARPTATTRSTSTTRSTATATSTTRSSAPTSRPSAPRPRSSAPRPRSSAPTTRSAAPTTRSAAPTAIATTSVYKSRRTTNAISGATTRRSASSKRAPMQPRTALTPTQQQQRQ

SEQ ID NO: 1446 - protein, 1983 aa, synthetic construct
  source 1..1983: note = Description of Artificial Sequence: Synthetic polypeptide
MPRSLASEPVHSSASRLPSQAPPTSRSGAAHTPPPSLQARPLASADAGLAATALASPQDPPYDVAPPGRAAGRLPDSVSPGATLSAATARALAVRHWPLELDSDSSDDEDAQDPHAAAPGPPADVASVLAPPGRAGSMLADPAALAAGLARAPPPPSAPQDPSPALPAGPAGQNPRAAAPARVEVHTVVAPPGRAGGMLPDPGLVDSSPAAATAATPAPVAATATTARVAVEHHAHAEPNQEHLPMARVLVEPMQVDECSSCDRSTLTADDGSGDDVAAPSSMLSNDVAAPMDVDSGTSCPPTLQQPLQRPRALHVGSKRRRLNADDGEEAHQLQEEEEAGIHAPALRLSAASAQPASVLAVYTHNASRFDCTLCAYTAGSFASLKTHRNSRHRRTAFLDRFSAGCACGVPFASRLAAARHAQACASLSSAPLAEASSAAGASSHTVDGADSTVSAAGHAEPDLPRHNATELTASPPLVSSTDVEVQATETEATENRWGTPLPRVLVASRIAGRLAQVPPPRWGPPLPRTTIAGRIATRLAATPAPRWSPPLPRSLVASRIAGRLLPALPDAPACEDEAKDSDEMDWEASEPHVEAPGPVDEETIDDADGEWLLRFDGACRANPGPGGAGAALFKPSGPVVWTCSHYDPSTTATNNTAEYTALLLGARAAADHGVTKLRVEGDSTLVIQQVRGIFATRSTRLRALRNKVKLELARVGSFSLHHIDRQANGHADRLANAGLDRRRTQLECSVHPDGRGCTNTSVATAAPTASAAPSTPTRPPATTAAPFHSDQGHIDEDDERRADIDDGEIYAPMTLGPDEVPARRPRLRLRQLSDEELEAAGAIVERLSASLSAKITDAEDWGTAEGYITALPHLLYDKLLPYSRTAPRHQRPPRPSRNQQDHPQPRRDQPQRNVDEQQHAESQQGEDQRQQQPPTRRRRRRGKRRGRRQRRHPRQPGQSTRASQQSRQRRPRPPRVTRHHREHRIDEALDELHTLERARPQDRSAIDKARRRVGRVRGAINQHLLRHRFDTDEKACVADILEKAHAARAARTAQAAGAATSTGGAATAPTQQAATSALGDADDGTCPILADELWQYFTGTNTPRWEFNPATPVGEAFRTAMARLPPATRLRELLTEAPTADEIETQLQHVRGSSSPGLDGIGYDVYQRFAQQLLPVLTASFKRCWTAKMVPQSWQVGVVRLLYKKGAHDDPANWRPICLQQAIYKLYTGVLARRLVRWLDVNDRHAPGQKGFRAVNGCGEHNFLAATLIDQARRKRRSLYEVWYDFRNAFGSVPFQLLWDSLQRLGAPADFIDMCKGLYHQAAFVIGNAADGPTAAIRQQVGVFQGCPLSPQLFNVAISPLLFALRRLPETGVQLSGDDRVGVSAYADDLKTFSSTKAGATKQHELVAAFLAWTGMKANAAKCSSMGVRRNSNGATEADNLDLALDGTPIPSMTHMQSYTYLGIGDGFDHVHRRIELAPKLKTLKQDTTALLESGLAPWQVVKAVKVYLYPRVEYALRHLRPEDQLLESFDLHLRAGLRHLLRLPKNANNDFFYSPVSRGGLGLLPLVELHAALQIAHGWQMLNSTDPATRRIAREQLHQIADARHRLDKAHWKERGDELCQLFLNLDLGTSAHAPPKRRNCDIGSLWVDVRKNLQAFGLKLETAPADAESGTPALPLQLRVPHHEKWLTHRDVLRHVKQHLKNKHWRAWCAFQDQGRTARAHGGVGSSFITRPRGMWESDYRFAVAARLNMVDTSATLARRRLRAHDRCRYPGCRWKESLEHVLNHCPGTMDAVRGRHDGVLREIEHALRAPSGARRELRVNQTVPGLPGPALRPDIQVYNHDQRTVAVVDLAVAFDRQDRDDPETSGLAKAAAEKKAKYTGIQRHLERQGWKVHLSALVYGSLGSVAPNNYKVYTEHLGLLKRDAKRLDRTLSVACIQSSRRIWNLHCAKHRARQHQTPSQSRGRRVTETGGAPSRTDRR

SEQ ID NO: 1447 - protein, 1493 aa, synthetic construct
  source 1..1493: note = Description of Artificial Sequence: Synthetic polypeptide
MQDQVDAEQQARNRWGPPLPRPLVASRVAARLGEVPPPRWGPPLPRGVVVSRIAARLEAVPVPRGGPPLPRSFVATRIADRLAPPSPDLSLLDEEMKESEPPDPTHHSADEDSTDAETADAVMEPAFVSDPPTATPREWRLQFDGACRGGPNPGGAGALLYNPEGAVVWTGSHYMPGAKETNNSAEYTALLIGARAAADHGARQLRIEGDSLLVIRQVKGLYATKSTRLRQLRNAVRHELARVGQHSLHHIDRQGNAFADRLANRALDLKSDKVECKEHPVAGACTTCMGSPSAGPPATPPPTTADIEMADAGSDDELRADIDDGEVYAPMRLEPGVIPTRRSRLRLRQLTDDEMEAAGEVVERLSAGLSAKIADADDWETAEGYITALPYMLYDKLQQYTQVRHGTARSPAPHPQRRDVQGQVETHREPRHETIGQPDQPGEPSPTRRRRRGKRKGRRQRRHPRRTNCGGGGRQQRKQRHPRPPRGTRHHREHRIDEAIDELHALERARPQARPAIAKARRRVGRIRSAIDQQLLRHRFDTAEKECVDGILAAARTARDARTTVRAAAATGTTATPETAVTSGTEQQDDNGTCPIPSEVLWRHFDSVNTPQRDFDPEAPEGAAFRSAMARLPAATRFMELLKEEPSTDGIEVQLQHASSTSSPGLDGVGYDVYKRFASQLLPVLKAAFKCCWTHKQVPQSWKLGVVRLLYKKGDREDPANWRPICLQQAIYKIYTGVLARRLTRWQDANDRHAPGQKGFRPVNGCGEHNFLAAMLIDHARRKHRPLYEVWYDFRNAFGSVPLGLLWDALERTGVPAEYIAAVQGLYDHAAFMVGNAVDGSTAPILQRVGVFQGCPLSPPLFSAAISPLLHALQLLPSSGVQLSGDDRPGVSAYADDLKTFSGTKAGVTEQHELVAMFLRWTGMAANPAKCRSMGVRRNGNGAIEADHLELALDDTPIPTLTHLQSYTYLGIGDGFDHVRRRVALAPKLKLLKQDATALMESGLAPWQVVKAVKGYLYPRVEYALRHLRPDDQLLESFDLHLRRGLRHLLRLPKSANNDFVYAPVSRGGLGFLPLVELHAALQIAHGWQMINSPDPAIRRIAREQLHQVADARHRLDKDHWKQRGDELCELLLNGELGTSAHAPPKRRNGDIGSLWVDVRKNLKAFGLKLATAPADPESGAPAKPLQLCVPHHAEWLDHRNVLRHVKQHMKNKRWRAWCSHVDQGRTARAHGGVGSGFLTRPRGMWESDYRFAVAARLNMLDTVNVLARRRLRAHDRCRHPGCRWKETLAHVLNHCPGTMDSIRGRHDDALKEIERTLHASSGDRQGRTELRTNQTVPGLAGPALRPDLQVYNHDQRTVAVVDLAIAFDEQPRDDPESSGLAKAAAEKKAKYAGIKRHLERQGWKVHLSALVYGSLGSVAPSNYKVYTEHLGLLKRDAKRLDRQLSVACIQSSRRIWNLHCAQHRARQHQDQPAPRGRRVTETGGTPSRTDRR

SEQ ID NO: 1448 - protein, 1716 aa, synthetic construct
  source 1..1716: note = Description of Artificial Sequence: Synthetic polypeptide
MLADPAALAAGLARAPPPPSAPQDPSPAFPAGPAGQNPRAAAPARVEVHTVVAPPGRAGGMLPDPGLVEEPIQATYAHDAAQFECALCPYVAESMAVLVQHRRSAHRGTRFKDIFTSGCQCSLVFYARIVAASHAVACARRNQRAVPPAPTPVAPTRPEATPQPTGYLAAAMTAAAAAASSDTVVAAATNMQSAVPAAAKTTGLQLVPPELEPALPQRASCHAGKRRRLNADEAVTPCTPTARVSPQTEVAMAPHDAPQDDTVLQREAAEPQPDPAATQGAQVQRVEDTTAAQDDTVQQDHDADTAQVSPPRRTPTRWGPRPSSTQEPSPMTGEPAATLAARRPLTPAATGTRATRWGPCHRAIGAAAIARLVTGLPTEPAQPQRRQPPPPQEPPLQPEPQAAAATVAADIAATVAADIAAAAANAAMDVDGGPAADETWLLRFDGACRRNPGPGGAGAALFAPSGAVVWTCSHFMPSRSETNNTAEYTALLLGAQSAVHHGAKRLNIEGDSHLILSQVRGAFACNNKRLRSLRNRVQASLRQLDWYRLQHIDRKANQHADRLANRALDLRRTVTECGPHAETRNRCFQTPQPLVEPGETHCVPGSDEVLAANTAMEDATAVPTEDDEAEVAARDGGEVFPTIAIGPDSAPAKQPRLRLKKLDEDDFDAAAAAVTRVSEELASKIVDAGDWTSGEGYISAIPERLRAALRPFALPTQPARPQPREPRMQQPPRRPPRVTRDHLEHRLDEALDTMENVQRSTPQNQKAVRRARRRVGRLRSAMDRTRLRKKFATHERECVAEILRRASTEEAANPSQEKCPIDRATLHEYFTATSTQRTPFDYDSAKGTEFRTFLEVMSTPSHETSALTAEPTLDEIEDQLAHVKAGSSPGHDGVGYDVYRRFQVQLLPLLHAAFRFCWRHRRVPALWKVGFVRLLHKKGDPQQPNNWRPICLQTAIYKLYSGLLARRLSKFLEANELLPMAQKGFRAFNGCHEHNFVATTLLDQTRRMHRRLYQVWYDLRNAFGSLPQQLMWGVLRQLGVTEEFVARCSGIYEDSYFVVGNASDGATEPVRQEVGVYQGCPLSPLLFITALVPLLRALENQDGVGVPLADGVRPCATAYADDIKVFCDSATGIQRCHALVTRFLEWTGLQANPAKCAFLPVTRSQHSNPTRDRDIELRIHGEAIATLGLQESYRYLGVGDGFDHVRHRLQLEPKLKQIKREAVALLHSELVPWQILKALKVYIYPKVEYALRHLRPLKSQLQGFDSAIVRGLRHLLRLPENSHDGLFFSPTSAGGLGLLSLVELHEALQVAHAWQMLHSKDPAIRAIARTQVGQVARKRFKLVEEHWRGREDDLAQRFLNTELAASPHATETRRNGDIGSLWNDVRDTLQTLGLKFAAGDEEEAPGLLQLRVPHHTKWLSHSTVLRHVKLHMKLRRMDTWKSKVSQGTTVREHGGVGSRFITAGAGLSDAEYRFAIAPRAHLIDTNSTLKRRRLRANDTCRAPGCSYTEPPAHILNKCSPNMDAIRKRHDDALERIADALRRKVEKSGGRLEVAINKTVPEYDGAALRPDIVLRNTETKRAIIADLAITHENQPTDATTSSALQQSRDNKITKYQTVAAAMMRAGWRVRVTGIVYGSLGSVLPSNFKVYTELLALLKRDARRLNRQLSSHCIRASARIWSAHCRRHRERQRSGNASRASRGSGGAPRRTSQASARR

SEQ ID NO: 1449 - protein, 1546 aa, synthetic construct
  source 1..1546: note = Description of Artificial Sequence: Synthetic polypeptide
MSGDVVSSDGSSRTTDASGDGDDGAGSSDAAGDVGVVAMDVDQGARRQQPPWQRVGGKRRRLNDVDDEDTRELAELLLEEEDEAGDHAPAPRLSAASARPASVLSVYAHNAQRFQCTLCTYTAASFASLKRHRDSRHRRTAFLDRFSAGCACGVPFASRLAAANHAHACDSLNRTFSVAAAPAAGELSPTAGAANATVKAATVTPDSPRQDPPKLAATPPLASSALVVDPDHAEQQARERWGPPLPRTLVAGRVAARLSEVPAPRWGPPLPRGVVAFRIGHRVLPPEMTSDEETKDDSSVQDGDRQDYPVAAMDVDSGMSGEWLLRFDGACRANPGPGGAGAALSQPDGSVVWTCSHYMPSSSETNNTAEYTALLLGTRAAADHGTTTLRVEGDSTLVIQQVRGIFATRSVTLRHLRDQVKLELARVGRFSLHHIDRQANAHADRLANRALDLRRTVSECGVHPDGNGCTPTAIDDRPLAPTQQPPDAPPPPPAADIEMEDPDDEDLADIDDGEVYAAMRVGPNATPQRRRRGRSGTAKKHRRQRPPRVTRHHREHRLDEALDDLHAVERSTPSDRTTVRRARRRVGRVNSAIEQQRLRHRFDTDEKACVTDILAKACATREAARTTASGGDPPAGPATPAAGSADDGTCPILGEELWRFFDSVNTPRQEFAPDAPVGAAFRSALARLPAATSCKELLTAAPSAGEVEDQLQHVRGASSPGLDGVGYDVYQHFAAQLLPALTAAFKACWTAKRVPQSWKLGVVRLLHKKGAREDPANWRPICLQQAIYKLYTGLLARRLVRWLDANDRHAPGQKGFRAVNGCGEHNFLAATLVDQARRKRRTLFEVWYDFRNAFGSVPFALLWDALARLGVPDDYVTMCKGLYESAAFVVGNAIDGTTDPIALRVGVFQGCPLSPQLFNAAISPLLFALQRLPATGVQLSGDDCPGASAYADDLKIFSGTEDGIKRQHALVADFLRWTGMAANPNKCCTMSVQRDGRGVLKTDDLQLDLAGTPIPALSMSASYTYLGIGDGFDHVRRRVELAPALKQLKDDATTLLQSGLAPWQVVKAVKTYLYPRVEYALRHLRPFQQQLEGFDRHLARGLRHLLRLPGNATAECFYAPVSRGGLGLLPLTELHAALQVAHGWQLLNSKDPAIRRIARVQLRQIADARHRIDSRAWEGRDEELCELLLNSQLGTSPDAPPKRRNGDIGSLWVDVQRHLRTLGLKFATAPACADAGSAATTLQLRVPHHDKWLDHRTVLRHVKLHVKHRHWSKWAAMRDQGKTARAHGGAGSGFLTRPRGMWEADYRFAVAARLNQLDTHSVLKRRRLRAHDHCRQPGCSRAETLAHVLNHCAGTMDAVRGRHDDALKHIERALHASSPGGQDRVELRVNQTVPSLAGPALRPDLQLYNHTKKMVAVVDLAVAFEEQASDDPESSALARIAAHKRAKYAGVKRHLERQGWKVHLSALVYGSLGAVPAGNHKVLTEHLGLLKRDAKRLDRQLSVACIQSSRRIWNLHCSQHRARQHQAPGGSRAAETGGTPPRTGRR

SEQ ID NO: 1450 - protein, 1392 aa, synthetic construct
  source 1..1392: note = Description of Artificial Sequence: Synthetic polypeptide
MARVLVEPMQVDECSSCDRSTLTADDGSGDDVAAPSSLNSNDVAAPMDVDSGTDCPPALQQPPQRPRALHVGSKRRRLDADDEEEARQLQEEEEAGIHAPALRLSAASAQPASVLAVYTHNASRFDCTLYAYTAGSFASLKTHRNSRHRRTAFLDRFSAGCACGVPFASRLAAARHAQACASLSSAPLAEASSAAGASSHTVDEADSTVSAAGHTEPDLPRHNATELTASPPLVSSPDVEVQAPETEATENRWGTPLPRVLVASRIAGRLAQVPPPRWGPPLPRTTIAGRIATRLAATPAPRWDPPLPRSLVVSRIAARLLPALPDAPACEEEAKDSDTMDWAPTWTNEETKDSEPHDEAPGQVDEETIDDADGEWLLRFDGACRANPGPGGAGAALFKPSGPVVWTCSHYDPSTTATNNTAEYTALLLGARAAADHGVTKLRVEGDSTLVIQQVRGIFATRSTRLRALRNKVKLELARVGSFSLHHIDRQANGHADRLANAGLDRRRTKLECSVHPDGRGCTNTSVATAAPTAPAAPLPPARPPATTAAPSHDDDHSVQGDIDDGEVYAAMCIGPDAVPHRRPRLRLRHLTDEESEEAGDVVERLAASLAAKIADAPDWETAEGYITALPYALYDKLQPYSQAQPQPPSQQQQQQQQRPRQQQQTRQRRQRRGKRGGGSQRRQRKTRRRRPPRVTRHHREHRIDEALDDLHAIESRRPQDRTAISKARRRVGRIRSALDQHQLRHRFDTDEKVCVDAILAGARASQGATTAPPSATTDPPAPMDDSRCPIPGDDLWRFFDSVNTPRRSFDAEAPDGAAFREAMACLPAATRAQELLTEAPTVDEVEDQIQHARASSSPGLDGVGYDIYKQFAAHLLPALHTAFVCCWNHKRVPQSWKLGVVRLLHKKGDRQDPANWRPICLQQTIYKLYAGILSRRFVRWLDANARHAEAQKGFRAMNGCGEHNFLAATLVDHARRKRKELHVVWYDLANAFGSVPHDLLWETLARQGVPPTFVDCCRGIYSDAAFTIGNAADGTTAPIRLRVGVFQGCPLSPHLFTAAIAPLLHALKRLPVTGVQLTGVDRPGAAAYADDLKTFSSSVDGIKRQHELVATFLRWTGMAANLSKCSAMSVQRDSRGVLKTGDLCLKLNDAEIPALSMTASYAYLGIGDGFDHVRRRLELAPMMKQLKHDATALMQSGLASWQVVKAVKVYLYPRIEYALRHLRPFKQQLEAFDEHLRRGLRHLLRLPTNATSAFFSAPTSRGGLGLLPLTELHAALQIAHGWQILNSPDGATQRIAREQLREIPDARHRLDTAHWRNRDAELCELLLNSQLGQSSHAPPKRRNCDIGSLWIDIRRQLGTLGLKFETAPGRRSHQPARPAIAAFACRTTTSG

SEQ ID NO: 1451 - protein, 1606 aa, synthetic construct
  source 1..1606: note = Description of Artificial Sequence: Synthetic polypeptide
MSGDVVSSDGSSRTTDVSGDGDDGADGAGSSDAAGDVGVVAMDVDQGARRQRPPWQRVGGKRRRLNDVDDEDTRELAELLLEEEDEVGAQAPALRLFAASAHPASVLSVYAHNAQRFVCTLCAYTAASFASLKRHRDSRHRRVSFVDKFSAGCACGTPFGSRLAAARHAQACASLSIPRTVTAPAAAGDLSPTATGANATASAAATSPDLPRPASPELAASPPQTSPFDVAIQADAAEQTAWTRWDPPLTRAAVAARVASRLAVVPAPRWGPPLSRTLVASRIAARLDAQTSRWGPPLPPAMVASRIASRLAAMPAPRWGPPLLRTVIASRIADRLLPPELAADEETKDDDVHMDNAASVDVDEESEVADVVMTDHDGEWLLRFDGACRANPGPGGAGAALFKPSGPVVWACSRYMPSSSATNNTAEYTALLLGARAAADHGATHLRVEGDSTLVIQQVRGIFAARSTRMRALRNQVQSELARVGSFSLHHIDRQDNAHADRLANRALDLRRTVIECGIHCDGVGCTATTTEVQSSSAPEIPTRPVADDHDEHEVVDVVDVCGVCGVCGDRGTCGVCDVSGDIDDGEVYAAMRTGPDAVPARRPRLRLRKLTDEEQEEAGTLAERLGATLAAKIADARDWESAEGYITALPYLLYDKLLPYSQGPARSLPVRQHQRQQQQPDGQFQRPTQSRSAARRQRRQRHRARRRPPRVTRHHREHRLDEALDDLHAVERATPSDRRSIRRARRRVGRVNSAVEQQRLRHHFDTNEKGCVEILLAKARAQRSTTVARTAVGEPNSGAAEDDGTCPIPSERLHRHFTEVNTPGSSFDAMAPVGAPFRAALAHLPAATEASELLTEAPTPDEIEDQLQRAKGTTSPGLDGVGYDVYKAFSTQLLPVLHAAFQCCWQHHRVPQSRKQGIVRLLYKKGPREDPANWRPICLQQVIYKTYAGVLARRFTRWLAANGRHADAQKGFRTVNGCGEHNFLASTLIDHARRSRRELHMVWYDLKNAFGSVPQELLWEVLQRMGVPPAFVEVCQGLYQDAAFTVGNAADGPTDLVRQLVGVFQGCPLSPHLFTAAISPLLHALDRLKDTGVRLSADDRPGASAYADDLKIFSGTADGVKRQHALVADFLRWTGMVANPNKCCTMSVQRDGRGVLKACDLELQLDGARIPSLIMNASYAYLGTGDGFDHVRRRIELVPALMQLKDDATALLQSGLAPCQVVKAVKTYLFPRVEYALRHLRPFQQQLEGFNRHLVCGLRHLLRLPVSATTSFFFVPVSRGGLGLLPLTELHAAPADRRPAPPPRPRPLEGAGGENMRAADQLAARDVGPRPTQAPQRRHRLVVGRRPAPPPRTRPQARDRAGVRGDRHRGGDAAASRAAPREVAGPPHGPAAGEAAHEEQALAAVGRDEGPRQDRPHPWWCRERLPHAASRPMGDRLPLCSGGSAQPAGHAQRAEAPAPPRARPVSTAGLLPCRDTGTRAESLRRHHGRGPRPPRRCAQDHRARAHRVVRAARTAPSSGSTRPCPRSPAPRCGPTSSSSTTPRRRWRWSTWPWRSRSRRATTPRALRWRASPRTSEPSTPASSGTSSAKGGRSTSRRSCTARWAR

SEQ ID NO: 1452 - protein, 1540 aa, synthetic construct
  source 1..1540: note = Description of Artificial Sequence: Synthetic polypeptide
MATSSSSVSSGNVQTEVRCVYHGKGDLLLECPVAHCPSIHPTVATITKHLKKHHTPQFEQITTKNLTITYTCSQCSFSTTGLTQHHISKHYKTCKGVGAVQEGNKGRFCCPACGTRWALLCKARHHFNNVHFEYDTPPIAAFSGTPYKLKKRKFTIINKALTYSCPLPLNQLLCPLWSCSLTILNKPLSSVQQETAHGDGSQGQSYVPTQLRQVLRARCHCGNPPIGKGHWASCQGKRPLSSPKGGRSSPTPPANLTLHFLNYLPFQLPSQSSSPQSSTLDPTACKARVPIPSFLRGDCEVTFFIIPSVNFYRPYLSYPLRMFWRNRTSSGHCSLHRVVRGFVRERLVPHPRSKSPARTPLEFLCEFRLAGVFPDPGKVASLRPVPAPLTLCLSPPVAGPMISCEDHSAPPSVRSSSPIPNSPASVSSVEAHLSDLLDKVSSGELRPLSPTLPSSGFFGPLLPPTPPPRPTPSAEKASPSGLSYLPCREVKIASIARPSPASQRVGCDADRTGPSLNPNYQQTSPPSTPSFSPIVRPPKFPRSGAKVNSKSKPPGVRPRRAKPIEPGTESASPVDVDTISSSVQEPCTPENRTPEFFYERKWLVSILNIHEREGSNFFQFNRDLEYWTQLLSGSQKGGRAKRASYNRGAANQAMKNRDSGRKDFDPRPVAGHSSGGGTELGSRPRYPKGARLRADFWRDMKGTVRKLLDGSNGERRCGIPLDIIERKFRQVSMPGWIDHRRYAAGASPSLVTQAETDVAITSEEVEAVLSGLNVQSAPGSDGLSYRFWKGLDPSGRLLSCLFEIVRRHGRIPGAWPTCSVILLCKDAQGDVQDVGNWRPITICRTLYKLYAAVIARRIQTWAKQGGVLSRLQKGFMPVEGVFEHVFMLDTVLSDAKLRRKNLLAVFLDVRNAFGSVRHECLLKVLRHFDAPHYLVELVRDIYTGATCRVRSSVGETGDIPCDRGVRQGYPLSGILFNLVTEVLIPGLSAGNDGYRMACLGGKLTQVLAYADDLVVVTENRDQMLRQLGVCEEFGRWAGLAFNQRKCGLIGWRTLRGGRRVALEDPLLLNGVEIPLLRPGEHYKYLGAMTGVMSVPRTGSQLIKDFRARLQRLFTSFLTPHQKLIALKRFLLPSLSFHLRVRPIARSELIALDRRVRECLRVAFRLTKPSCQAVFHTPTDMDGLGVPSVCSESSILTIAQGFKVLTSPDGTVSATASARVKLYAAKFGGLTEAGPSDWARYLSGDDVNGNSTRKPGANLPSGLWTRVRCASRQLGAVWRVCPENGITVRVRNSVITSRDRRKLIRSFHDCSNQQWKEQWMQHPNQEKTAAAHMAYADANRWVKQPSVMEPHTYFFALRARLNLLPTRVSRAIYSRDQHPDILCRRCGASVESLPHVLNHCPPNMSIILGRHNLVLQEVLNAVDKTQFKEISVDRTVPEHMSETGEALRPDIVARRNDGSVVVVDVACPFDQKANFDEAAKRKLLKYDKLCCNIAASTGKPVECHSIVVGSLGSLAEGLSTSLRALGITDFARSKLVACHQG

SEQ ID NO: 1453 - protein, 1144 aa, synthetic construct
  source 1..1144: note = Description of Artificial Sequence: Synthetic polypeptide
MPVSTGAETDITSSLPIPASSIVSPNYTLPDSSSTCLICFAIFPTHNILLSHATAIHHISCPPTPVQDGSQQMSCVLCAAAFSSNRGLTQHIRHRHISEYNELIRQRIAVQPTSRIWSPFDDASLLSIANHEAHRFPTKNDLCQHISTILTRRTAEAVKRRLLHLQWSRSPTAITTSSNNHTITDIPNTEARYIFPVDLDEHPPLSDATTPNASTHPLPELLVILTPLPSPTRLQNISESQTSHESNKNSMHTPPTYACDPDETLGATPSSTIPSCFHSYQDPLAEQRGKLLRASASLLQSSCTRIRSSSLLAFLQNESTLMDEEHVSTFLNSHAEFVFPRTWTPSRPKHPSHAPANVSRKKRRKIEYAHIQRLFHHRPKDASNTVLDGRWRNPYVANHSMIPDFDCFWTTVFTKTNSPDSREITPIIPMTPSLIDPILPSDVTWALKEMHGTAGGIDRLTSYDLMRFGKNGLAGYLNMLLALAYLPTNLSTARVTFVPKSSSPVSPEDFRPISVAPVATRCLHKILAKRWMPLFPQERLQFAFLNRDGCFEAVNLLHSVIRHVHTRHTGASFALLDISRAFDTVSHDSIIRAAKRYGAPELLCRYLNNYYRRSTSCVNRTELHPTCGVKQGDPLSPLLFIMVLDEVLEGLDPMTHLTVDGESLNYIAYADDLVVFAPNAELLQRKLDRISILLHEAGWSVNPEKSRTLDLISGGHSKITALSQTEFTIAGMRIPPLSAADTFDYLGIKFNFKGRCPVAHIDLLNNYLTEISCAPLKPQQRMKILKDNLLPRLLYPLTLGIVHLKTLKSMDRNIHTAIRKWLRLPSDTPLAYFHSPVAAGGLGILHLSSSVPFHRRKRLETLLSSPNRLLHKLPTSPTLASYSHLSQLPVRIGHETVTSREEASNSWVRRLHSSCDGKGLLLAPLSTESHAWLRYPQSIFPSVYINAVKLRGGLLSTKVRRSRGGRVTNGLNCRGGCAHHETIHHILQHCALTHDIRCKRHNELCNLVAKKLRRQKIHFLQEPCIPLEKTYCKPDFIIIRDSIAYVLDVTVSDDGNTHASRLLKISKYGNERTVASIKRFLTSSGYIITSVRQTPVVLTFRGILDRASSQSLRRLCFSSRDLGDLCLSAIQGSIKIYNTYMRGT

SEQ ID NO: 1454 - protein, 1132 aa, synthetic construct
  source 1..1132: note = Description of Artificial Sequence: Synthetic polypeptide
  VARIANT 46: note = Any amino acid
  VARIANT 59: note = Any amino acid
  VARIANT 89: note = Any amino acid
  VARIANT 172: note = Any amino acid
  VARIANT 204: note = Any amino acid
  VARIANT 205: note = Any amino acid
  VARIANT 217: note = Any amino acid
IAKFDNNTNSASDAAPLSPGGAVADLSASEGTTDNDQAMSPAMSLXTVPLVGNRVACPXCEKREANLFFLNLSDLDRHLTQHHPDAPIXWSCIDCAKCFPKLHGARCHIPKCGGASSQARTGEFQCEACPMSFGSRRGLSTHERHAHPAVRNIKRRGADPPEENTKSWKVEXVARLKGLWEIFKDHKYPNKEISKFLTTKTVDXXKYQRKKLNLIGXESPQEATSLATEGGCDLVSSGNASFGSPVGRNENEEELIHEWKLSLKNEINKPTEVPPILKEVYNRLMLIWEEHQDDRDSLTESLDHFIRTALYELINKINKNQTDLKTKRAAKTKSPKNNRNSRKRFSYARCQELFHECPRRLADAVVNNDQAYLEPARQPPGSEEVRGLYEKLWGQVGSTYVPAPVTRVPKLSLSEIFPPIAAEDVGERIGKIRKKAAAGPDGLQRDHLTIPGLPIIMAKIYNILVYCSYFPSAWKENRTTLIPKINKPCSLVENWRPITISPILGRIFSSIIDGRIRRGTVLNMRQKGFTSENGCKINIELLNSALNYSKRNSGGIFTIVDISKVFDTVPHAALKPCLAKKGVPALIVDLIDEMYKNVKTTIKTKDGGVEIMIRRGVKQGDPLSPLLFNLCLEPLLEEIEEQASGINVSEHRKVSVLAFADDIVLLGADAREAQHQINVLTDYLQSLMMNLSIEKCQTFEVVAKKDTWFIKEPGLKIGNQIMPTVDPDEAFKYLGAKIGPWKGVHCGVIVPELLSVVKRVRKLSLKPGQKVELLTKYIFPRYIYHLLVSPPSDTVLKLLDSEVRQEVKTILHLVPSTATGFFYTPKACGGIGIPRFEHIIKLGTLKSAIKIANSIDPAVAGLIDDAAIKKLKQTANSLRINWPASLEDIEKARKRLRKEHISQWADLKCQGQGVPDFIKNKTGNLWLEDHSLLKPSRLIDALRLRTNTFGTRSVLARADKNIDVTCRRCRAQPETLGHILGLCQHTKGLRIKRHDEVKSLLEGRLKSKKNNEVFVEPTIKAGGSLFKPDLVIKNGERVLVVDVTVRYENKNYLALAEKEKIEKYRPCLRALKEIFNAKGGEILPVVLGSRGTITPNTEKVLKRLGIANNDIKTILLNVLRSSIELCNIFIDD

SEQ ID NO: 1455 - protein, 1186 aa, synthetic construct
  source 1..1186: note = Description of Artificial Sequence: Synthetic polypeptide
  VARIANT 16: note = Any amino acid
  VARIANT 18: note = Any amino acid
  VARIANT 27: note = Any amino acid
  VARIANT 33: note = Any amino acid
  VARIANT 49: note = Any amino acid
  VARIANT 50: note = Any amino acid
  VARIANT 51: note = Any amino acid
  VARIANT 63: note = Any amino acid
  VARIANT 66: note = Any amino acid
  VARIANT 88: note = Any amino acid
  VARIANT 90: note = Any amino acid
  VARIANT 95: note = Any amino acid
  VARIANT 96: note = Any amino acid
  VARIANT 120: note = Any amino acid
  VARIANT 122: note = Any amino acid
  VARIANT 128: note = Any amino acid
  VARIANT 133: note = Any amino acid
  VARIANT 155: note = Any amino acid
  VARIANT 168: note = Any amino acid
  VARIANT 173: note = Any amino acid
  VARIANT 182: note = Any amino acid
  VARIANT 184: note = Any amino acid
  VARIANT 186: note = Any amino acid
  VARIANT 192: note = Any amino acid
  VARIANT 195: note = Any amino acid
  VARIANT 203: note = Any amino acid
  VARIANT 204: note = Any amino acid
  VARIANT 218: note = Any amino acid
  VARIANT 237: note = Any amino acid
  VARIANT 260: note = Any amino acid
  VARIANT 271: note = Any amino acid
  VARIANT 280: note = Any amino acid
  VARIANT 285: note = Any amino acid
  VARIANT 311: note = Any amino acid
  VARIANT 347: note = Any amino acid
  VARIANT 353: note = Any amino acid
  VARIANT 357: note = Any amino acid
  VARIANT 365: note = Any amino acid
  VARIANT 367: note = Any amino acid
  VARIANT 369: note = Any amino acid
  VARIANT 386: note = Any amino acid
  VARIANT 387: note = Any amino acid
  VARIANT 401: note = Any amino acid
  VARIANT 410: note = Any amino acid
  VARIANT 413: note = Any amino acid
  VARIANT 414: note = Any amino acid
  VARIANT 445: note = Any amino acid
  VARIANT 457: note = Any amino acid
  VARIANT 459: note = Any amino acid
  VARIANT 483: note = Any amino acid
  VARIANT 490: note = Any amino acid
  VARIANT 505: note = Any amino acid
  VARIANT 516: note = Any amino acid
  VARIANT 523: note = Any amino acid
  VARIANT 528: note = Any amino acid
  VARIANT 533: note = Any amino acid
  VARIANT 545: note = Any amino acid
  VARIANT 556: note = Any amino acid
  VARIANT 599: note = Any amino acid
  VARIANT 621: note = Any amino acid
  VARIANT 647: note = Any amino acid
  VARIANT 650: note = Any amino acid
  VARIANT 664: note = Any amino acid
  VARIANT 691: note = Any amino acid
  VARIANT 694: note = Any amino acid
  VARIANT 701: note = Any amino acid
  VARIANT 716: note = Any amino acid
  VARIANT 719: note = Any amino acid
  VARIANT 720: note = Any amino acid
  VARIANT 724: note = Any amino acid
  VARIANT 736: note = Any amino acid
  VARIANT 743: note = Any amino acid
  VARIANT 752: note = Any amino acid
  VARIANT 762: note = Any amino acid
  VARIANT 773: note = Any amino acid
  VARIANT 775: note = Any amino acid
  VARIANT 782: note = Any amino acid
  VARIANT 785: note = Any amino acid
  VARIANT 789: note = Any amino acid
  VARIANT 804: note = Any amino acid
  VARIANT 817: note = Any amino acid
  VARIANT 820: note = Any amino acid
  VARIANT 836: note = Any amino acid
  VARIANT 837: note = Any amino acid
  VARIANT 841: note = Any amino acid
  VARIANT 873: note = Any amino acid
  VARIANT 876: note = Any amino acid
  VARIANT 880: note = Any amino acid
  VARIANT 890: note = Any amino acid
  VARIANT 895: note = Any amino acid
  VARIANT 896: note = Any amino acid
VPPGAEARGRYHHPRXEXARQGEPPSXRVFLVXLPDSNPPCPICGDHVXXXSVLALHCVEGHXWAXVQYQCTHCGILCHIPRCQGRVXEXTGKDXXCPECPASFDEKAGLSQHKRHTVTXSXERVAGXLLRAXLRHGCWSVEEEETLTRLDAMFXGARNINQLIAAEXVSKMXKQISDKWRXLXLXPEQTTXGGXAESASVVXXESMTPEMEAQSPAXPPGKIRKIFTGQDGHAGGXAWENQEDFHWTRWARRWLKRGQXLSDKVQEVLGXWVEGQPRIXAWVDXVSLDVLTLFLGVPPGPQRAPSKKGPXEGGKPTSWMNKRAIKWGTFLRYQHLFGANRKLLAAXILDGAXRNQXTLLLEEVXQXYXGKWEAEPPFEGLGRFGXXRDVDSFAFEALITXEEAVKHMMXMAXXSAPGPDKLTLRDLRRADPEGDALAELFSLWXITGVVPDRLKEXQXVLIPKAVDFEKLRQLGNWRPITIXSIVLQLXSRVLTARLTAACPIXPHQQGFISAPXCAENLKXPELIXRKVKXDRRPLGVAFVDXARAFDSVSHDXISWVLKAKGVDQHIVNLIEDSYQKVTMRVQVFSGSTPPISIKXGVKQGDPMSPLLFNIAMDPLIXKLKTVRQGVKVGSASLTTLAFADGLXLLXDSWEGMQHNITTSXTPGRACNTTSRHPRGLLQPHGPTSATXKMXGVLLESXMRLLYGEQLRGLEDXRPXXHDAXARRADTISGLEXRSLGWDXQTRFGYATXLLAREDGDCXAQTNAEALCWXSXPFPGCAXRPXYANXGWVASEALDSMSRRXVKEWFHLPACTDXLLXSRHRDGGLGLLRLARXXLAAXVRRPIRVATSSDEVTRKVSYACGISDEVERLXLAXGGDXSNVPRFEDPXAPKSXXVQGPHEAAQETPRVVRTQAIPWPSNWRAEEHSKWAQLSCQGERVELFCNDPVSNGWINSRGQLAERLWIMALKLRSNIYPTREFLGRGQAGTNIGCRHCTHPRETLGHILGICPAMQEARILRHNKLCKILAAEGKNCEWTVYYEPHLHNAAGELRKPDLIFVRDGTALVVDITVWYEGGPATLLSTTAEKATKYLDLNTQIQELTGAEQVTYFGFPIGARGKWHADNWRVLSELGLSNSRKERVTRLLSWRALLGSVDMVNIFVSKHRQENLLDEHCTPAEQVVSSYAS

SEQ ID NO: 1456 - protein, 1055 aa, synthetic construct
  source 1..1055: note = Description of Artificial Sequence: Synthetic polypeptide
FERRSNSWGYRPLEPRSVGTESNNNSPRSNITITSATSRPGDQPREAIAVVNLAGEIPCAVCGRLFNTRRGLGVHMSHQHKDELDTQRQREDVKLRWSEEEAWMMARKEVELEASGNLRFPNKKLAEVFTHRSSEAIKCFRKRGEYKAKLEQIRGQSTPTPEALDSITSQPRPSLLERNHQVSSSEAQPINPSEEQSNWEIMRILQGYRPVECSPRWRAQVLQTIVDRAQAVGKETTLQCLSNYLLEVFPLPNEPHTIGRSNLRRPRTRRQLRQQEYAQVQRRWDKNTGRCIKSLLDGTDESVMPNQEIMEPYWKQVMTNPSTCSCDNTRFRMEHSLETVWSAITPRDLRENKLKLSSAPGPDGITPRTARSVPLGIMLRIMNLILWCGKIPFSTRLARTIFIPKTVTANRPQDFRPITVPSVLVRQLNAVLASRLASKVNWDPRQRGFLPTDGCADNATLVDLILREHHKRWKSCYLATVDVSKAFDSVSHQAIIKTLQAYGAPTNFVSFIEEQYKGGGTSLNGAGWSSEVFIPARGVKQGDPLSPLLFNLIIDRLLRSYPREIGAKVGNTMTSAAAFADDLVLFAETPMGLQTLLDTTVGFLASVGLSLNADKCFTVSIKGQAKQKCTVVERRSFCVGERECPSLKRTEEWKYLGIRFTADGRARYSPADDLGPKLLRLTRAPLKPQQKLFALRTVLIPQLYHQLTLGSVMIGVLRKCDRLVRQFVRRWLDLPLDVPVAYFHAPHTCGGLGIPSIRWIAPMLRLKRLSNIKWPHLEQSEVASSFIDDELQRARDRLKAENVQLCSRPEIDSYFANRLYMSVDGCGLREAGHYGPQHGWVSQPTRLLTGKEYLHGVKLRINALPSKSRTTRGRHELERRCRAGCDAPETTNHILQKCYRTHGRRVARHNSVVNAVKRGLERKGCVVHVEPSLQCDSGLNKPDLVGIRQNHIYVIDVQVVTDGHSLDQAHQRKVERYDRADIRSQMRRFFGATGEIEFHSVTLNWRGIWSGQSVKRLIAKDLLIAEDTKLISVRAVNGGVTSFKYFMYCAGYTRS

SEQ ID NO: 1457 - protein, 1222 aa, synthetic construct
  source 1..1222: note = Description of Artificial Sequence: Synthetic polypeptide
  VARIANT 1109: note = Any amino acid
  VARIANT 1124: note = Any amino acid
  VARIANT 1139: note = Any amino acid
  VARIANT 1170: note = Any amino acid
  VARIANT 1191: note = Any amino acid
  VARIANT 1217: note = Any amino acid
PAAPRAWGAVEAGPWPGRTRAVEPAPSPESSPSEAARAAPAGEGHGPGHESPSVQRPEADTTAPGVSAPTREGEPPSTRVFLVRLPDSNPPCPICRDHVGKPSALALHCVESHAWADVQYQCTHCKKVSANKHSILCHIPCCQGRVPEWTGKDWACPECPASFNKKVGLSQHKRHVHPVTRNVERVAGSLSRAGLRPQTRRGCWSVEEEETLTCLDAMFRGARNINQLIAAEMVTKMPKQISDKRRQLGLCPEQTTLGGDAESTSVVEEESMTPEMETQSPINPPGKIRKILAQRARRWLKKGQGLSDKVREVLGAWVEGQPRIHAWVDSVSLDVLTLFLGVPSGPQRAPNKKRPKEGGKPTSWMNKCAVKWGTFLRYQHLFGANRKLLVAIVLDGADRNQCTLLLEEVFQAYREKWGLEEVLRAYRGKWEVESSFEGLGRFGVRRDADNFAFKALITPEEVVKHMMAMASKSAPGPDKLTLRDLRRADPEGDALAELFSLWLITGTVPDGLKECRSVLIPKTVDREKLGQLGNWRPITIGSIVLRLFSRVLTARLAAACPINPRQRGFIAAPGCAENLKVLELLLRKRKRDRQPLGVVFVDLARAFDSVSHDHISWVLKAKGVDEHIVNLIEDSYQKVTTRVQVFNGVTPPISIKTGVKQGDPMSPLLFNIAMDPLIAKLETDGQGVKVGSASLTTLAFADDLVLLSDSWEGMLKNISILEDFCNLTGLRVQPKKCQGFFLNPTCDSFTVNNCEAWKIAGREITMLGPGESTRYLGLNVGPWVGIDKPDLGTQLSSWLERIGTAPLKPMQKLSLLVQYAIPRLNYQADYAGIGRVALEALDSMNRRKVKEWFHLPACTSDGLLHSRHRDGGLGLPRLAKAIPEAQVRRLIRVATSSDEVTRKVSYACGISDEVERLWLARGGDMSSVPRFEDPEAPRSPGVQGPCEAAQEIPSVVRKLAIPRPSNWRSKKHSKWAQLSCQGEGMELFCNDPVSNGWNNSRGQLAEHLQIVALKLRSNIYPTREFLGRSQASTNVGCRHCTHPHETLGHILGICPAVQEARIIRHNKLCKILAAEGKKCEWTVYYELQLLNAAGELCKPDLIFVRDGTXLVVNVTVGYEGGPAXLLSTAAEKATKYLDXNAQIQELTGAEQVTYFGFPIGARGKWHADNXRVLSELGLSNSRKERVARLLXWRALLGSVDMVNIFASKHRQENLSDXALSPS

SEQ ID NO: 1458 - protein, 1247 aa, synthetic construct
  source 1..1247: note = Description of Artificial Sequence: Synthetic polypeptide
MQCTSRLADAPRFARVGVEGEGVGASGNGTDAQLWYGCTGCDEAFSSLRGLRIHAAQKKHGNQDGLLRLPAGRPRKRRVGKSTTAGASDRVTTDPVPAPVPESPGLLPGLPGPSLPGCSDLPPGVLPGGWSASPGPLSWPPSLDAGPLPGPSRVSPGPSRPSPGKPTGPPSLDAGPLPGPSRVSPGPSRPSPGKPPGTPEPLPGSPGGRRGVSPGQPGSRTDPSSSAGAGHFVCPQCSRAFSSKIGMSQHQKHAHLEEYNAGINITRTKARWDPEETYLLARLEATLNPDHKNINQTLHAALPRGSCRTLESIKAHRKQAAYRDLVTSLRSARESSEAQHVPDRPLETPEPQTPANPQRDSKQAVIEALQSLIGRAPPGSFQGARLWDIARQATRGTNILPLLNSYLRDVFTLPTKPTRKKPAVRPARSRRKQKKQEYARTQDLFRKKQSDCARAVLDGPTSSSVPGTGAFLQTWREIMTGPSPALEAPPLPTRGEVDLFFPATAQEIQSAEIAVNSAAGPDGFSARLLKSVPALLLRVMVNLLLLVRRVPAALRDARTTFIPKVPDAVDPSQFRPITVASVLQRLLHRILAKRALEAIPLNFRQRAFQPVDGCAENIWLLSTALNEARTRRRPLHMASVDLTKAFDRVTTDAILRGARRAGLSGEFIGYLKELYTTSRTLLQFQGESLLVEPTTGVRQGDPLSPILFNLVLDEYLSSLDPDISFVSGDLRLDAMAFADDLIVFASTPAGLQDRLDALVEFFDPRGLRVNVKKSFTLSLQPGRDKKVKVVCDQIFTIGGTPLPASKVATPWRYLGMTFTPQGSINKGTSEQLDLLLTRTSKAPLKPQQRLVVLRNYLLPRLYHRLVLGPWSAALLLKMDTTIRGAIRRWMDLPHDTPLGFFHAPVTEGGLGINSLRASIPAMVLQRLDGLHFSTHPGAEVAIQLPFLTGLHRRAEAAAQYQGQRLLSKADVHRMWSARLHGSCDGRPLRESKRVPAAHRWAAEGTRLLSGRDFISITKLKINALPTLERTSRGQHKDIQCRAGCQAVESLGHVLQACHRGHRGRIRRHDNIARYVCGRLTQIGWAVKWEPHYSVAGRTLKPDIVAHRGAETVVLDAQVVGTSMRLGFHHAQKKEKYSLPDLLHQVCEGRRDAARVSTITLNFRGVWAPESAQDLKSLGLTDNDLKLLTVRCLQGGAQCFRLHRRMTTVVKATGDEANALPAHSGLPPTQLGGRTLGPSAHNQSARTT

SEQ ID NO: 1459 - protein, 1099 aa, synthetic construct
  source 1..1099: note = Description of Artificial Sequence: Synthetic polypeptide
MSNTSHSKLNLKMDNKLKTSLETPSGVRADSIITRVRTSSNRGEHSNGVTYPRCEQGVAPLDTHGGICDAPPQVTVPATETDKQKKCEYCEFTYLKPRQIGTHMRKRHPQEWNDIKRTKFLSEKRQKRWLDEDFELLCIGQEEYLVLSSIGKQGKGINQYIQTKYFPTLSTDAIKSQRKSRRFSEYSEKRSRELQPCNTSSDPEELPNEAVTENSPLSFDPLDRDVVKKISSKDHGDQILLVQEHLINGRYQEANTLAKAIFEKLSGKFPNLKTGDHRPGKQQTARKVGKKRVRGSGKKLSPSKQNRRELYAIVQKQWRTKKRSKVINQILTGNLNKEQSYTHTPDQLAQFWSTLFGRVSPRDDRPINHRRSVIPELDKPLSVEEVEAALKGAKDAATGIDGVPISHLKHLGSAALTILYNGLYVTGSIPDPWKRARTILIPKSNPPASPGDYRPISISSYFYRIYTSAISKRLASAVSLDDRQKGFIKEDGIRDNLSLIDTLINETKAGSKSLFMTFMDVKKAFDSVSHYAIARSLEWAGVPDGMRSVIADLYQDCTTDICGRSVKVTRGVKQGDPLSSTLFNLVIEMVMSNVPERLGIQFQGHRLFYLAFADDLVLLTRGPTANQKLVSLVHEQLARVGLELHPGKCKSIAIMADPKRKTTFVDQGSSVLIGGEPVSSLGPQEWYKYLGIKLGSGGMPQGIYRDQLADLLAKTDSAPLKPQQRLYILRSHILPKFNHRLMFERVTCQTLEGLDKLIRTHVRKWLKLPKDTPGPAFYADKGSGGLGLITLRYRVPLLKLRRHKKMADSPDPVIRLIPNAEPTISLLARWTKMCSLYGKQYQHKSELSKIIRDKYWTMCDGKGLRTEVPPDTAKKTLSLLFEDRTPLKPGQLIGAIGVRLNTLGTPARNNRAKGYSPEANICDKCPGNRQATLGHISQTCPATHGRRVKRHDKIVNRIAKALKERGSVKNILTEPHLRHDKLPLRKPDLIVHTEKSVEIIDVQVVADQGISRHEDEDQQKKIVKYDVDGYKRAAYKMLGIDYGSIPCNVSAFTITWRGNLAPHSLKLASRLQFSPVLKYIVADSLVDTWGAFLIWGKTS

SEQ ID NO: 1460 - protein, 1085 aa, synthetic construct
  source 1..1085: note = Description of Artificial Sequence: Synthetic polypeptide
MNERLTDELTTEFILSDMFLWDYPCTDQNKCYPCNLVFLDHRTWSSHMARVHPHANKTYKCRICNRTADSIHKIASHYGRTCKSLIGKTNAITTTIDETLFSCLHCSRGFTTKTGLGVHTRRTHPTEHEAILQQNTPGRKVRWGEEEVEIMAHKEAQQKDEDINMNQLIQNSVMPHRTLEAIKGKRRNIKYKELVRTLKETTYKVENQCLVNLVLPTTSEITTTPSEGDQPAIRAEKEQSPTAAEDLQVIINDLKSQNFSHNQALLLLNSHVEKFLNRSKPIKRKDHVNQQEIDENRHRRQSKQTKYRRYQYLYHTNKKALLDEITSDRSGPSIYPTEESIRGTFVTLFESNSPPDNIPSKLKNDQSCIDIVKAITLDELIKTLAIMKDKSPGQDNITLSDLRTLPIKYLLDILNIILYIQDIPQIWKQHRTRLIPKTKEELEKPSNWRPITISSIVIRLLHKILSYRLGQQLKLNYRQKAFLPVDGCFENSALLHFIIHNARQKHENTQIVSIDLSKAFDSVSHESIIRALNRFNLSKESITYLTNIYKCNLTDIVFGSTIMRNINLKRGVKQGDPLSPLLFNMIMDELLDNLPTYIGVNVGNQKVNSMMFADDLILFAETECGMNKLLDITTKFLDDRHLKININKCNSLRFIKYGKQKTFSVATTSSYFINNEPINPVSYVKGFKYLGIEFDPRGKRSISCNLLAAMLNKLTRAPLKPEKKVYLINNNLIPRIIHQLVLGKVTKGLLMSLDSEIRKTVKLLLRLPHDTPDSFFYTSVSNGGMGIRNLCDSVALSIINRHNKLITSDDLVIRALSQQSYTIATLKQAHIIAGSKFPSKSLNQNKWSNKLYQTTDGRGLVYCQSQTENNSWITGNHRTIKSYNYIDMVKLRINALPTKSRCNRGTLETKQCRFKCRSINNQISEETLAHILQKCDRSHYSRIARHDSLVQFLATAAQKLNWEVIKEPTLPSDTNKAKPDLILVRDSHVLIVDVAVPWESRSLAHAYDFKVKKYATDKKMQAYLKTIYPEKEIRTEALIISARGGWCALNNMVTKKVGLSSAWVKLALIKVMEGSVKIWRSWSKG

SEQ ID NO: 1461 - protein, 1031 aa, synthetic construct
  source 1..1031: note = Description of Artificial Sequence: Synthetic polypeptide
  VARIANT 78: note = Any amino acid
  VARIANT 87: note = Any amino acid
  VARIANT 200: note = Any amino acid
MKKVLNNETEKLPGSNLTFMCGFCDREFDTARGRGVHESRGHLVERDAAVQSRVKAVVSKKYYYSNEEDVALAKMQLXHADLAKSEXLEAMYLALGKGRTREAIEQHIRKSLRYKGVLEEQRKLLETARGNVRQNNVGVPASNATKNLQRFLESLPLGTNRREERLDRIIRSNSIESQRLELIHYCNDMCQDFVQLDCQXNPINAIRRRNPKRLSKKQLKRAKFSALQRLWIRDRKAAAQLVLKDKLDSLLSNKEDSKDLGSYWQQVFERESELDRRPIPQVVENEELNSPVLEKEVEWAVKNIKKSTAAGPDGLTALALKKIPYSELVKLFNIILLVGFLPDVLKNSRTILIPEVDNPQGGGDYRPISINSVLTRTLNKILAKRVSEGDFGINGQKGFKSVDGCLENLATVESILADARMKKNKLAVVFLDMSKAFDSVNHESIVRAGEIKGYPKLLMTYVKECYNDATTNVAGVTAKFNRGVKQGDPLSPALFNNVIDLAIERVSGTGIGYNMGGKKYSVVAYADDLVLFGESREGLQIALTALLEELKLNGLTPNPAKSASLTFERSGPHWFASTDTVTALGDQIPAMGNIETYKYLGIKFNSCGVVKGSLPGIYTKKLELISKAPLKPQQRLAMLTDFLIPGVLHQAVFGQTNAGDLRSLDKRTRRAVRSWCHLPSDTSTAFIHAKAKDGGMGIPSIRAEVQFGKLDRFGKLPNVKDERSKVLADNAHIKKKMLEKLGVGIPIKGVRCKNKLEFYNKMREELIKSNDGIGLKEASLVPSANTWLKLSDLHMSGRTFVGCLKTRGNLMATVTRTSRGGQNPGIELNCKKGCQYQGSLNHIVQKCPVVKGLRIKRHDEVVKYVEEITKKAGWSATMEPIIPFEGSHRKPDLVLVRGDLGKVVDIQIVSDHCGLDEKNSCKIGKYDNDIIRNYVRGLGPSRVEVAAITLNWRGVWSRDSFNLIKRLGMTEMDAKIISMRVLASTAKMFKTCKKVLEPVCRTKTADCDGYGPEETSARPCHELNLKESSGT

SEQ ID NO: 1462 - protein, 1395 aa, synthetic construct
  source 1..1395: note = Description of Artificial Sequence: Synthetic polypeptide
MENSFAWEGTSSAEGRTTVEDSPSSSDDFVSNVGFKVAKADPTVWEEANMSEDNTIIEDPPSSSDDFANNVGFKVTRADPTAWEEASTSTETEDLPSSSNFIDNVETQIDMAGPTAWEDADSNEDNIDEGTPNNINNNLAIVRGRADAYACSCCERNFISLKAIGTHLKETHNKKVVFECAKCQHTFVKAHGLACHVPKCKEDADTPMLNRLLHGCGECGLAFNTRRGLSQHERHRHPSACLSTRRRSRLDGIARKKSLRNRRDIWTNDEIRLLKQLMIQYEHAKKINIKIAEHFNHKNAKQVMHKRRSLREKDMALGAPHDAPPPLAEEPIIEVVEGAREELEQAPVDVILPDLEALTVNDGRGGGSPVLTEGGESTRDMEENGGTDTRSPSPREERAGSTPWERGWQPRVDRGRGEYKGYGGERGDRHTVSLSQRGESGVDPLTPGGVVEDYDDSYLEDYFPGWDEDEHMHIIGRLDLSDESEQGEAAVSPRLGSFGDLLEEVNAMEGKDNLSEALAETLGLVLHEGHRVEYIKEKMNINVKQMATEILAHGANKGNPKRRKEAVAAKRNPGTRLDRAQRDNQAKAKAKEKKRIFSETQTQYKKNPHRLVEKLLDGKGDERCSVSLEVIQRTYMNRFSRESKEVDIGAYVDPETVEDNQGIVDPISKAEIERAISTTKKGSAPGPDGVTYDALKAYGNCQLYLLIMYNTWLAMGKVPSEAKTYRSILIPKGQGDPMDINNFRPLTLANVISRLYSKILTRRLDGAVSVCPRQRGFTHKASIEDNTLILRELIMKSKRNKECLAVVLLDLAKAFDTVSHDLIIKALRRHRVHEHLISVIMDLYEGGTTSFTTDEGTTCPIAIRSEVKQGDSLSPVLFNLALDPLLATLEQRGKGVEIGGHTFVSLAYADDTALVSSSHLDMTANLDITVEYLNATGLSLNVRKCQGFLLTPINKSFLVNEAESWVVEREAIPWVEPGDTAKYLGVQVGPWSRPWPSIQPVIKRLTAYCESIDKAALKPRQRIHILTTYIAPRIAFEIAEGGYSTLVDCRGGIQYTRIREVDMTIRNYVRKWLFLPACLSNSFLYTRRGEGGLGLVSFYDYVPTERMRKLVRVCDSEDPVIAGAAASLGLRERAAKISAQTGLPVPVKPKGAHNAWRKVQKKKWKAQPTQGKGVSCYQHRLGNKWLGAPSFLTENDYIWAIKLRTNLVPTREAMGRGIIGRNQVECRHCHTTIETMGHISGYCQMVLDIRLIRHNRICKALIKAATATGLRVTEEPRIVGTDGKNYLPDLIFSAGAGEPCYVVDPTVVWDDDPKNLREAWRGKVRKYTPIIPAVEAMLHPSSVQIFGFVCGARGTWCPMNDDIAKIVGLKNSGISRTLQIVLCDTIRMVKAFMAR

SEQ ID NO: 1463 - protein, 1236 aa, synthetic construct
  source 1..1236: note = Description of Artificial Sequence: Synthetic polypeptide
MSGKRIVEMSGCDEKICQNKHCLKRRWAWISGPKGETSPPRKRGTCENVSFQDKSHASDPDPLKAPEAREDAGSVAPQWVGEIKTPSLTSRDGVSEVVLPPQPVHAEGVSPASDSKDKATKITLLISLPVCDLRCGRCERPLETVGKAVRHFAVAHPTVSVVFKCQKCEKSSKNSHSISCHIPKCKGMTETRTDVEGDHGCDHCQEKFTTAMGLTQHKRHRHIVQYCKEKEGEMTARRKGEVEAVKWSEWEESEVARLSDGLAGLKMINRRIADSLGTGKTAEQVRQKRRRMRPEKVRCDKPKEAKDKSNLIKMLSIPSATPTPQTGLKGFLLGELNGVATKGEVQIGGVTLSLRGVEQDSALLNTSALELQRLLGGRAGSANPLSLQRERETTLPSERRKTKQGEYRRVQKMFRSNEKKIAKYILDGNGDGEAASPPLEIALAFKSRWEEVETFHGLGQFYSRGEADGVVFRSLISMSEVCENLGAIKNNTAAGPDGITKPALLEWDPTGAKLAAIFSIWLTSGTLPGPFKKCRTTLIPKTDDPILLTQVAGWRPLTIGSVVLRLYSRILTHRLERACPINPRQRGFISSPGCSENLMILGGLIKRSWAKGERLAVVLVDFARAFDSVSHSHILEILRQRGLDEHIIGIVGDSYTDVTTTITVSGEQSPPIDMRVGVKQGDPMSPLLFNLALDPMIDTLERYGLGYRMGEQQITALAFADDLVLVSDSWEGMACNIRILEEFCRLTGLRIQPRKCHGFLIQKIQRARSVNLCKPWIVCGEELHMVGPEESVSYLGMKVSPWHGIMEPDPVERLCNWISSIGRSPLKPSQKVRMLNVYAAPRMTYQADHGGLGPIVLNVLDGMIRKAVKVWLHLPLCTCDGLLYSRCQDGGLGIVKLACQIPSIQARRVYRLWHSKEAITRVVTRRTVEAEEYRGMWLRAGGSEAGLPPLEDREEGAVQCTDTAGSVKPKNPVIPDWRRAEFLKWQNLTAQGVGVQVFGGDKNSNHWMANPETLGSKERHYIAGLQLRANVYPTREALSRGRPDLPKVCRQCLAGTESCAHILGQCPAVKDSRIRRHHKLCDLLASEAESAGWTVIREMCCRTRAGALRRPDLVFVKTGFALVVDVTVRYEMAYDTLMGAAAEKVARYTPITPYVAMTLKARRVKVFGFPLGARGKWPGSNDRLLKAMGVGGGRRKQLAKLFSRRALLYSLDVLRDFYRAEGETGDLDDESVDDHL

SEQ ID NO: 1464 - protein, 1298 aa, synthetic construct
  source 1..1298: note = Description of Artificial Sequence: Synthetic polypeptide
  VARIANT 129: note = Any amino acid
  VARIANT 184: note = Any amino acid
  VARIANT 218: note = Any amino acid
  VARIANT 259: note = Any amino acid
  VARIANT 369: note = Any amino acid
  VARIANT 370: note = Any amino acid
  VARIANT 402: note = Any amino acid
  VARIANT 721: note = Any amino acid
MSRRPGKSNEPPVRSRAMGLTTLSGTKTSNSGAQGPSTSAPMQNMAGGFVCDCGRSYALKTSLARHKKECGKNNAECRWCGTRFNTLAGTRQHERKAHFVQYQSDLAKALPQPESELMEKIAIVEARSXNGIFYKEMMASTGLTHQQVRSRREKPEYKGFLERARRSLAQTNIRAGSISPASTXAGSLESASPKAGCSSSASPGPTTRSRAPTKGVPXRSSNSARIVVEAQVHTRAPPNTGETEVALRESRRTVPRLGXNPSRPCGISPLMAIAIDEDSVLGGLRVQAGPSPTAVHSVEAFPGTSSMTPMETDRVHNKSGIDPILEHNGTRQVRREESSTREDPVEQWSPNYPKTPVTMPNITTTADAXXTSYNRTPQTLPGNRRRRSRSLPPVQRKSASDXLESVDSLGPWAVFLQDQVDAGSLSGNDSLADLVRVALTKSDRGVLNDAVNRYLAQRAESLRIRKRGSKGKRKSKTGRHYGQTTSGSGQRAALFKKHQDLFLKNRRGLAETILSGKEDFGPRPEPPVTSVEEFYGGIFESPSPPDNEPFEVRATGVEDPPPLTSPWTKRTLRSPCYWRRRPPPTYITMDEIKAARAGWQISAPGSDQIPVAAVKTMSELELAILFNIILFRNVQPSAWGVLRTTLVPKDGDLRNPANWRPITISSALQRLLHRVLAARLSKLVSLSSSQRGFTEIDGTLANALILHEYLQYRRQTGRTYXVVSLDVRKAFDTVSHCSVSRALGRFGIPSVIREYILATFGAQTTIKCGSVTTRPIRMLRGVRQGDPLSPVLFNLVMDELLEKVNEKYEGGSLQSGERCAIMAFADDLILIADRDQDVPAMFDDVSTFLERRGMSVNPAKCRALIAGAVSGRSVVRTGSSYKIHNTPIPNVDALDAFKYLGLEFGHKGVERPTIHNLSVWLNNLRRAPLKPDQKCLFIRQYVIPRLLYGMQNPQVTSRVLREADRLIRRHLKTYYHLNVHTPDSLIHASVSDGGLGIMELRKAIPRIFLGRLVKLLNKNKDSVLSSVLQSNRVRTLMGKLSTMAGEVPESTFWRNQIASGPLSKGLEQAAEDSASRLWISEKPSGWSGRDHVRAVQLRTGNLPTKAIPSVPVGQRRCRHGCACDESISHVLQMCPLTHADRIRRHDEVVKKVARHCTSRGWTVEVEPHIRSRCGRLFKPDLAVHQPGGAIVIADVQVSWDSESLTVPYERKRAKYDVPQFHQAAQHAWPGKALTFAPVIVGARGIWPRINNDRSAALQIPPVVRRACVNSVVKWGSSIHATFMRSVWANRLNPRPLRA

SEQ ID NO: 1465 - protein, 1243 aa, synthetic construct
  source 1..1243: note = Description of Artificial Sequence: Synthetic polypeptide
  VARIANT 40: note = Any amino acid
  VARIANT 71: note = Any amino acid
  VARIANT 84: note = Any amino acid
  VARIANT 347: note = Any amino acid
  VARIANT 495: note = Any amino acid
  VARIANT 503: note = Any amino acid
  VARIANT 572: note = Any amino acid
  VARIANT 724: note = Any amino acid
MGSWIVNFVSVATQTGEFPVDTARRAPVPVTSYPESECHXPLPLTFCNSDVTIWGGVRPEPVDCLGDLPEXYDALPGVAGPREXVGGSPPGEGVRSPGIASPSGTAVQHDFGSPILVPGAEAAEVSTPVVKVPQDHPACPCCGTRVVKVTALSEHLRRAHGRKRVLFQCSRCGRMNEKHHSIACHFPKCRGPPVEEGPLGAPEWCCEECGQKFNTKSGLSQHKRSVHPLTRNVERIEAARPKGKGKRGAHKGCWTEAEVAQLIELEGRFKNQRFINKLIAEHLPSKSAKQISDKRRQLAAATKTSSPEKRVTSSTSGESSPEVEKVEGIKREYRRRVGEWLCAGSLXDQTSFQKILEDVESGSEIVTGPLEELASFARGKLAAARVRHHRKHPAEAVPAREEQRWMKRRVGRRGLYLRFQRLFALDRRKLAGIILDDVESIKCPLPMEEVADVFRRRWEEVAPFTGSGSFRSLGKADNGAFKPMISAKEVMKNVXEMSRRSAXGPDGLSLRDLMKIDPQGSRMAELFNLWLLAGRVPDQVKAGRTVLIPKSADPGKIGNIDNWRPITIGSVXLRMFSRILSARLRRACPINRRQRGFIAAPGCSENLKLLQALIKSAKRDHRTLGVVFVDLAKAFDSVNHQHIFQVLVQKGVDGHIIDILRDLYTNAGTYLESGSQRSGFIKILRGVKQGDPLSPILFNLALDPLLCRLEDRGLGYKYGDQQIXSLAFADDLALLSDSWEGMQQSIRVVEEFCQRTGLRVQAPKCHGFLIRPTKESYTINDCDPWTIADMQLDMIDPGSSEKYLGLGIDPWIGLSRPELSEVLTRWVKNIGGAPLKPLQKVDILRSYALPRLLFIADHAGLSATCLHSLDLSIRSAVKGWLHLPPSTCDAIIYVSYKDGGLGLPRLASLIPNVQARRLVRIAQSEDDVIRSVVLQEGIQEEIRKVWISAGGRPEKVPSVTGEFPVMEAQAADEALSEWERRAPRTIYPIPCKWRKREMENWTNLKSQGHGIRNFENDRISNDWLLHYGRIPHRKLITAIQLRANVYPTREFLARGLGEGAPRGCRHCPAEWESCSHIIGYCPAVQEARIKRHNDICGVLAEEARKLGWVIFIEPHLRDNTNELFKPDLVLVKGSCAKVVDVTIRYESGLTTLSDAAAEKARKYQHLAGEVRALTSATTVDFLGFPIGARGKWYVGNNGLLSDLGFSTSRVVRIARALSKKALLSSVDIIHIFASRARQAQTSE

SEQ ID NO: 1466 - protein, 1085 aa, synthetic construct
  source 1..1085: note = Description of Artificial Sequence: Synthetic polypeptide
MSNRLANTAAAGGVPEKTSGTLDIPGQPSSSGEKRAISYPGPFGCNSCSFTSTTWLSLELHFKSVHNIRDFVFLCSKCKKSWPSINSVASHYPRCKGSVKAAVVPTSLANTCTTCGSSFGTFSGLQLHRKRAHPDVFAASCSKKTKARWSNDEFTLLARLEAGLDPACKNINQVLAERLMEYNITRGVEMIKGQRRKDQYKALVRQLRSNSETQQCVGLAGSMDSNVPANDTSSSVASEVSITYPEYGAVMSCDLIKEATGMAIVDINELQSNLRKAFLSGRKLPMKFHGARETAQKKMANPRVAKFKRFQRLFRSNRRKLASHIFDKASLEQFGGSIDEASDHLEKFLSRPRLESDSYSVISGDKSIGVAHPILAEEVELELKASRPTAVGPDGIALEDIKKLNTYDIASLFNLWLKAGDLPASVKASRTIFLPKSDGTTDISNCRPITIASAMYRLFSRIITRRLAARLELNVRQKAFRPEMNGVFENSAILYALIKDAKVRSREICVTTLDLAKAFDTVPHSRILRALRKNNVDPESVDLISKMLTGTTYAEIKGLQGKLIPIRNGVRQGDPLSPLLFSLFIDEIIGRLQACGPAYDFHGEKICILAFADDLTLVADSAAGMKILLKAACDFLEESGMSLNAEKCRTLCITRSPRSRKTFVNPAAKFIISDWKTGISSEIPSLCATDTFRFLGHTFDGEGKIHIDTEEIRSMLKSVKSAPLKPEQKVALIRSHLLPRLQFLFSTAEADSRKAWLIDSIIRGCVKEILHSVKAGMCTDIFYIPSRDGGMGFTSLGEFSLFSRQKALAKMAGSSDPLSKRVAEFFIERWNIARDPKVIEAARRVYQKKRYQRFFQTYQSGGWNEFSGNTIGNAWLTNGRARGRNFIMAVKFRSNTAATRAENLRGRPGTKECRFCKSATETLAHICQRCPANHGLVIQRHDAVVTFLGEVARKEGYQVMIEPKVSTPVGALKPDLLLIKADTAFIVDVGIAWEGGRPLKLVNKMKCDKYKTAIPAILETFHVGHAETYGVILGSRGCWLKSNDKALASIGLNITRKMKEHLSWLTFEIIFITQISRIYNSFMKK

SEQ ID NO: 1467 - protein, 1086 aa, synthetic construct
  source 1..1086: note = Description of Artificial Sequence: Synthetic polypeptide
MCILGGLTSHSREGGLSRGSSQLKTVKPQNEEDNGTTQLKAGSADSFPRPSGDLNPEEPLSIDICPVCFRQMKSYLGVRVHMQKMHLEEYNASIPDPVVSHTRWSDEEAAQLAFTEAKIEVDKLLPRGKGINKFLLELLPGRTLESIKSHRKRQSHKDLVRKYVKEFVDTLAADNDDDTIICQDNGDIFNDPIVGATDSQSETETVADPAEFKTFIELADDPTKPKVVAKLRNLIKDKPKSEILGSDILVRILRRTLHGLPVEDELDQYLEVYFTGKIKQRRSKTQTALSKKQIKQRDYGRLQELYSRSRKRCANEILNPTSMSGGFGHQELSEFWTKTFGPDEQPTLGEVEIIPKENCWWDIFSPISSDEIKASYPSIGKAAGPDNFSAYQLRKVPVWHLECLYNIFAFYKDIPSRLKDAKTILIPKKDNAESPGDFRPITLSSIITRHFHKILATRVNNFVRFHPMQRGFIQSDGCLENTALIQTVIREAKVRRKQVHITFCDVRKAFDSVRYDSIIAAIAKKGAPGSFIMYLSNLYRGNKTTLLTAGGETRITPTRGVRQGDPLSPILFNCVMDQILTALPSRTGFTLSAGDESVNVNCLAFADDIILISKTKNGHQELLDVTQRILKENGLDLNPDKCCSLSLIPHSKTKKIKVVRADFVVNGVKVRSMSIGDSTCYLGVSINVTGQVAPVKMYQALCEKLDSAAIKPHQRLYILKHFVITKMFHPLILSTIAAHKIKNLDLISRRYVRKWLHLPHDCGSGMIHAKVSDGGLGVPLLFRTIADLKVRRKEKLQVHENPIFRILAKLSTVSKELENCKKIASKTTDIQEKTFKEMLATYDGLSLKEARAVPEVHKWVDSYDKRYKFAGRDFVQVIQARFNALPTRSRVWRGRGADEKSLRCRAGCNARETLNHVSQSCFRTHRVRTARHDKILDFICERLDVVGVKYVREKPISFPGKKLIPDLIVENTDQALVLDLQIVGDNSELPLDERGKNKVIKYNCSEMQELYKRKKKTLAVKALTLHYKGLMAPETSNILRSFGFKSKDLEKMAYMALFGTVAAWGIFNRSTETMRSVANWPRPEEL

SEQ ID NO: 1468 - protein, 1054 aa, synthetic construct
  source 1..1054: note = Description of Artificial Sequence: Synthetic polypeptide
FERRSNSWGYQNLEPSNVGQDMNTVPRINNTTTTPATSRPGDQPREAIAVVNLAGEIPCAVCGRLFNTRRGFGVHMSHQHKDELDTQRQREDVKLRWSEEEAWMMARKEVELEASGNLRFPNKKLAEVFTHRSSEAIKCFRKRGEYKAKLEQIRGQSTPTPEALDSITSQPRPSLLERNHQVSSSEAQPINPSEEQSNWEIMRILQGYRPVECSPRWRAQVLQTIVDRAQAVGKETTLQCLSNYLLEVFPLPNEPHTIGRSNLRRPRTRRQLRQQEYAQVQRRWDKNTGRCIKSLLDGTDESVMPNQEIMEPYWKQVMTNPSTCSCENTRFRMEHSLETVWSAITPRDLRENKLKLSSAPGPDGITPRTARSVPLGIMLRIMNLILWCGKIPFSTRLARTIFIPKTVTANRPQDFRPITVPSVLVRQLNAVLASRLASKVNWDPRQRGFLPTDGCADNATLVDLILREHHKRWKSCYLATVDVSKAFDLVSHQAIIKTLQAYGAPTNFVSFIEEQYKGGGTSLNGAGWSSEVFIPARGVKQGDPLSPLLFNLIIDRLLRSYPREIGAKVGNTMTSAAAFADDLVLFAETPMGQTLLDTTLGFLASVGLSLNADKCFTVSIKGQAKQKCTVVERRSFCVGERECPSLKRTEEWKYLGIRFTADGRAQYSPADDLGPKLLRLTRAPLKPQQKLFAHRTVLIPQLYHQLTLGSVMIGVLGKCDRLVRQFVRRWLDLPLDVPVAYFHAPHTCGGLGIPSIRWIAPMLRLKRLSNIKWPHLEQSEVASSFIDDELQRARDRLKAENVQRCSRPEIDSYFANRLYMSVDGCGLREAGHYGPQHGWVSQPTRLLTGKEYLHGVKLRINALPSKSRTTRGRHELERRCRAGCDAPETTNHILQKCYRTHGRRVARHNSVVNAVKRGLERKGCVAHVEPSLQCDSGLNKPDLVGIRQNHIYVIDVQVVTDGHSLDQAHQRKVERYDRADIRSQMRRFFGVTGEIEFHSVTLNWRGIWSGQSVKRLIAKDLLIAEDTKLISVRAVNGGVTSFKYFMYCAGYTRS

SEQ ID NO: 1469 - protein, 1253 aa, synthetic construct
  source 1..1253: note = Description of Artificial Sequence: Synthetic polypeptide
RPQTKLMTDKLKFSSQLARGLAKQRAMDGARVGDPPITVRPTETDLCNTEGSWGRRPMKLLFVSVSTQTQNEDALWASDVAKPMASRSALKMTSIPSMTFHNSSLEKEEEMNYDFYEQIKSLVESDDSSDDFTEDDEDVEESFLDISAEEPVLGKFPIDTKGTITVVLPSLEYICVICKQHMGKASELVAHFNIKHRDIPLVFKCAKCDKTNSNHRSIACHAPKCGGIKLTEESLPMVCECCQARFATLSGLSQHKRHAHPVTRNEERIKDGIKGTSQRGVHRSCWSLKEVEQLALLELQFQGKKNINKIIAEALGTKTNKQVSDKRRDLSKKTGAPMSDSLHFSSRPLETLSPPPNVTTGTSSILAQAAERLTNENSGTLEKPAMEAIKAWLNGEGQHDALVETATALMLCPMRLVKNKGKRSKPENDIIKPRILPTRSWMKKRAEKRGSFMKHQKLFFKNRSLLASLVLDGTERHECRIPNADVYRFYCEKWEKVLPFNGLGQFKSSGVANNEYFEPLISVEEVQTAIRAIKPTSAAGPDGLTRAAICAADPEGRTLTALFNAWMITGIIPKELKKNRTILIPKVMDDEKLKELGNWRPITIGSMILRLFSRIMTARLARACPLNPRQRGFIAASGCSENLKVLQDLMRHAKKLHRPLAVMFIDIAKAFDSVSHAHILWVLRHKKVDEHVVGIIQNAYDRCTTSFKSNGESTREISIRVGVKQGDPMSPLLFNLAMDPLICTLESHGVGYSIDTDHVTALAFADDLVLVSESWVGMAANLAILESFCGLSGLEVQARKCQGFMISPTKDSYTVNNCDPWTIKNKDVHMIQPDESTKYLGLKICPWTGIIRSDLHVQLKTRISKIDEAPLKPTQKVELLNAYALPRLLYPADHSDCKQSTLRVLDQEIIKAVKGWLHLPASTCDGLLYARARDGGLAILKLENAIPSVQVRRLQRIANSSDAIARNIASSQGVEEEYRSLWVRAGGDSEAIPTFFLRGSESKEPVYPRPCDWRKRESRRRCEKPVQGRGIVNFAQDRISNAWLGPRCGFKQCFFIAALQLRANIYPTRESINRGRDGASRSCRKCSARLESLSHILGQCPAVQKFKDCATQTEAEMVPHGPAGNALPGWSLSRTFLVNVPQYKNSRIARRNKISDILADEAARLGWWVYKEPRFTSEAGELRKPALVFAKGEEALVIDVTVRFELSRKTSSEAASHQVAYYTPPCDQVKVLTKASNVTFFGFQVGARGKVAP

SEQ ID NO: 1470 - protein, 1127 aa, synthetic construct
  source 1..1127: note = Description of Artificial Sequence: Synthetic polypeptide
RKELVTIKNLFEESGATAPAPVPLEVAVEVHQSSSVPEITDESTTTQEGSYSEPPIHRCENCGREFRTRAGVQQHRRKAHTNEFMEEKEKAAPTKKLRWTDEEKEILIESEIKIIKEGSLKEQHEINKILASRMPGRSQDGIAKIRQKQEHKAEIQRRLHGTVTTNETRGNRTSEITEPIRSLPINTKTWSEDEMKRMLAEEVKLRTKNEKDINKKLAEIFPNRTMGSIKSKRTKDKDYQDLVKLTMQTISENPDNETDFNTSNTENNSTDAEKEVKNYLNMLLLTINEEEWLTSTLKEAATLALQGKKTEASEKLNEYASKTLFPGLKITNQTRKREKKISKRETRRQEYAEIQKLYKKNISSAAEKAINGKWSIKPEEEYHNNKDLIKAWKPILEAPPFSDCRPIENIKEMDYALMEISTAEIFLAIRAMGKTAPGPDGIKYSKLKKNIQSMAILFNTCLLTSFLPLPLKIARTILIPKQENPGILDYRPLTIASVVTRVFHSILAKKLDNNAQLSQRQKGFRKCDGVAENIVILETILTNSRSEKRPLCMAFVDLRKAFDSVGHESIIRGAKRVGVPPMLLEYISSSYQNASTNLFGEILNSRRGVRQGDPLSPILFNFVIDEALENLNRNIGYLLKEEKVSCLAFADDIVLIAETKGGLENHIEKLLEKLNGAGLELNASKCATLMVMKNGKEKSTYISTKAIKIKENDIPTMKATETYKYLGLQMGFKAREQNANEVITEGLENITRAPLKPQQRIHILRDFLIPRLIHKLVLGRVAKKSLKRIDQNIRKKVRNWLHLPKDTTAAFIHADAGDGGLGVPALEHTIPLLKRERITNLRKSNDPVTKECLRMEYTKQVLGKWSRPTKIGETLATNKSQLKEAFRKQMLITLDGKGLKDHHETPTIHKWIRRGENMTGKQFITAVKIRGNLVATKSRNSRGRPEQEKLCEAQCGRPDSLGHILQGCWRTHGMRVERHNNICRRIKAIMKGKESEVVEEPRLQTNEGLRKPDLLICHKGKIIICDAQVVADSSNCSLESENQRKIDYYKKDSVVSEARKLIGRVDEDIIIMAVTFNWRGAISKTSIRDLDMLLDIKSKEVIKMSRKIIRDNSIMVEMHRNRTEKRR

SEQ ID NO: 1471 - protein, 1089 aa, synthetic construct
  source 1..1089: note = Description of Artificial Sequence: Synthetic polypeptide
  VARIANT 546: note = Any amino acid
  VARIANT 551: note = Any amino acid
MKSRSFRRIGDCAAGSSRRGVRLTGKAGREGRFAASPHLSPRYLAGSVSGNVPSVPPGPGLGAGAPAFAAGRNADGGPAQNPCPYCARSFTTANGRGLHIRRAHPDEANNAIDIERIHARWSHEETAMMARLEAGAIQRGGVRFMNQFLVPRMPGRTLEAVKSKRRDATYKALVQRFLQAPQINLPELRDGDAPRQPDPQQENPPEPPSFDGAIRGAVADLVGGVDWQRLGFQGDRLCNIARRACDGGDVSGQLLGWLRDVFPVKRVSTRGDQSDLDVDGALVSRRTARTREYARVQELYRKEPKACLARILGDRREGANRAPNRDPAFIDFWRGVFSEASAEVEGWAEEVSDHGELARRVWDPISVEEVGRSRVRNGAAPGPDGIAVSVWNKLPPEAAALLFNVLLLGRCLPAELTRTRTVFIPKTDAPRTPADYRPISIASVVARHFHRVLSARVQRIPDLFTKYQRGFLSGVDGIADNLSVLDTMLTMSRRCCKHLHLAALDVSKAFDTVSHFAIVRACRSIFGSAETVLEEGGRRHFVQVRXGVRQXDPLSPLLFNLVLDRALKRLSTDVGFRLTDATKVTALAFADDVVLCATTARGLQTNLDVLEAELRLAGLLLNPNKCQALSLVASGRDHKVKLVTKPTFKVGQNTIHQVDASSIWKYLGIQFRGSGMCGCGSEGVAAGLKRITCAPLKPQQRMHLLRVFFLPKFYHAWTFGRLNAGVLRRLDVVVRTSVRTWLRLPHDIPVGYFHAPTKSGGLGIPQLSRFIPFLRLKRFDRLGRSAVDYVRECAFTDIADRKIRWCRERLSGIVDQVAGGRDALDAYWTAQLHQSVDGRALRESASVASSTQWLRCSTRAIPASDWLHYTAVHIGALPSRVRTSRGRRGGQDVSCRGGCLLDETPAHCIQVCHRTHGGRVLRHDAIAKRISADLMELGWIVTREVSFRTTAGVFRPDMVAVKEGVTVILDVQIVSPAPTLDEAHRRKVAKYRDRADLARYLAEAAVARGRAPPANIRFASATISWRGVWSAESVGSLRELGLSARHFDRYTTMALCGSWRNWVRFNASTASRMGRGRGDASPRRHENQQ

SEQ ID NO: 1472 - protein, 1123 aa, synthetic construct
  source 1..1123: note = Description of Artificial Sequence: Synthetic polypeptide
SGPATSTFGETKSRLCEPTSALGCRPGAVVIQWAQIHKEKRKRIVGWPLGHLGSPTSLKLRHPRLQAKRIVPVLAELMQCLCARHVSGRSPQKSAWAFTLEERTSACGVDAMFVCSTCQRSFATKIGLGVHVRRAHVEVANAAISVERVKDRWSEEERRIMAAVEVRGVLSGARFINEYIMSHLQTSRTLESVKGTRKNPKYKELVATLLEEARTSVREESPRSAVNDSATQPSGPSDTRSLRTEHLFTESTEPFEHRIRELIGDLEGVTDFRAELLVSIAEQQLQGDEVAESLTRWLGEVFKPENQQQQVQRKRRRQRKAPVSGQLPKWRERRRDYAAMQTLFHRNPSLAAGRVLDGKNESRPPDLPEMTAFWEPILTEQSAEHRAVGPASEKSELCSVWGPVEKEELLSSVPPLDTAVGPDGVTARQWRAVLPAVRALLYNIILKRGSFPASMLESRTVFLPKKQHSVNPADFRPISIASVVVRQLHKILAMRLRRTNLVDERQRCMDDGCAENITVLASLLDDARHGLKELHLVSLDCAKAFDSVSHHAIDATLKECGLPAGFVQYISRTYSDSSTRLEVGRNRSEPIKTNRGVRQGDPLSTLIFCLCFDRVARTLSPHIGYDLNNTRISTLLYADDAFLVSTTAPGMNILLRSVEESAGEVGLSFNTSKCSALSLIPSGKEKKMKVGTTPTFKTSQGFITQITPSQEWRYLGVDFQYSGPKKASRSLKIELERISKAPLKPQQRLLILRVYLLPRYYHHLVLSRTTLGHLRGLDLQVRAAVRRWLSLPRDIPIAYFHTTAKEGGLGLPAFETSIPCLMLARLRSMETSTCKAARAAVQGFWVQKRIHWATAALTKNGEALTCKADVDRWWASRLHKSVDGRELRECSGVGSSSTWVNSALNITGRDYVQYHHVRINSLPTRIRTSRGVRREGMEVTCRAGCQVTETAAHVIQSCHRTHGGRILRHNAVCKVLASGLRDKGWEVREEPKLRTRQGLRKPDIVAIKDGVARVIDAQVVSGSGPLDEAHETKRKYYSDNGDVTAAIARECNIAPSNVAYSSCTISWRGVWSPRSAADLLQVGLSKKLLGFITLRVLRGSHLNWTRWNKMTTMRVHHQRTGIG

SEQ ID NO: 1473 - protein, 1133 aa, synthetic construct
  source 1..1133: note = Description of Artificial Sequence: Synthetic polypeptide
MSSNEEGASDTGAPGPGVPVADVSAADGRATYDDHGMSTDYEKQTIELPLNGQIQCLWCHIEGRNQRFLQESQYLKHKDTQHPKGEIIWRCAACQKEFEKLHGCRCHLPKCKGRKEAKGVAKFKCDSCEESFLTQRGLSMHELHRHPAIRNLKRTQGTSRGNTRPINRASVWSKEETDLLIKLNERYKHLKQPNVALKEYFPDKTLKQISDKRRLLPVQEPEDVATTDETGPPPSDSSEESIYESATEDEGGGDMQQTAPNDSWKEPFIQSIRTNHLEEEDSLRKVEEAIERMAMNEGVTEQEVGTLLEQFVDSLTQSPTTERKGSRRKSQKTTKRKTTHNNRKKFLYAKHQELYKKSPRRLLELALSGESSSGREVVNLPEADSVGPLYKSLWGQIGPEKTHRNQPMCNNIDMSEIWTPIALESLVEKFKKIKSDTAAGADQIKKFHLRKKGALHVFAKLCNLLMLHRIYPAQWKTNRTTLIPKPGKSAEEVENWRPITIGSLLGRIYSAMIDRKLRSKIKQHIRQKGFTQEDGCKNNIAILSSALTKMKEDSGGIITIIDISKAFDTVPHGEISQSLMNKGVPSPICEYIQKMYIGCKTIIYCRDKKTLPVDILRGVKQGDPLSPLLFNLIIDPIIGTLDETTEGIKLENENISVLAFADDLVLLAKDKETADKQNRLINEYLDDLKMKVSAEKCTTFEIKRQNKTWFLGDPQLTLGQQRIPYADPEAAIKYLGTNFNPWRGLCKTSIKEIIDAARTVKQLKLKPHQKINLIRTYLLPRYIHKLVANPPPLGTLDLIDKELKTIIKEILHLHPSTTDGLIYTDKSHGGLGIQRVANIVKLAKLKHSILMTRSEDNAVKIALNGQEGMVKRYATSIGLQWPCGIEEIEETRKKLKRADTNKWKTLISQGQGIKEFFGDKTGNAWLYNPEMLRPSRYLDALKLRTNTYGTKAALHRAKRDIDINCRRCGVQVETLGHILGLCTHTKNKRIKRHDEICDLIAKNVSKEYVIFREPEVEVNGDRRKPDMVIKDHDKVYVVDVTVRYENNDSLNKAYKEKENKYKETAEIMRRDLKAKESRVLPVVIGSRGAVPRATIENLKVLGLQTKHALTASLIALRSSIEMANEFLDYDHTT

SEQ ID NO: 1474 - protein, 1279 aa, synthetic construct
  source 1..1279: note = Description of Artificial Sequence: Synthetic polypeptide
  VARIANT 81: note = Any amino acid
  VARIANT 111: note = Any amino acid
TFAPTHPMVRSGPCRKTKRPGSDYRESLIMDSGNNVASEPRGAVDVTSAAPIGAELNAEPCEGRNQRREAALSAQTRRRNXARRARNAQQADEPGDDEEIETHGPLTIRTXEPMEIVAIAKNPQACPKCLQGGTQLLCMGSWELSRHINKEHPSVDVTWVCGACQRRCTTLRSWSCHVLHCKGRQEPKDLPFKCEHCSLSFDSQIGLSQHERHVHPEVRNDKRAAEANKPKGKSGRRPSIWSDEDLLLIRELESEYHGARNINEKIAEHFPDRTGRQVSDARRRKDYAALRGRGGPQGPAEGVEAIEEVDEGEIPEGEELVATDGAALESGPPENGGSAPAEQVNAPALESSSQQDRECSPAVGSDEQIEDSSDDDEFSDALGEISLPEPLSVERTTISPPPRDDWKGPMRWEICNASEEAGSYANWVTGLQELVRNNALSEIGLDSLYDQLIQIMRHPSDDNEQDRLQLNARGPPRRGHRKNRRRRRLTAADRKRFAFARCQDLWNNNPKKLAELVIANDLSILQRRQAPGRTETQTLYNELWGRVGPNIEAPRRTEDPIPVSRIFTPITPQEIMGRIRRIKNDSAAGPDGVTKDDLRGRGVSIALSKLFNSILLAGYYPKAWRENRTTLLPKPEKDPADVKNWRPITISSMVSRVYSGLLDQRVRAVIKQCDRQKGFTEENGCFSNIQLLDDAVSNAKKAGGVITILDVSKAFDTVPHAVIQGCLEKKGIPETVAAYISSMYRDCSTAIRTRSGDVKIGMKRGVKQGDPLSPLIFNLVLEPLLERLQETSGVEIEGMNLSCAAFADDIVCFANTAPEAGRQLRMVADYLGRLDMSLSVSKCIAVEYVPHRKTWYTKNPGLEVNGNAVPSISPSETFKYLGAKVSPWKGLLEGFESDAFREVISRVQRLPLKPMQKVDLLQMYIFPRYTYGLITSPPAKAVLKTIDRIIRTRIKEILHLPESVSSSFLYTPRKQGGLGLLEVEKMVLIAALRNGLRARQSHDPVTRAAMNSNAADDRLKSYADALRLHWPLTTKELDTYKYQLRLSYAQKWAEQKWQGQGVEEFAQDPVGNSWLQRYDLLPASRYIDAIKLRTNTYPTRALMKIIDGRVDSSCRKCQGSSETLGHILGRCRYTKDKRISRHNEIKDLLKARLAKNHQVMDEPQITVRGQRFKPDLVVKTNEGRVHVIDVTVRYEHRTYLDEGRTEKIGKYRQILSTLRRDLHSNAEEVIPIVIGSRGAIPRETRKALSKLGIGKSDWLTISLIALRSSLEIVNAFMDD

SEQ ID NO: 1475 - protein, 1104 aa, synthetic construct
  source 1..1104: note = Description of Artificial Sequence: Synthetic polypeptide
MGEWPWVSWSLTVLVEKWRPFTILQPYPMPGQLRVDVYLPRKTSYLMDKNIYENTTSPGGGPLCGEKTHRSDVIIPPPGFAPSTDTASNTLGENVDASATTSSANPLSQEPGWCESCSKLFKSQRGLRVHQRSKHPELYHSQNQPLPRSKARWSDEEMVIFAREEIANRKIRFINQHLHKVFPHRTLESIKGLRGKNVRYARIMADLEAEMTSQPEAATSLCTETSENLASSNVLPQTRGWAENLVENIDTAHLANLGPLSQFEPGKPSSSTKEAINTEYNDWISKWLPSGAAHRERRANPPSTKLNARATRRLQYSRIQNLYKLNRSACAQEVLSGAWKVQSGELNLKEVQPFWEKMFRKESAKDRRKPKPTGEVLWGLMEPLTIAEVGSTLKSTTPSAPGPDKLTLDGVKRIPIAELVSHYNLWLYAGYQPEGLREGITTLIPKIKGTRDPAKLRPITVSSFICRIFHRCLAQRMETSLPLGERQKAFRKVDGICHNIWSLRSLIHNSKDNLKELNITFLDVRKAFDSISHKSLGIAAARLGLPPPLITYISNLYPNCSTKLKVNGKISKPIEVRRGVRQGDPLSPLLFNAVMDWALSELDPRVGVQIGEQRINHLAFADDIILVSSTKIGMVSSINTLSRHLAKSGLEISAGKEGKSASMAIVVDGKKKMWTVDPLPRFKVNSQKIPALSITQQYKYLGINIDAQGARNDAARILTEGLAELSRAPLKPQQRLYLLRVHLLPKLQHGLVLSSCAKRALTYLDKSVRSAIRRWLTLPKDTPTAFYHAKACDGGLGITRLEHTIPILKRNRMMKLTLSEDPVIMELVKLTYFTNLLHKYSNVKLLNSWPVTDKDSLARAEASMLHTSVDGRGLSNCSDVPRQSDWVTNGASLLSGRDFIGAIKVRGNLLPTKVSAARGRQREITCDCCRRPESLGHILQTCPRTWGPRISRHDSLLKRVRNQACLKNWTPIIEPSIPTNIGLRRPDLVLAKGNIAFLVDATVVADNANMQLQHEAKVEKYNNSDIKEWIKVHCPGVDEVRVTSLTANWRGCLYGGSASFLTEDLGLPKAELSLLSAKINEKGYYLWCAHYRGTARLWNRPLRS

SEQ ID NO: 1476 - protein, 1115 aa, synthetic construct
  source 1..1115: note = Description of Artificial Sequence: Synthetic polypeptide
WVTSPRRPRYVGPQKKKASDGNDGRAAARAEPTNPGGPDRADDDEGDVKFWCEFPGCDRFFMTRSGRGLHHKKGHPDWNDQRNLAGKQHRKEIWSEEERLLLAKKEAELAISGARFINVELRDFTARSLDAIKGQRKRPDYKILVEKFVRELRVRGIRQGVASRSQQARAMAVAGAPAATSSGAPPVATQPPPSGRVLRSQVVEAPAMEIPVAESEGDSSGDELFEDVEPVRLSDLPPDRFTIYFAGLEIPGTEDIYAHRLHTICLMTTWRTKEEVRLELGLFLKDLFPSKGSQERPERTNLPDPRNRIERRRGEYKKCQDLWRRNKSTCVQRILKEDLSQGECLPRELMEPFWNATFTQNPGTAPVLPPPTEVYSSVWEPIRPENIKGNYPPQNTAAGIDGLTVGDLKGVSREMLARIFNLFMWCGKLPEHLCASRTILLPKKPGAKVPGEFRPITVTSVLIRTFHKVLAERLKVVPLDPRQRGFRESDGCAENVMLLDMTIRYHHERRRKMFLALLDMAKAFDSVSFESMREVLTTKGIPTPFIEYFMTHLEDSFTVLQHGNWQSGKIHPTCGVKQGDPLSPPIFNFIMDEMLKRLPKEIGVNLDGLFVNAMAFADDLSLVANTEQGLQILIDEATSFLGLCGLRANPNKCVTLAIKTIPKEKKTAIDPSSHFRIGNAVIPSLKRTDEWVYLGIKFNSNGRLISDAKPKLIKDLELLTKAPLKPQQRLWALKVIVIPGILYRGTLGSSTAGYLRSLDCVIRAYVRRWLRLPGDCPNGYFHAAVADGGLGVHPIRYKAMVDRLARLRKLEKSAYITGPEAARYLQRQVSIAENRLRDGANRIMSDASMLREFLRELLYKSFDGRPLENSSKVPGQHRWVEEPTRFLSGADYMNCIRARIAALPTAARCARGRLKDKHCRAGCGNVETLNHVLQFCHRTHGTRIGRHDAVVKYVVGGLKKRGYAVKEEPKIVLQDVVYKPDMVATKEGKTLILDAQVLGDQRDMRLAHEDKLRKYGAPEFKRKIRSETGSATIKSLSVTLSWRGLWGPDSVKGLLEEGVILKKDLKILSTRVLIGALAGWRRFNERTSMATSGRREEVTTRMVRRWKRRERVGVG

SEQ ID NO: 1477 - protein, 1013 aa, synthetic construct
  source 1..1013: note = Description of Artificial Sequence: Synthetic polypeptide
  VARIANT 753: note = Any amino acid
MSGKSSKPRTVSSGSSSQETPPSGSNACDICGKCFMKPVGLSRVHPSQYHARLEKNQPKAKKFRWTDEDLYFLAKKEAELLHLGSIKFVNKELAEFFPEKSVDQIRGQRRSETYKQQVLSIHSELLKLQTVADSPPPSRIPAKEVSAWLDFFLALPKTKNKFSEDKLDQLIRTAQDGTLILDDLDLYLREVLVQPTSQGEKQAKLLPPPKSSREKRDREYARAQNLYRKNKTACVNAILDGNKKCENKIPDIDDFWKTIFESHSPPDAEPVCYVVDEEPTNIWSWISFFEMNHNYPDSSTSPGPDGVTARMLRSIPARVLNKLLNLLLFIEDLPAVFKCHRTVLIPKIDNPTSPGEFRPITISSIVVRQLNKIIAARVSEGVPINPRQKAFRQIDGCAENVFLLDFILRDAKTKIKSLSLATVDIKKAFDSVSHHSIFRAIRGARCPENLVNYIQNSYSGCTTQISVGGSISASKIPMNRGVKQGDPLSPVLFNLVINEIIRKLPASIGYPINSELSINCIAYADDLILVTNTREGLKLLLGLLNEELPKRGLELNASKCFGLSLTALGKLKKTHLCTSDQLDLHGTLIKNLTAEESWVYLGVPFSHIGRSKSFSPDLEALLNKLQKSPLKLQQKLFALRVYLIPRLLHGLVLSRVAIGELKIMDKLILKHLRVWLRLPKDTPLGFFYSPVKLGGLGIKNLRTNVLKCRKQRIERMLVSPDDVVRLVAESEIFLKETDKLKDLLTINGMCLDXRNVPRTGKNNKFWSERLYTSFDGKTLAYSEYFTQGGGWIREDKILQPAHVFAECIKLRINALPTKSRVAHGRPTKDRSCRAGCLDVQKVPTIETINHIAQVCPRTHGARIKRHDRLVQFLSLNLRKNPKRNVLVEYNFRTVAGIRKPDIIVIEDTRAVILDVQVVGDSSNLEMEYLEKSRKYSNDANFINALQKLYPTVTNLTFHAVTFNNRGLIAKSTVAALRMLGVPPRCIMILCVISLEKTLEVWRMFNQSTASARK

SEQ ID NO: 1478 - protein, 1016 aa, synthetic construct
  source 1..1016: note = Description of Artificial Sequence: Synthetic polypeptide
MSEESRPKQTASKRGAAVEKTMMSGTYVCTLCGRSFEKSVGLSLHTNRMHPEAYNKLKEAKKPVLKKARWSEEEVFLLAQKEAELSFIGGIKFMNIELHKIFPERELEGIKGQRKNPTYKAQVVSLLAEIRESKANDSSSSSSSSSSCDSASLGISNWLEFLLALPKTSNQFQEGRLDRLISDALRGVDVLENLDAYLLEVFAKPMAQNPCPKPPPPAKNSRERRDREYSRVQNFYKKNRSACINSILDGNTRSQNVIPGLTKFWTETFEKNSPPDDEAPDQFVADEPRDMYKWITFYEMSQDYLDSSTAPGVDGFSAKQLRSMSPRVLNKILNLLLLSENLPNSFKMHKTVLIPKIDDPKSPGDFRPITISPVLARLLNKILAARLSKLVPISQRQKAFLPVDGCGENIFLLDYILRSSKKSSKSVAMAVLDVKKAFDSVSHHSILRALNEAKCPINFINFVRNSYDGCTTKLTCGGTSFPDSVRMNRGVKQGDPLSPVLFNLIIDSAIRKLPDSIGYVIRDGLKINCLAYADDLILVASSRAGLKTLLNIVAEHLSLRGLDLNAAKCHGLSIIASGKAKTTYVSAADSLDLDGQPIKNLGVLDTWTYLGIPFSHLGRAEKVSPDLTNLLNKLQKAPLKLQQKLYAVRNFVIPRALHGLILSKTNLKELNTLDRAIRVFLRTLLYLPKDTPLGFFHSPIKSGGLGITCFRTSVLKCRLQRIARMRSSCDGVIQAVAESDIFADEYAKLRDLIRINGNVLDTTESIKRYWAQRLHSSVDGKTLAYMDYFPQGNLWMSEDKVSQRSYVFADCVKLRINAIPTRVRVSRGRPNKEMCCRAKCFDSQRMPAFESLNHITQVCPRTHGSRIQRHDKIAKFLFKNLNNCPSRSVLYEPHFVTVDGLRKPDIIIYDDSHMVVLDVQVVSDSANLEKEFECKAKKYANDVALRSAMLIKYPFIKSFSFVAATYNNRGLIAKSSVQVLRQLGLSPRSIMVSILICLEGTLETWRIFNQSTMNAH

SEQ ID NO: 1479 - protein, 1020 aa, synthetic construct
  source 1..1020: note = Description of Artificial Sequence: Synthetic polypeptide
  VARIANT 757: note = Any amino acid
MSGKSSKPRTVSSGSSSQETPPSGSNACDICGKCFMKPVGLSLHMSKVHPTQYHARLEKNQPKAKKFRWTDEDLYFLAKKEAELLLLGGIKFMNKELAEFFPEKSVDQIKGQRRSETYKQQVVSIHSELLKLQAVADSPPPSRIPAKEVSAWLDFLLALPKTKNKFSEDKLDQLIRTAQEGTPVLNDLDLYLREVLVQPTRQGERQAKPLPPPKSSREKRDREYARVQNFYRKNKTACVNAILDGNKKCENKIPDIDEFWKAIFESQSPPDAEPVSYVVDEEPKNIWSWISFFEMNRNYPDTSTSPGPDGVTARMLRSIPARVLNKLLNLLLFIEDLPAVFKCHRTVLIPKVDNPALPGEFRPITISSIIVRQLNKIIAARVSEGVPINPRQKAFRQIDGCAENVFLLDFILRDAKTKIKSLSLATVDIKKAFDSVSHHSIFRAIRGARCPENLVNYIQNSYSGCTTQISVGGSISTTKILMNRGVKQGDPLSPVLFNLVINEIIRKLPASIGYPINSELSINCIAYADDLILVANTREGLKLLLNLLNEELPKRGLELNASKCFGLSLTALGKLKKTHLCTSDQLDLHGTLIKNLTAEESWVYLGVPFSHIGRSKSFSPDLEALLNKLQKSPLKLQQKLFALRVYLIPRLLHGLVLSRVAIGELKIMDKLILKHLRVWLRLPKDTPLGFFYSPVKLGGLGIKNLRTNVLKCRKQRIERMLVSPDDVVRLVAESEIFLKETDKLKDLLTINGMCLDXRNVPRTGKNNKFWSERLYTSFDGKTLAYSEYFTQGGGWIREDKILQPAHVFAECIKLRINALPTKSRVAHGRPTKDRSCRAGCLDVQKVPAIETINHIAQVCPRTHGARIKRHDRLVQFLSLNLRKNPKRNVLVEYNFRTVAGIRKPDIIVIEDTRAAILDVQVVGDSSNLEMEYLEKSRKYSNDATLSMRINALQKLYPTVTSLTFHAVTFNNRGLIAKSTVAALRMLGVPPRCIMILCVISLEKTLEVWRMFNQSTASARK

SEQ ID NO: 1480 - protein, 1138 aa, synthetic construct
  source 1..1138: note = Description of Artificial Sequence: Synthetic polypeptide
MLRGTGNMNDKRDGSATADPTSALLGAVGDGSLVCNLCGLACKSRGGLSIHRRSKHATVYHAERQPAPRAKARWTNDEMILVARKQIASEKSRCSAVVEGMREAVPHRTFDAVKSLKTKNRNYTRILEQIRAECSEEEVIESGVLKDRTENVCVQTTSNVPGSAGRAASVELEGNIQVGHQLAQKTMAGNNSRKQPANHTNWAEFNIEEGNITLRKSKRKANGMPDATHRPGPPTVDSLKHPVCLLQGAADKRDEPHTVEQLYYNIEEGMPLAEEQQWSEKLFDAIDSSLLSVEVELGRIVPGCPDEETRQLIDREFLDFIHSYSREKPPQRGLAKSKPPPKGPKSLRRQQYRQLQRLWDKNRSAAAEQALTGKWQEVRTAAGVPLSLMEVPWREIFETPSTTDVREPAPAGPVLWQLLRPVTIAEVEDAISSKKSASGPDGVPCAALQTMGAASLAAHFNLWLLAGTQPKRLTECRTIFVPKEVNTHLPLHHRPITIGSVVVRLFHQILGKPMEAVLPLGSGQRGFRKGDGICQNIWLLHTLIRRSTDLLRPLKLVFLDVKKAFDSVSHESLLIAAKRLGVPGPLLTYINELYSRSETVFEVGGESSGSVKVSQGVKQGDPLSSTLFNCVIDWAVSDLDPHIGVLLGESRVSFLAYADDLVLLSETEAALTSQLNSIEKSLAHCGLKLSTGDSGKSASLNIVIDGKAKRWVVNPTPFLRASGGEIRSLVANETYKYLGINIGAQGVKAAEYNAFKEALDNLSRAPLKPQQRLFLLKTYLLPQLHHSLVLSRTTGKLLNSLDALVRKAVRGWLKLPHDTHRAFFYAHQADGGLNVPSLYHLIPLLRRSRYERLTRVEDPEIREVSRTDYFKRVLGAAAAATTVAGHRIDSKVTLRLAWREALYASADGRGLSQCPLVPEVHSWVTDVSGLQTGSQYISAVRLRGALLPTAVRKSRGRGGVNSNCDCCGRGQPEFLGHVLQTCPRTWGSRISRHNHVLSLIAKACRSRRWQVLEEPIIQTPAQLLKPDLVIWNHQAAYVVDVSVPGDNTPLSTCHNRKVAYYSGESVREWVRSKTGHNPTVSSVVINWRGAMAKESYRLLTKDLRLAKTLPRLLVLRVLEGGHGIWLNFHRSTFAVGVT

SEQ ID NO: 1481 - protein, 1148 aa, synthetic construct
  source 1..1148: note = Description of Artificial Sequence: Synthetic polypeptide
MPVSTGAETDITSSLPIPASSIVSPNYTLPDSSSTCLICFAIFPTHNILLSHATAIHHISCPPTPVQDGSQQMSCVLCAAAFSSNRGLTQHIRHRHISEYNELIRQRIAVQPTSRIWSPFDDASLLSIANHEAHRFPTKNDLYQHISTVLTRRTAEAVKRRLLHLQWSRSPTAITTSSNNHTTTDIPNTEARYIFPVDLDEHPPLSDATTPDASTHPLPELLVILTPLPSPTRLQNISESQTSHESNRNSMHTPPTYACDSDESLGVTPSSTIPSCFHSYRDPLAEQRSKLLRASASLLQSSCTRIRSSSLLAFLQNASTLMDEEHVSTFLNSHGEFVFPRTWTPSRPKHPSHAPANVSRKKRRKIEYAHIQTLFHHRPKDAANTVLDGRWRNPYVANHSMIPDFDCFWTTVFTKTNSPDSREITPIIPMTPSLIDPILPSDVTWALKEMHGTAGGIDRLTSYDLMRFGKNGLAGYLNMLLALAYLPTNLSTARVTFVPKSSSPVSPEDFRPISVAPVATRCLHKILAKRWMPLFPQERLQFAFLNRDGCFEAVNLLHSVIRHVHTRHAGASFALLDISRAFDTVSHDSIIRAAKRYGAPELLCRYLNNYYRRSTSCVNRTELHPTCGVKQGDPLSPLLFIMVLDELLEGLDPMTHLTVDGESLNYIAYADDLVVFAPNAELLQRKLDRISLLLHEAGWSINPEKSRTLDLISGGHSKITALSQTEFTIAGMRIPPLSAADTFDYLGIKSNFKGRCPVAHIDLLNNYLTEISCAPLKPQQRMKILKDNLLPRLLYPLTLGIVHLKTLKSMDRNIHTAIRKWLRLPSDTPLAYFHSPVAAGGLGILHLSSSVPFHRRKRLETLLSSPNRLLHKLPTSPTLASYSHLSQLPVRIGHETVTSREEASNSWVRRLHSSCDGKGLLLAPLSTESHAWLRYPQSIFPSVYINAVKLRGGLLSTKVRRSRGGRVTNGLNCRGGCAHHETIHHILQHCALTHDIRCKRHNELCNLVAKKLRRQKIHFLQEPCIPLEKTYCKPDFIIIRDSIAYVLDVTVSDDGNTHASRLLKISKYGNERTVASIKRFLTSSGYIITSVRQTPVLTFRGILERASSQSLRRLCFSSRDLGDLCLSAIQGSIKIYNTYMRGTQRLNE

SEQ ID NO: 1482 - protein, 1031 aa, synthetic construct
  source 1..1031: note = Description of Artificial Sequence: Synthetic polypeptide
MSQKRRPEKAVPDEGATAHDVAQPDKSKCSVCGETFKGPASVTMHMVKKHPVEFNELKMAKKPVPKKVRWSEEEIFQLARTEAELTLQGVRFINVELQKIFPAREIEGIKGQRKLAKYKELVKDQLDEIGRAPNPPEQEIGEDVPSPFKAWLELLLALPKTPNDFLEHKLDNIIVQALKEDVNSDQVFNDLNSYLKLILEPSGRAKSVPGEIIHGDPSGSAKTSVTKAPKPATVSSSRKKRRDAEFARIQRLYRKNRTSCINTILDGNTREHEAPKNMEGFWREIFERESPDDPDDPDIFLEEEASDIWKYISFYEMCNLYPPPSTAPGPDGFSSKDLRRMTPRVLNKILNLLLHLRDLPQILKSHRTVLIPKTDLPTKPGDFRPITISNILVRHLNKILANRVSHLIPINERQKAFLPIDGCAENIFTLDFILHHARTKIKSLSMAILDISKAFDSVSHHSIFRALREARCPIGFIKFIENCYGGCFTKLFCGGVKYPSEVSMNRGVKQGDPLSPVLFNLVIDGLIRQIPSALGFNVSDQVKVSCIAYADDLILIATTRAGLKTLLDLTNSYLAKRGLSLNPDKCSALSIVASGKQKLVYIASSEHFDLAGQKMRNLNVGDSWRYLGIQFSHLGRAEKVTPDLTCLINRLQKAPLKLQQKLYALRIYLIPRLIHGLTLSKTNLGELKTLDKLIRKYIRAWLHLPDDTPMGYFYTPLKAGGLGLPSLRLVILNNRLERILRMKASQDIIVRTIAESETLGVEIRKLHDLLSIDGTILDTSVKIHSFWAERLYSSYDGKCLCNSANFPPGNKWIGEDSLNQRSHIFADCLKLRINALPTRSRTARGRPLKDKPCRAGCRNSDGVKVIETLNHITQVCERTHGARVKRHDRLVDFAVKGLQRPHRVVLKEPHYKTVNGVRKPDIVIKIPDHTYICDFQVVSDTSCLELEFRKKALKYAEDKGLCDQLTRDHPGELSFTAITFNTRGLIAKSSVTALRKLGMPPRSIMTLQKICMEGSLEIWRIFNQTTAMARN

SEQ ID NO: 1483 - protein, 1056 aa, synthetic construct
  source 1..1056: note = Description of Artificial Sequence: Synthetic polypeptide
FERRKDPWGYRPPGTLKQIGATENNEPRNLNRFVRGESTASSLESTQFGTSAEVNLAGRVPCTICEMTFSSKRGLGVHMSHRHKDDLDAQRLRVDKKARWSEEETLMMARKEVELAASGVRFLNKKLAEIFTHRSADAISSYRKRSEYKAKLEQIRGQSVPTPEAEEINTTQRRPSNSEQNRRVPRSEGGPIAPTEQTNNEILRVLQGLAPVVCLPRWRAEVLQNIVDNAQVSGQETTLQSLSSYLMEIFPPRNEPHILTRPRTEPRNMRQRRRQQYARVQRNWDKHPGRCIKSLLEEDDESVMPNQEVMEPYWRRVMTQPSSSSIKRDMFNMEHSLERVWSAVNQRDLRATKVKLSSSPGPDGITPKTARSVPEGIMLRIMNLILWCGNLPYSIRLARTIFIPKKATANQPQDYRPISVPSVIVRQLNAILASRLSAAINWDTRQRGFLPTDGCADNTTIVDLVLREHHKRFKSCYIGTLDVSKAFDAVAHEAVYNTLASYGAPKGFINYLRKAYEGGGTMLAGNGWVSEAFIPARGVKQGDPLSPILFNLVIDRLLRSLPSEIGAKVGNAMTNAAAFADDIVLFAETPMGLQKLLDTTVCFLSSVGLTLNTDKCFTVSIKGQAKQKCTVVERRSFLIGGRECPSLKRTDEWKYLGIKFTAEGRARYDPAEDLGPKLLRLTRAPLKPQQKLFALRTVLIPQLYHKLTLGSVTIGVLKKFDKLVRYTARKWLGLPVDVPVSFFHAPHKSGGLGLPSLRWTAPMLRLKRLSNIKWPHLERSEVASSFVEEEMRRARDRLQAGSEELLTRSQVDSYLANRLHMSVDGCGLREAERFAPQHGWVSQPTRLLTGKEYTDGIKLRINALPSRSRTTRGRHELERRCRAGCDAPETTNHILQQCYRTHGRRIARHNGVVNFLKRGLERRGCVVHVEPSLQGETGLNKPDLVAIRQNRIYVIDTQIVTDGHSLDQAHQRKVGKYDTPDIRTNLRRSFGAFDIEFHSATVNWRGIWSGQSVKRLIASDLLSSGDSNIISVRVISGGLWSWRQFMYLSGYTRDWT

SEQ ID NO: 1484 - protein, 1022 aa, synthetic construct
  source 1..1022: note = Description of Artificial Sequence: Synthetic polypeptide
MTTRPSVDIFPEDQYEPNAAATLSRVPCTVCGRSFNSKRGLGVHMRSRHPDELDEERRRVDIKARWSDEEKWMMARKEVELTANGCKHINKQLAVYFANRSVEAIKKLRQRGDYKEKIEQIRGQSALAPEVANLTIRRRPSRSEQDHQVTTSETTPITPFEQSNREILRTLRGYSPVECHSKWRAQELQTIIDRAHLEGKETTLQCLSLYLLGIFPAQGVRHTLTRPPRRPRNRRESRRQQYAVVQRNWDKHKGRCIKSLLNGTDESVMPSQEIMVPYWREVMTQPSPSSCSGEVIQMDHSLERVWSAITEQDLRASRVSLSSSPGPDGITPKSAREVPSGIMLRIMNLILWCGNLPHSIRLARTVFIPKTVTAKRPQDFRPISVPSVLVRQLNAILATRLNSSINWDPRQRGFLPTDGCADNATIVDLVLRHSHKHFRSCYIANLDVSKAFDSLSHASIYDTLRAYGAPKGFVDYVQNTYEGGGTSLNGDGWSSEEFVPARGVKQGDPLSPILFNLVMDRLLRTLPSEIGAKVGNAITNAAAFADDLVLFAETRMGLQVLLDKTLDFLSIVGLKLNADKCFTVGIKGQPKQKCTVLEAQSFYVGSSEIPSLKRTDEWKYLGINFTATGRVRCNPAEDIGPKLQRLTKAPLKPQQRLFALRTVLIPQLYHKLALGSVAIGVLRKTDKLIRYYVRRWLNLPLDVPIAFVHAPPKSGGLGIPSLRWVAPMLRLRRLSNIKWPHLTQNEVASSFLEAEKQRARDRLLAEQNELLSRPAIEKYWANKLYLSVDGSGLREGGHYGPQHGWVSQPTRLLTGKEYMDGIRLRINALPTKSRTTRGRHELERQCRAGCDAPETTNHIMQKCYRSHGRRVARHNCVVNRIKRGLEERGCVVIVEPSLQCESGLNKPDLVALRQNHIDVIDTQIVTDGHSMDDAHQRKINRYDRPDIRTELRRRFEAAGDIEFHSATLNWRGIWSGQSVKRLIAKGLLSKYDSHIISVQVMRGSLGCFKQFMYLSGFSRDWT

SEQ ID NO: 1485 - protein, 1070 aa, synthetic construct
  source 1..1070: note = Description of Artificial Sequence: Synthetic polypeptide
SSFGLIVTNLNSETVLWGCQPLGQFSLIGTNMQNTTPRIINTNSLTNQIPTVSSLGAQSEHSAQVNPNSGYQCTICESSFRSKSGLGVHMSRRHKDEFDQLRLRTDRKAQWSEEELSMMARKEIELAANGERYLNKKLAEVFTNRSVDAIKKCRQRERYKTKIEQLKGQAVPLPEALESETIQRRPSIRERDLLVTPPNTLGTTPTELSNSEILAVLQGYPPVVCNDQWRVEVLQSIVDGAQASGKEITLQRLSTYLMEVFPSQNDRPIQTRPPRRPRNRRQGRRQQYALTQRNWDKHKGRCIKAILDGTEGTATMPSQGIMGSYWRQVMTQTSPTYSGTNTTFRTEHPLEGVWSPITLGDLRVHRVSLTKSPGPDGITPRTVRSIPSGVMLRIMNLILWCGKLPVSIRQARTIFIPKVGNASRPQDFRPITVQSVMVRILNAILASRLTSSVDWDPRQRGFLPTDGCADNTTIVDLILRDHHKRCKSLYIATLDISKAFDSVSHAAVSATLTAYGAPKEFVDYVQNSYEVCGTTLNGDGWRSEEFIPARGVRQGDPLSPIIFNLIIDQLLRSYPNEIGATIGDHTTNAAAFADDIVLFAETRLGLQTMLDTTVDFLSSVGLTLNSDKCFTVGIKGQPKQKCTVVIPETFRIGSRSCPALKRTDEWKYLGITFTAQGRTRYSPADDLGPKLLRLTRSPLKPQQKLFALRTVLIPQLYHKLTLGSVMIGVLRKCDILVRSTVRKWLGLPLDVSTAFFHAPHTYGGLGIPSVRWVAPMLRMKRLSNIKWAHLAQSEAASSFLTDELNKARGRTLAGLNELTSRTEIETYWANRLYMSVDGRGLREAGLFRPQHGWVCQPTRLLTGQDYRNSIKLRINALPSRSRTTRGRNELERQCRAGCDAPETTNHILQNCYRTHGRRVARHNCVVNNLKRILEEKGHTVHVEPSLQLETSVSKPDLVCIRDNHACVIDAQIITDGLFLDDVHHRKVEKYKRPEVISALRREFGVSGNVEVLSATLNWRGIWSNQSVRRLIAKGLISSGDSNVISARVVTGGLYCFRQFMYLAGYTRDWT

SEQ ID NO: 1486 - protein, 1070 aa, synthetic construct
  source 1..1070: note = Description of Artificial Sequence: Synthetic polypeptide
SSFGLIVTNLNSETVLWGCQPLGQFSLIGTNMQNTTPRIINTNSLTNQIPTVSSLGAQSEHSAQVNPNSGYQCTICESSFRSKSGLGVHMSRRHKDEFDQLRLRTDRKAQWSEEELSMMARKEIELAANGERYLNKKLAEVFTNRSVDAIKKCRQRERYKTKIEQLKGQAVPLPEALESETIQRRPSIRERDLLVTPPNTLGTTPTELSNREILAVLQGYPPVVCNDQWRVEVLQSIVDGAQASGKEITLQRLSTYLMEVFPSQNDRPIQTRPPRRPRNRRQGRRQQYALTQRNWDKHKGRCIKAILDGTEGTATMPSQGIMGSYWRQVMTQTSPTYSGTNTTFRTEHPLEGVWSPITLGDLRVHRVSLTKSPGPDGITPRTVRSIPSGVMLRIMNLILWCGKLPVSIRQARTIFIPKVGNASRPQDFRPITVQSVMVRILNAILASRLTSSVDWDPRQRGFLPTDGCADNTTIVDLILRDHHKRCKSLYIATLDISKAFDSVSHAAVSATLTAYGAPKEFVDYVQNSYEVCGTTLNGDGWRSEEFIPARGVRQGDPLSPIIFNLIIDQLLRSYPNEIGATIGDHTTNAAAFADDIVLFAETRLGLQTMLDTTVDFLSSVGLTLNSDKCFTVGIKGQPKQKCTVVIPETFRIGSRSCPALKRTDEWKYLGITFTAQGRTRYSPADDLGPKLLRLTRSPLKPQQKLFALRTVLIPQLYHKLTLGSVMIGVLRKCDILVRSTVRKWLGLPLDVSTAFFHAPHIYGGLGIPSVRWVAPMLRMKRLSNIKWAHLAQSEAASSFLTDELNKARGRTLAGLNELTSRSEIETYWANRLYMSVDGRGLREAGLFRPQHGWVCQPTRLLTGQDYRNGIKLRINALPSRSRTTRGRNELERQCRAGCDAPETTNHILQNCYRTHGRRVARHNCVVNNLKRILEEKGHTVHVEPSLQLETSVSKPDLVCIRDNHACVIDAQIITDGLFLDDVHHRKVEKYKRPEVISALRREFGVSGNVEVLSATLNWRGIWSNQSVRRLIAKGLISSGDSNVISARVVTGGLYCFRQFMYLAGYTRDWT

SEQ ID NO: 1487 - protein, 1057 aa, synthetic construct
  source 1..1057: note = Description of Artificial Sequence: Synthetic polypeptide
FERQNFSDGLVPQRKFIHIGTTNRNNEPRSNLRNLMTTRPSVDIFPEDQYEPNAAATLSRVPCTVCGRSFNSKRGLGVHMRSRHPDELDEERRRVDIKARWSEEEKWMMARKEVELTANGHKHINKQLAVYFANRSVEAIKKLRQRGDYKEKIEQIRRQSALVPEVANLTIRRRPSRSEQNHQVTTSETTPITPFEQSNREILRTLRGYSPVECHSKWRAQELQTIIDRAELEGKETTLQCLSLYLLGIFPAQGVRHTLTRPPRRPRNRRESRRQQYAVVQRNWDKHKGRCIKSLLNGTDESVMPSQEVMVPYWREVMTQPSPSSCSREVIQMDHSLERVWSAITEHDLRASRISLSSSPGPDGITPKTAREVPSGIMLRIMNLILWCGNLPHSIRLARTVFIPKTVTAKRPQDFRPISVPSVLVRQLNAILATRLNSSINWDPRQRGFLPTDGCADNATIVDLVLRHSHKHFRSCYIANLDVSKAFDSLSHASIYDTLRAYGAPKGFVDYVQNTYEGGGTSLNGDGWSSEEFVPARGVKQGDPLSPILFNLVMDRLLRNLPSEIGARVGNAITNAAAFADDLVLFAETRMGLQVLLDRTLDFLSLVGLKLNADKCFTVGIKGQPKQKCTVLEAQSFYVGSREIPSLKRTDEWKYLGINFTATGRVRCNPAEDIGPKLQRLTKAPLKPQQRMFALRTVLIPQLYHKLALGSVAIGILRKTDKLIRYYVRRWLNLPLDIPIAFIHAPPKSGGLGIPSLRWVAPMLRLRRLSNIKWPHLTQNEVASSFLEAEKQRARDRLLAEQNELLSRPAIEKYWANKLYLSVDGSGLREAGHWGPQHGWVNQPTRLLTGKEYIDGIRLRINALPTKSRTTRGRHELERQCRAGCDAPETTNHIMQKCYRSHGRRIARHNCVVNRIKRGLEERGCVVIVEPSLQCESGLNKPDLVALRQNHIDVIDIQIVTDGHSMDDAHQRKINRYDRPDIRTELRRRFEAAGDIEFHSATLNWRGIWSGQSVKRLIAKGLLSKYDSHIISVQVMRGSLGCFKQFMYLSGFSRDWT

SEQ ID NO: 1488 - protein, 1063 aa, synthetic construct
  source 1..1063: note = Description of Artificial Sequence: Synthetic polypeptide
TCLAANLSGKNFSDGLVTQRKFTHIGTTNTNNEPRISLHNLMTTRPSVDIFPEDQYEPNAAATLSRVPCTVCGRSFNSKRGLGVHMRSRHPDELDEERRRVDIKARWSEEEKWMMARKEVELTANGHKHMNKQLAVYFANRSVEAIKKLRQRGDYKEKIEQIRGQSALVPEVANLTIRRRPSRSEQNHQVTTSETTPITPFEQSNREILRTLRGYSPVECHSKWRAQELQTIIDRAELEGKETTLQCLSLYLLGIFPAQGVRHTLTRPPRRPRNRRESRRQQYAVVQRNWDKHKGRCIKSLLNGTDESVMPSQEVMVPYWREVMTQPSPSSCSGEVIQMDHSLERVWSAITEHDLRASRISLSSSPGPDGITPKSAREVPSGIMLRIMNLILWCGNLPHSIRLARTVFIPKTVTAKRPQDFRPISVPSVLVRQLNAILATRLNSSINWDPRQRGFLPTDGCADNATIVDLVLRHSHKHFRSCYIANLDVSKAFDSLSHASIYDTLRAYGAPKGFVDYVQNTYEGGGTSLNGDGWSSEEFVPARGVKQGDPLSPILFNLVMDRLLRNLPSEIGAKVGNAITNAAAFADDLVLFAETRMGLQVLLDKTLDFLSLVGLKLNADKCFTVGIKGQPKQKCTVLEAQSFYVGSREIPSLKRTDEWKYLGINFTATGRVRCNPAEDIGPKLQRLTKAPLKPQQRMFALRTVLIPQLYHKLALGSVAIGVLRKTDKLIRYYVRRWLNLPLDVPIAFIHAPPKSGGLGIPSLRWVAPMLRLRRLSNIKWPHLTQNEVASSFLEAEKQRARDRLLAEQNELLSRPAIEKYWANKLYLSVDGSGLREAGHWGPQHGWVNQPTRLLTGKEYIDGIRLRINALPTKSRTTRGRHELERQCRAGCDAPETTNHIMQKCYRSHGRRVARHNCVVNRIKRGLEERGCVVIVEPSLQCESGLNKPDLVALRQDHIDVIDIQIVTDGHSMDDAHQRKINRYDRPDIRTELRRRFEAAGDIEFHSATLNWRGIWSGQSVKRLIAKGLLSKYDSHIISVQVMRGSLGCFKQFMYLSGFSRDWT

SEQ ID NO: 1489 - protein, 1057 aa, synthetic construct
  source 1..1057: note = Description of Artificial Sequence: Synthetic polypeptide
FERRIFPKGLVPLTKDNHIGTTNLQNEPRIFTNDLLTTRPSVDHVPEDQYEPNAAATLSRVPCTVCDRSFNSKRGLGVHMRSRHPDELDEERRRVDIKARWSEEEKWMMARKEVELMANGFKHINKQLAVYFANRSVEAIKKLRQRGDYKEKIEQIRGQSALAPEVANLTIRRRPSRSEQDHQVPTSEASPITPLEQSNREILRTLRGYSPVVCPSKWRAQELQTIIDRAEFEGKETTLQCLSLYLQGIFPVQGVRHTLTRPPRRPRNRRESRRQQYAVIQRNWDKHKGRCIKSLLNGTDESVMPSREFMEPYWREVMTQPSPSSCNGEVIRTDHSLETVWSAITEQDLRASRVSLSSSPGPDGVTPKTAREVPSGIMLRIMNLILWCGNLPHSIRLARTIFIPKTVTAKRPQDFRPISVPSVLVRQLNAILATRLTSSIDWDPRQRGFSPTDGCADNATIVDLVLRHSHKYFKSCYIANLDVSKAFDSLSHAAIYGTLRAYGAPKGFVDYVQKTYEGGGISLNGEGWCSEEFVPARGVKQGDPLSPILFNLVIDRLLRALPSEIGTKVGNAMINAAAFADDLVLFAETRMGLQTLLDKTVDFLSTVGLKLNADKCFTVGIKGQPKQKCTVLEAQSFCVGSREIPTLKRTDEWKYLGIHFTASGRVRCNPAEDIGPKLQRLSEAPLKPQQRLFALRTVLIPQLYHKLSLGSVTIGVLRKTDKLIRFYVRRWLNLPSDVPIAFVHAPPKCGGLGIPSLRWVAPMLRLRRLSNIKWPHLVQSEEASSFIEAEKQRARGRLIAEQNELLSRPAIEKYWANRLYLSVDGGGLREAGHYGPQHGWVSQPTRLLTGKEYLDGIRLRINALPTKSRTTRGRHELERQCRAGCDAPETTNHIMQKCYRSHGRRVARHNCVVNRIKRGLEERGCVVIAEPSLQCESGLNKPDLVVLRQNHIDVIDVQVVTDGHSMDEAHQRKINRYDRPDIRTELRRRFEAAGDIEFHSATLNWRGIWSGQSVKRLIAKGLLSKYDSHIISVQVMRGSLGCFRQFMYLSGFSRDWT

SEQ ID NO: 1490 - protein, 1309 aa, synthetic construct
  source 1..1309: note = Description of Artificial Sequence: Synthetic polypeptide
MEVPLTSSLGSGATQAPGTPELLGEHTVERPGLDQGHSYGLLMDDVELPVRLPFFGPLICPGCRTLLTSEETISSHHRRVHPDARTRWVCYGCDSPFMTYRAIKCHLPKCSGRKVVTGDHICNGCTKRFESQRGLSLHKRRAHPGLRNEEMLEPPVRAERRPNAHKSSIWSIDEIRILEQYEAAYVGDLHINMKIAAHLPFKTNKQVSNYRNDRRKKSRTATDASQQGLGPNDGNRGIVPSGQSSPLFLEGSDAEGDEDVFNVLVPPTLGGLEPAGQVHSLSEGETSPLVGEADPCFMGGTPSAGEASGSTLLGPDPTPADGYSLVRKDLQLSVQTSPLLAVGSVGTESVQFERGVLSCGTPPEFLHPEQFAHCANNDPVLNASEEQVHAPLGEEANDLPDNNHPSELGVDPEDPTCSPATEQVQPSSEEEADDPFAQFKAWRRRVASYALKIETGVLPAQVDDLLRRLRDGDTQSKVTCEEVEEVVLSLTRTILGGTAPKKRVEGRTKWTYKSRTNHEARKRIMYARCQDLYRRRPQRPVERAVGYQAEESLLDNQDERPSHGAFETFYTGLWGKSGQCNITMPPGVPRHTGHVLREVTPKDIYSRLRKLKKDYAPGPDGVTKLKVQSMGAYPSLLAKVYNLVMLTGYFSSCWKEHKTSLIPKDRGSPMDVSNWRPITIGSLLSRIYTGLIERRLRTVSDIHQRQVGFMPVNGCAANLFIFDECIRQAKKEGTIVGSLIDVAKAFDTVPHEAILRALSSQGVDEHTMAHIRDMYSGIRTRINGKGSDIPLVRGVKQGDPLSPMLFNMVMDPLIRDLQRKGFRIGGHEIGALAFADDIVLLADSIDGAQDHVDQVGRYMNKLGMTLNPRKSSSFLITAMRKTWICRDPGLSIGETKVPGARPSSALKYLGVNYTLSEGLESGALIDKLMQAVNRARGLALKPLQKVNLILERIIPKFLYGIILGGPSLTRLHAADKCVRMAVKEILHLHPSTTDHVLYARKKDGGMGIPRLAHLVRLASLRSGLALLASGDVAVQAAGMAGDLEGRCKKVANDLRLNWPVTLRDVVRASNKFKSQESKDWERLASQGHGVKDFRNDRLGNCWLYDPTVLSSSRYTDALRLRTNTFGVNVALRRADKDLEVNCRRCHGKPETLGHVLGECVAGKGMRIQRHDKMAAFVATKCEEKGYQTTREQLFSIEQGKLKPDLVVIDGERALIVDVTVRFESGNALSRGASEKIEKYQPLADYFVSQGAVREANVLPIVVGSRGAITQATLKSLATLGLDVERVGKYLAICAVASSVEIACMHLDYT

SEQ ID NO: 1491 - protein, 1198 aa, synthetic construct
  source 1..1198: note = Description of Artificial Sequence: Synthetic polypeptide
MMADYNNSVDHALEDNTRLIFARDAVLARVCGPFDNLECGLCGVLLTSLQGVREHCHRAHHNLDLTFQCTKCDKGFSSYRGICCHFSKCIGARISVSEGPLSCSECEREFDSKRALSTHERHMHPGIRNAKRLKDFNPRGGGGKTIHGNTKWTEEEVQLLVSLSKRFEGYKSINKEISLILTSKTCKQISDKRRYLNLHNGNGGLAAAEAVLEFCEDSHPEVTESDGAVLSEIMDEECHQSSVTMRSSIVHGDIGREVQGKELVRIPPDNSVMGNCVVLLRKLATDKRSDLDLSKDKELRIDIEKATKANRESADGRVIQSVAGNEIDPDTFQWKELLLGQVRGFPRVDENSELFDLDDKLTKELSSDSPVWNDNCELIVSDLCQVLCKKKYELGRQHHVRKGKRHRGIHHKREKFRECQKIFRKSPRKLAEYLYRDKDLSHISKDASTPQGIEQYYSQLWGEPELLESNTIEEKLPSSSLFDCLPPITPEEVEGRIHKIRPSSAPGLDGVRKIHLVGKGITLVLVKLYNLLFLTGGYPECWKRNRTVFIPKIGKDLSEVGGWRPLTIGSLLARMYSAFLERRIRRVTSLSLSQRGFTNIQGCHVNLTILKEGIRQAKVKNGGVIVSVDIEKAFDTIPHSVIFSRLASQGVPPLLRKIISNMYKDVYTVIEGQCIPIKRGVKQGDPLSPLLFNIAIDPVLRSLEEFQGGLPLGNSAIKILAFADDIILGASSAGQAQQMVDMLGIGLTSCGLGVSHRKCFGFQIVNKNKTWTIVDPMITLNGSSLPFSGPEDRLPYLGVDINPWDRKSRYDAGQRLISAAKRGSQLSLKPQQKINLITAFLLPKFLYILIEDPPSPAYLKSIDHDLRQIYKNILHLPNCVSTAFMYSPKRDGGLGLPRLSCLVPLAHLKAGIKLGSLQDSLVREITTSDRFVRTMGSVAHSLWASWSLTLQDIYKLKSALKRREAKAWESCVSQGQGAAQFRGDSIGNNWLHNPGTYRPGQYIEALKLRANLTGVRVNLKRSGYNVPITCRFCKDIPETQAHVLGLCPKTKGMRIQRHDSIVNRVRDKLKTKSPVALMHEQNFTVEEGQVFKPDIVTILGEVGYVIDVTVRYDDRDYIKDASVEKIRKYEALKGYLKDLYPQLNKVEVLPLVFGSRGAVPGSTVHNMGLLGFTKREMVHISRKVIADSLIISNFLEVY

SEQ ID NO: 1492 - protein, 1198 aa, synthetic construct
  source 1..1198: note = Description of Artificial Sequence: Synthetic polypeptide
MMADYNNSVDHALEDDTRFIFARDSVLARVCGHFDNLKCELCGVLLTSLQGVREHCHRSHHNLDLTFQCTKCDKGFSSYRGICCHFSKCRGARISVSEGPLSCSECERKFDSKRALSTHERHMHPGIRNAKRLKDFNPRGGGKTIHGNTKWTEEEVQLLVSLSKRFEGYKSINKEISLILTSKTCKQISDKRRYLNLHNGNGGLAAAEAVLVFCDDSHLEVTDSDGAVLSEIMDEEYYQSSLTMRSSIVHGDIGREVQGKDLVRIPPDNSVMGNCVVLLRKLATEKRSDLDLSKDKELRIDIEKATKANRESADGRVIQSVADNEIDPDTFQWKELLLGQVRGFPRVDENSELFDLDDKLTSELSSDSPVWNDNCELIVSDLCHVLCKNKYELGRQHHVRKGKRHRGIHHKREKFRECQKIFRKSPRKLAEYLYRDKDLSHISKDVSTPQGIEQYYSQLWGKPELLESNTTEEMLPSSSLFDCLPPITPEEVEGRIHKIRPSSAPGLDGVGKIHLVGKGITLVLAKLYNLLFLTGGYPECWKRNRTVFIPKIGKDLSEVGGWRPLTIGSLLARMYSAFLERRIRRVTSLSSSQRGFTNIQGCHVNLTILKEGIRQAKVKNGGVIVSVDIEKAFDTIPHSVIFSRLASQGVPPLLRKIISNMYKDVYTVIEGQCIPIKRGVKQGDPLFPLLFNIAIDPVLRSLEEFQGGLPLGNSAIKILAFDDDIILGASSAGQAQQMVDMLGIGLTSCGLGVSHRKCFGFQIVNKNKTWAIVDPMITLNGSSLPFSGPEDRLPYLGVDTNPWDRKSRYDAGQRLISAAKRGSQLSLKPQQKINLITTFLLPKFLYILIEDPPSPAYLKSIDHDLRQIYKNILHLPNCVSTAFMYSPKRDGGLGLPRLSCLVPLAHIKAGIKLGSLQDSLVREITTSDRFVRTMGSVSHSIGASWPLTLQDIYKLKSALKRREAKAWESCVSQGQGAAQFRGDSIGNNWLHNPGTFRPGQYIEALKLRANSTGVRVNLKRSGYNVPITCRFCKDIPETQAHVLGLCPKTKGMRILRHDSIVNRVRDKLKTKSPVALMHEQNFTVEEGQVFKPDIVTILGEVGYVIDVTVRYEDRDYIKDASVEKIRKYEALKGYLKDLYPQLNKVEVLPLVFGSRGAVPGSTVHNMGLLGFTKREMVHISRKVITDSLIIISNFLEVY

SEQ ID NO: 1493 - protein, 1009 aa, synthetic construct
  source 1..1009: note = Description of Artificial Sequence: Synthetic polypeptide
MSNYNETNTSGGDNPRMATQTTGSLSSGPINQHTCELCCRTFGTRAGLGQHVRKTHPIESNQSINVERKKRRWSPEEIRRMANMEAQATINNIKHLTQYLATYLPQRTLNAIKGRRRDAEYKELVTGIIANLRSNSSTQQTNQVCNESEMSQRSKILQSIRESVRDLRSRRNKYAKALQELGEAALCGKMLNEEQLIHCIKSMFNTAKCPKGPRFRKTATHSGTNKQQRQQRYARVQKLYKMNRKVAAKMVLEETDKIQIKLPDHDPMFKFWESEFKEGEGMPERMPKDLKESPDLKAIWDPVTEEEVRKAKVANNTAAGPDGIQPKSWNRISLKYKTLIYNLLLYYEKVPHKLKVSRTVFIPKKKDGSSDPGEFRPLTICSVVLRGFNKILVQRLVSLYKYDERQTAYLPIDGVGTNIHVLAAILNDSNTKLSELHVALLDITKAFNRLHHTSIIKSLVGKGFPYGFITFIRRMYTGLQTMMQFEGHCKMTQVNRGVYQGDPLSGPIFLLAIEKGLQALDKEVGYDIGDVRVNAGAYADDTDLVAGTRLGLQDNINRFSSTIKQVGLEVNPRKSMTLSLVPSGKEKKMKVETGKPFRANDVPLKELSINDFWRYLGISYTNEGPERLSLTIEQDLERLTKAPLKPQQRIHMLNAYVIPKYQDKLVLSKTTAKGLKRTDRQIRQYVRRWLKLPHDVPIAYLHAPVKSGGLNIPCLQYWIPLLRVNRVNKITESQRSVLAAVGKTALLTSTVYKCNQSLATLGGNPTMLAYRTYWEKELYAKVDGKDLQNARDDKASTRWNGMLHSDISGEDYLNYHKLRTNSVPTKVRTARGRPQKETSCRGGCKSTETLQHVVQQCHRTHGGRTLRHDRIVGLLQHELRRDYNVLAKQELKTGIGLRKPDLVLIKDDTAHIVDVQVARCSKLNESHVRKRSKYDKKEIEVEVKSRYRVSKVMYEACTISYKGIWDKQSVMSMRRLGVSEYCLFKIVTSTLRGTWLCWKRFNMITSVRS

SEQ ID NO: 1494 - protein, 1455 aa, synthetic construct
  source 1..1455: note = Description of Artificial Sequence: Synthetic polypeptide
  VARIANT 916: note = Any amino acid
  VARIANT 1141: note = Any amino acid
MAGHKITMSEGKLLEVAVRYGGVRNVSYECPVPDCTKTFSQANNLIRHLNNFGNTKHRAHNFTYFFTCEKCKIQIHSNTKHNISNHYKQCCATGGGPSCETGQYFCPACEQAGLGNLESALRHFQSSHPEFNLPPRSQFSKSHPNSYTLSLKPKDHLMKILYSGPLTPGQLVCPIKICLRSSAARLFHDVSKLRKHMLVDHNRTLVYETTCGKCLRPVDTSKNMRKTTSHFEKCSGESFISSPSPIPQKTYKLDLPSTSTPPPRKSPKLQPYKPIRTFKNPLTKSSQSKSDNPPKPTPFFSPRTLERSASWPALSEVVDPLPKLKEKHPSLPCALDKCPPSPRIKPSTLVPPCHTANNSPKPTSPESPSTLKPLPRPIRPSKPLEDWLTVRSVGPDREIVLNIGPRPRPGPAAGSRTTSPPSTAPAKRVAANPIAAPLSGEPGATLDCGQTGRKVQPPKKRPTESAGSLPPPAEPATDLLTGREGLARLVEEYHLSGDFGAFCRDLERWTALSSTNRRPKPRRGRYNRGAAARATRNRGRDDRQDPQDRDDQGGPGPVTCGRPQRYKRAAALRSAFGRDMKATVRRIIDGERGDARCEIDPKTIEGRFRDELSPPVREGPECSLPPWMAEAQAGEHAPSNDSQPGDAYDGPITALEVEMVLSTLNVGSAPGSDGLSYGFWRALDPKGLVLSELFEVCRIERRVPGPWKSSRVTLICKDAEGDLDDLGNWRPISICQTVYKIYAAVLARRLQSWALDGGVISRSQKGFMPFEGVYEHVFLLDSVVADARATRRSLAVCWLDLRNAFGSVDHTTIVEALSRFGAPAGLVEMISDIYTGGSCRIRTRAGFTPDIPVGRGVRQGCPLSGIIFNLVMEVLLRGVEANNACGYRLSCAGGASVRVLAYADDVALVGSSRAEXKIQLGVCERFAAWAGFSFNNKKCAAMVLKHQRGGRRLLDSAPLRLCGEEVAILGPDSFYKYLGAHTGYGRQTGGQLVDRVERQVVRLFTSFLTPTQKLSALKRIVLPAMSFHLRVRPCAEGHLRRLDNTVRRCVKTALRLPKGSCRAFFHTSPDAGGLGITSVVAECDILTVTQAFKMLSSPDHLVSLVAKGRLGMHAARMGRSETASACAMADYLSGDSVMGHXSWKTGYRMPADLWTATRAASRRLSLRFSPQPQGEFGLESGTFKIAPRERRSLTRRLHHRQNLWWRNQWAALPNQGKTVAAHSAYAASNNWVKGPSSLAPQALFFGLKARLNQMPTRSVKACYSRAPNYDKSCRRCGAEVETLPHVLNHCPKSMKSILERHDSVLAEVLAAIPRGTFASVDVDRTSREHFRRVGEALRPDIVARRHDGSVVVADVTCPFESCASALDTAAARKIEKYDQLCANLRQLYRKPVESHALVVGSLGSWGRTNNTALAALGIRGAVRSRLAKQLVNLSVEGSHNIWLRWSGGIPKDLVR

SEQ ID NO: 1495 - protein, 1196 aa, synthetic construct
  source 1..1196: note = Description of Artificial Sequence: Synthetic polypeptide
MLRRGRIFLPASTKAGKTRGRMKWSREVNLFIMRTYYYVTKLETDLTIYRKKLHEHFSLKYPNVIISQQRISDQKRAIERNKLLSQETLDRLKEEVRKQLEDEQTNNVENEKLNSETYSHEYTTLTPQTILTKKTQQHTNIISSTQTSHSSTQTESITLLLENEVDILNTNPTEGATQTQEVKDKFETNLTMYSGMDPKARPPLPKLKYSSKLNELIRLFNNDILVDYISPDTQLSDVHTLTYCTAVTISEQLKYKIIAIEGNARHKKNFKPPWQQRLEKDIAKLRADIGKLTQYINNNRSKKVVQSVEQIFKNTKIHTSHENGNKKSQEFLDTLKQKLALKAHRLKRYNNSQKRKNENTIFLTNEKLFYRNLIKPKTDRDNSNIDIPTAEQLEMYWARLWENSAKHNDKANWITEEKERWDTIEEMQFDDVTEEEITTITARLHNWKSPGIDKIHNFWFKKLICLHKTIAKNLTDIISGNQSIPEFIATGITYMIPKGDFSIEASQYRPITCLPTIYKILTTVITKKINSHIEHNNILAEEQKGCRRGHMGCKEQLIIDSTIMKHATTKNRNLHCTYIDYKKAFDSIPHSWLIQVLEIYKINPIIISFLRNIMTHWQTTLKLKNPPNFVTTRQIAIKKGIYQGDSLSPLWFCLALNPLSHQLHNDRAGYRIKQQDNTETIISHLIYMDDIKLYAKNDKEMKKLIDTTTIFSNDISMQFGLDKCKTVHIIKGKVQPGDYTIDDTNTITAMEPSDLYKYLGFQQLKGLDHITIKQSLTSEYKKRINAICKTKLSGKHLIKALNTYAIPILTYSFGIIKWSKTDIEQIERITRTTLTKHNNLHPKSAIERLTIKRQDGGRGMIDIWHLWRKQIHSLKTFFYIKSDLSEIHRAIAQNDNNYTPLNLKQKELIDNTENLRNRNPQKDMEENWKKKALHGRHPHDLSQSHIDSKASNMWLKTGSLFPETEGFLIAIQDQVINTKNYRKYIIKDPTIRDDKCRKCNTQPETIQHITGACSTLTQTDYTHRHNQLANIIHQQLALKHKLIQNTNTPYYNYKPQTVLENDSCKLYYDRAILTDRTIHYNRPDITLQDKNNKVTYIIDIAVPNTHNIQKTFTEKMTKYTELKEEIVRIWKQKKAYIVPIIISTTGVVPNHIHNSLKLLDLKDNIFISLQKAAILNTCRIVRKFMQLEENQTYYTQ

SEQ ID NO: 1496 - protein, 1209 aa, synthetic construct
  source 1..1209: note = Description of Artificial Sequence: Synthetic polypeptide
METRSMRKRTTRLPEEGAPTGAGPGTGDRASIQRLEDEMVQERSFSQRALPVPRTQNRNGSPINHQGNAASANVAVADRQQSLILAGGRRQRIMWTREMNHYVIRCYYVYTRMETDMPGRVKMLGMFNDRFPRFAHQLDLSKLYIRQRAIILPEELEFIKLEVRREFGEEEAGWRESSRISARLNTIDQNTSRASEDRDLDEPTAPGLSVDIQHQMATAVTQFHGTDPLSRHRLPKLHYSYRLKTAVSIINQDVLPQYLDSVGSIEDLQLIVYSAAVAVVRTLWLRTYPQGDSEGRPCSKAEKPAWMRRLENRINATRTKIGRMQEYQRGNSSMKVVRQIAEMVKPKELRDLTDANITEVLDIHLQRLSALAKRLRRYAECSKRKEQNRMFNINEREFYNWIRNDKPNFREGLPDIGDFTQFWANLCEKPVQHNSEGMRLAEDERFSDGIEDMPVLVVNAQDIREATQYTRNGAAPGPDFVYNFWYKKLITIHEQIAACFNTVLEDSRKLPKFITGGVTYFLPKDQNTKNPAKYRPLTCLSNLNKVLSSVITQKVKDHCDTNNVMTEEQTGRRKNTQGCKDQVIIDAVIVGQAAKKQRNLDMAYIDYKKAYDSVPHSYLLKVLQLYKVDGNVIKLMQHAMGMWSTSLHVTDGKVVLRSRSLNIRRGIFQGDTFSTLWFCLAMNPLSRTLNQQCNFGYLLKSEEISTRITHTFFMDDLKLFAETVQKMHHLLKNVQGFSNDIKMEFGIGKCRSIHLHRGQVLDADSFRANEQEEIRHMVQGETYKFLGFLQLRGIHYAVIKKELQDKFLHRVSCILKSFLSVGNKVKAINTFAVALLTYSFGVMKWSNTDLEALERTIRVVSTKHQMRHPKASVERVILPRKIGGVGIIDIQALCISQIHQLRSYFVESQNRHELYRTVYKADHGLSALHLAQQDYQLNCNIKTVDGKGATWKQKELHGTHTHQLNLEHIDKVSSSTWLVRCDLFCETEGFMVAIQDRVIATWNYRRCILREDVEDRCRKCNSGGESIEHVIAGCPVLAGSAYLDRHNDVAKIVHQQLALRHKLVERFLPCYRYLPDPVQENDCIKLYWDREIITDILIRANRPDILVYEKRKKRATIDIDIAVTLDHNVQTTFSTKVMKYHDLAEELKQTWYLEDIRIVPVIISATGIVPMALLRSLDELELQRELPRIQKAVILRTCSTLRRFLNPYN

SEQ ID NO: 1497 - protein, 1281 aa, synthetic construct
  source 1..1281: note = Description of Artificial Sequence: Synthetic polypeptide
MTCNNAVVFPPADGNPAGTADRNFAIRFPSSEPPGPSGIRPSEPLDGRTGIGDVEHAQAGNGGFLVDVLEYKEAHRYGSKCEFCYVQTKGTVCSKPRTDAWLKCEILFLLHHAYTANQNKSIELAESAFRRAGITRRSKATIAKRWSLIQRGKGTDYKEYWDEYFEKFRYECNPTPIVRRKRNRLAAGLQSPSSVPNGYEFERKRTCETPLDTKASSLPLICNLLTGIVGVENVEENMSVECTEPKELSGTANSSVPGLAEGVYERRHNNVNEPAAGCPQDVPVANNLIDSPTTNDRLEAEFKAQLDRAERSYMRRRLPRLKNLSPDERMWIGTTVERLRLETVSEPVCEQWRLANAGLYAAIRSIAVMRPLDAAREAHKTWLLNMKMTERKLRQQIGWVETTRRTKNEARTERQEIVYRKVAKLRRERFPEMDLDSVSVHLKRKLELLKGRIQVRTAERLRRDTREAAGPYGKTALRGQGFAPNVKDATQYWSGLAQPSGQKCSENSAILSDWKELVECNLSSLPDQMEPLVVQGISRASPWKSPGPDGIFNYYWRQDFIVDWLKQLMLDSLRTGHYPWKLSSGRTVLLYKDGDPTKAENYRPITCLNGCFKMINSVVSEVILKRVENTIALPIEQMALRRKVWACVESQIWDQIKQRKLSDRTQKCKVAWVDFSKAYDSLNHDAIKFVIGVLKLPTGINNYLLDSMQNWSTHLELKSSGKVVRGPSYPIKRGVLQGDSLSPTLFVVVTSIIVRHIKTIESSDIQMYMDDIKLYGKDQETLTRLIKELQTVSNKLGLCMNLKKCAILGDDLPEEINGIEHLKESYKYLGVPQREITQVRATMAALEKKILTEVDTSLGAAELSYRQRISRVNSKIAPLVRFVVQSMLVTPRDVLKVYNRLGGIDVEIRRRLVKYEIRYKKSNVARLYLDRKVGGIGFVNLCRIMVEAVAARAVYCRLAPSFNEFQDFLAEQNTSPITAAQTILDKCGINIELSTSTLGDVKKIVRNHYHELWLTAWKNTGLYKRWENDHVDIKRSSLWINRGNLSANNARIGIGIQDNSIFCRGFVGNKCDTKYCRLCGDGIESVSHIVTGCPTHRTNLYIERHDCVARNVYAYLAIRYGIPVPHYTQRVKTIEKNGDQSVELYWNYKFPCTRALEACRPDIVLIDKVSKRTHIIEVAVSWRGRLQEMVDRKVYKYTVNGEYEADGSSRGWNIVRELNDQYGFPVEVYTLVIGAGGEILPCTVKDVERLTGGAATDNLIERMERSAVLGSCRIIKRHLAL

SEQ ID NO: 1498 - protein, 1354 aa, synthetic construct
  source 1..1354: note = Description of Artificial Sequence: Synthetic polypeptide
  VARIANT 69: note = Any amino acid
  VARIANT 444: note = Any amino acid
  VARIANT 854: note = Any amino acid
  VARIANT 907: note = Any amino acid
MISCDLERETLTQMALFRARSDKTPTHAGIPAPDEVREGGCGQNRTNPAAPRGKAAAIQRQNGITIPIXACAQSGLVRTQRVQQWSAVEESALKDVVVRNTDDRGLINWAKGVLPEWQRLCQLNPTMYMARSSPSLSNKWASLRRTHVGPGCPSKEGSGPSQDLSDVKIQPARLAHDTVAELPQRTVPCGTDGHGVIDSDETETALAEVSRSSPFGEREPLDLGATERITRKRLRNAVRDVVPPRKRRVPSTPSRKEQDLVPEVDGPAPTDVLTHPPTESEPEPMLDPLSLVQLVRPQLGRAMGWAAEEMELGNVVMDVELKREFNREVRRVGRTPPDQMYKRGAGPPLPQKREPERVALLEQLIAARVERGINRGLDWFLELNVAVFAAARVLSRRERVETLADRLHINDSATLSEVSRRRAKAERKLRCAREQPWMSRRIRXLGVRVERLKQLADLVRQRIAGRGNRSSYEGPRRRFRLRPSLRSVTEAPVNPPLNGNEVYTFWHSLWAQSLRANTDDCQLREFKNQLSAARHTDLTSVGTSSLVQMFSAALRKMKKGKAPGPDGIRAAWWGVFRRIAPYVATWVVRVIRGAEPVANWICNGLTVLLPKSSDNADPSNYRPITCLNTCYKLFTAVIAQITASYVDVLGGLPRQQVALRKGVWGTSVSLMIDALTVADARRAKRPLGVCWFDFKKAFDSVPHNLIRWILRVIGLPPVILSVIVSVMDQWATRLKIGGKVMPKTIPVRTGVFQGDTLSPLLFCLSVWPISFALDQFPQYQFRCANHLQQGFSVGHVFYMDDLKCYCPDREVLTAVIQQVQKSASALGLTIHYKKSAWLDQDGGKSGKAVLGVPXLVGTYKYLGMHERFMIVSKDSLESVRGKFMGRLKTLWTSKLTFGQAMLGTKSXCMPVVRYVLQNLFLPKSEFNQTRLVLREWDRQIRDLLDECNIRQVFRSKTELYVSREEGGWGLPSMEDALEEEVVTKLAILVARQETEPLFRVCEALERKRCPTPLSLGLQILKDWGVGVELQGRTLLLNGNTVGPSQATRKLTGELVLRREAERLSRWRSKVKPGCGMTGGAWRDVPGIDVHLSNRWLVKGALSPTVVSNSLAIRANTVILRGSGGGYTKGTLLRCRGCGNTGETRRHIVSACSLGRQKGAASRRHDNVCRILVRAICHKLNIEPPNSANFPHVVVLEGSGAKMWIDFPFVVPHKIRHTRPDIVVLFEWNGVRRLSVIEVAVSDVANMQTQHIRKSHRYGTNSTEPFVAGVTPTYRNDCLAAQLRAKFKAQQVDVIPIIVGTTGETLDGEFGRIRKGLPMLTKLQMPRLWSEIQRAVILGSYRILVEHLALPKGGA

SEQ ID NO: 1499 - protein, 1284 aa, synthetic construct
  source 1..1284: note = Description of Artificial Sequence: Synthetic polypeptide
MKMSHNRDTPSNGVKGTSVRLGTSLVRSPVGEAGAVRERGTHPSESVSQDSDASVNATGEGSVREQAPLSPPGAEEATVPTQRRTRHKWSREDRVVLWECFVASKREGPGYLKRLKQLWDERGIPGNFPQASLSGQIRQICSKNLLSEEERLQIAARMEAQVASPSADEPARQVPTRPVTPPRSPPVEPARRPSIPSEETPDLGAVPSEIDSADPNRSPSRGPRHLPAHNMSQSESEDDVTDPDVSDQQRSDSLEPRDLLRNSSVESTPGHPNQELSDTLLSNYVPSEIDSDDPNQSPRRGPRHLPAHDMSLSDSMDEETEPDLSDQQRSDLLELRDLLRNSSVETTPKGHPSLRHLPEPKIRAAAFRVNSVIGKIHTNNITETNALIKAGADLAVRILEVQPRPQRTQRKKDPPWKHRLEKNIAEIRKHLSWISEWRRGNLHDEEKKTLLESRYRCLEVGLTNLEDTLKQRLSAKRSKVRRFEARVAGFHQNQLFNTNQKRLYQTLRGEETSSDSPNAEESIRFWSDIWSKEVRHNNTAEWLHDVKEKNVAADPDLTITSQQLKKQLSKTKNWKAPGPDMVQGYWIKTFTSLHSRIAAQLNHCLQRGTVPTWMTTGKTVLIQKDKAKGTEVSNYRPITCLPLMWKVLTGIIYERVYQHLDSKKLLPDEQKGCRRNTRGTKDHLLVDKLLTKDARSKKKNLSMAWVDYKKAFDMVPHSWILECLDIYGIAGNIRNLIATTMPNWKTQLTSANKHLGEVSIKRGIFQGDSLSPLLFVLTMIPLSETLNKAGQGYNYSRTMKLNHLLYMDDLKLYAKSKDQVEQLLNIVHQYSQDIKMQFGVSKCGVLNIERGEVTASEGITIEEGTIKDIEEAGYKYLGVMEYNTILHRTMKDSIRKEYLTRLRLILKSHLNGGNTIKAINTWAVPVVRYSAGIINWTKKDCTDMDIKTRKLMTIYRALHPRSCVDRLYINRREGGRGLISVEDCVEAEKRALSQHFRESDDPWARCLVEAKLLKETETADQFKERRRLDRTNKWKSMKMSGQYLEAVQDKIVPDSWNWLLRGELKRETEGTILAAQEQALRTRYIQNKIDKRNVPSTCRICRSSDETINHVISECGVLAQKEYKRRHDKVARHLHWTLLRIHNFPVSERWYEHEPAPVVENEAVQIYWDKRMETDRVLHANRPDIVVKDKQEKSAKLIDISIPFDSRIVDKEAEKKEKYRDLAIELQRLWQMKVDVVPVVIGALGAMSKNLKTALRELKCGHLHPGTLQKSALLGTAHIIRKVL

SEQ ID NO: 1500 - protein, 1261 aa, synthetic construct
  source 1..1261: note = Description of Artificial Sequence: Synthetic polypeptide
MVFNNCKPKHLCPAIRPTGQQETNGGSEGTAEPTAGPSRPAVSEDAAQPVPLFEEGEYIRAHRDKTCPYCEVLWIGARSSKARSDSWPLCQILYLMKRNDDLRGQRTRYPLLESSLRAAGIARTKFAIIKCIRNVLRDRYVPNGPYSEHWKIYRANSGEVPQGATITKGKRSARVAGLPSPSQSGHHTKRIQAGTGIETETTVTETNTTPEVSHEHRDPCGEPETSAANVDKVTELTEDGSETRGTANVANGGVSVSDPGRKRQSSSQNRGNIETTNPELVGMWEDMFGVQLDGAMRTTERPRLPKLKHLSEPERLWIRAKLEQAWLQCVSYDVEQQWLNANAVLYAAIRSVAASRPCKEAREAQKTWLDNKKKDEAKLRRLIGRISSVHSMPKGDRTPREKKLVKNITKLKNTHYPDMDWGGLLNHFKVKLSQLKEKISVRVAEHKRKVNRNAAGQYGKSVAGSAGLAPDVVSATAYWSGLAQPGPKKFKASSPIFQTWKDDVAKNLNTEPVLLYPIIKECIRKPSPWKAPGPDGIYNYYWQQEFVAQWIQTLVKRTLDIGRFPTALMCGRTVLLFKSGDKSMPQNYRPITCLNGCFKITNAVLTKVILQRVQDTCALPREQMALKPKVWSCMEAQLRDQALQSEIGDDCKTAWIDFSKAYDSLDHDALRFVIQTIALPAGMEEYLLKSLDSWRTQLVLSDAGKVVSGKPYPIKRGVLQGDSLSPALFVLTTSPIVAHLQRTCPTGRIQLYMDDIKLYGKTESDLCMLIKETQRVANKLGLNINLKKCALFGKSIKQSIAGFDPLGDRTYKYLGIPQRDVADIKQAYDELKAKTVQTIGETMACDYLTTRQVINRLNSKIPPVVRFVTQSALCSAPMTRGLYNKITELDNVSRAELRKVLIYKATNVSRFYLATKEGGFGYASLQQVFVEAVVSRAIYCLRAPSLCDIREFILSKFDPVKVARIALARSKIDMDIERMDMASATRTIRQHYQAKWKTLFQQSKLYQKWVQHKIDIPNSSRWLQRGEISPRNCRIAVAVQDNTLLCRGFVGSKDPNKQCRLCNAGIETASHIVTECSTHRVHMYIERHDSVARNIYAVLAKNCGFWIPHYSQKIPTVKITKSYELYWNYKFPCTQALEACRPDIVLIDRAKKRILVVEVAVSYVTRLEQMTQRKLYKYGVNGEYQADGETRGWNICRELVQKYNMRIDLCIVVIGACGEILPCMVKEIEKISKVSGRQLLERCQRSAVLGTVRTVRRHLAN

SEQ ID NO: 1501 - protein, 1360 aa, synthetic construct
  source 1..1360: note = Description of Artificial Sequence: Synthetic polypeptide
MRKSFLQHIPELSSHIAMSVPARNYPKMCSLAQGSSGTLSHNGKGVAMHRCPSDDCAGKDPPQRGSQKGNLRSVRWTPSEEKAVFEYWSRLEQHAMLNGSEARGTCAITRSQFLIHWDGERESRSLSDGVPEYPMRTERAYYERVRLLRQRGWQWDCANECLVIGQCAEPCRKPNVVAIKADKGMKRSLVKGKLLSLPHVMGEINQVSVQVEVPLPSVPASVPQVEGVESKGFTETEPSNKPSLEGNPAEEGLRKPERVNVPVHGIISDSERKDLKDRFWSAYKTAKRSVGFRPALKIEPNRVNRAQWEVLDSCVVEVLKKRETSNGYRGCVLRHLNVAVYAAGYVLAEGNKERRQVIRRQSAEWLLRQKSEINNIRRHIGWITDELTRRRTGKNPTSRQLSNFAWLQRRYQVLGKPVRETRDLEVQRERLVSRLRLAQDRINSSMDREERVRKRMLPLRRKLEEPLGDSKLDTKQARTFWASLIGERKEFGKIPELENWAEEVRSKVTDGQGFASDHVDQTVWKKILGKARPLKAPGPDGIPNLLWKRLPSANQALFKWLMGIKRKQLSVPSWLTKGRVVLLPKGGDPVDPANYRPIACLNTQYKLVTGMVTAWVSEHLTTYSILPIEQRAMVSGTWGCTHAMVIDRAITSYAEATGLPLYVGFVDFAKAFDSVSQPWIRYALKVAGVHKRIRCLIGILMKCWSVRYEVFKSGRVLRSAPLAVKNGVLQGDTLSPLLFCLSVAVVSSAVGSLFDFEVTIPGRGVMQQQNHLFYMDDFKGFAPSEASLTRMLVTLERTASALGLKINKRKCALVHPRERENEETGSDIPVLGLRDTYKYLGIEERFGIVFEDAWDRVRTKMFERMRTLLCTEHTFGELRAAFASTIAPVARYLFLNVIVGGPSWSETLTKAKDMDLRIRRLLWERRDNEPGWRFKHCSADRLYLRVQYGGLGFVSVEDTLSESIIYCWAYVQCRPELELARELFGTLNRSARSGIKQSIAKGARKVFRSYALLSKNSAQRVSDLDGDASPGFRVGEMIFMEPTRGARAIVKILRKENDSRRLAAWKGRPMGGRVVSLPELDQVHSYHWLIRARIGRRSFRDCIAAQEGQLKARELMCPHINAKAKWCRRCGDGRVETEQHILSGCAWSRTGTMLDRHNGVVRQVHTALCRKYGLPVSSHVVPLHAVIENEHAKILYDVALHTSPAGVLPREDGSTSYTGLRSTRPDMVIFDKKARTILIVEISVPWRENLVKQELIKWRKYAINSMIEPLELAEAEIPGPNLKHALGLAYGTSFPTVKVVPIVVGSCGEVLPNITKRLSELGIPKRGIPSLLESIQRAAIIGSGHVIRAHLSVPRSESET

SEQ ID NO: 1502 - protein, 1000 aa, synthetic construct
  source 1..1000: note = Description of Artificial Sequence: Synthetic polypeptide
MQKFSVPKDSSQIFLVDSILNKHICSTKNKVKDVIKRRSIIKTLICAAGLTLRKLVCGKLGNNKYNSKINQLWKKERKIINCIEDLKHLIETNKRRHNFGKRLRNAKVSPSEMLKDYYNKLRYIKNEITACLDEHKKAILRTKFKLTPSIKIISNIQNHNDEEAELPKEEEFVKYYKELFTNKDGDDKETPHLDNWLKKFSKTLIVDWTINDKEILEALKYCGNFKAPGSDMVMKVCYKWFKSAQNYLIRWIKSTWYGEYTINKKDTNAVTFMIWKRDGKPKNDVKSYRPISCLNCDFKLLNKLIANKIYESIEKILPINQMAVIKNKHGTCEALLLYKSLVQSMKFRRTKDVKEIWCSWIDFSKCYDSISHKCLKKMIQSIKAPPIIHKLILDGIDSWNISICNGKNISKTKIPVKSGILQGKVASSLYFVLLTGEISYALNKEEQVPIETITPSNTLKINHISFIDDYQLYATSQKKVEKLTIKLREIAEEMNLKLNPQKCGIYGTDDLGKRLMLKESSLNFPYTSEYKYLGLVENSLDLKDINIQLFKDKILSKYSTIFESRLTTHQKRKVFNSTISPCAAYYLGNLITNKCSIQELLNECKKFDQMVRNQLVNQNIKKLQVSNSRIYLPKEYNSLGLNEIEIEVAANIIRKACYIKKRETLRGVDKLYIAMSKNGHRNTLSDALYITKKYSNFQINWNIMGMVKDQNNILLDAKKIIENIKEKRRNLWLEHWKKGNMTYANEAIKKEFHLPDLNIDSKYLMLCYAGSEEQIIYNGHVSLVNQSSPSSRLCRKCNKLEETSYHVASVCEFHKKNLHLMRHNSAVYHIITELCRIMKVKCTLRYPEASGIIKSGNMKIAAGVKYTFGTAKIYHNKPDLVWYTPEVIYVIEVSISSLKNAKSQMKMKTARYAVNSTKKLENFAALNNLKKGENFVEILSHKANFKRVHFMPLVFCTFGEIPKETMKYLEKLNFSNEKIKTIASPIARYTGRTLKAHFTN

SEQ ID NO: 1503 - protein, 1292 aa, synthetic construct
  source 1..1292: note = Description of Artificial Sequence: Synthetic polypeptide
MISRSQADRPVEGQPVTAMSFHNLEPNNLYPENLRPTGSQDANRGVADIAEEVTGPSGLVTNEEAARAPPLFVEGEYKRAHCGGGKCHYCRVLWIGARSSKARTDSWNLCEILFLINKCMELGNVRRIYSPLESSLKEAGINRTRHAIVKCRLAVMRDRFVDNAPYSEHWRLYNACAENRAVVVPMDSATTVKKRTARQAGLESPSQIGVAGKRVHEAETGTDRINAVIETNTTPLEDIDLSPETPEGLAELPSTVEIMELTEDGSRSRGTANDADGGVSISDPLRNRPSSSQESRNVPEQVDPDGELVWESLYGAQLRGAMRTTDRPRLPKLTKFSAAEQLWIKSKVEKARLECVSYGIEQQWLRASAVLYATIKTVAACRPYNKAREAHKVWLENKRAEEKRVRRIIGRIETVRTMPKGKRTDKQIRLARKINRLKRVSFPEMDWHGFLNHFKAKLDLLKKLISVRVAEHERKISRKIAGTYGKSVSGQSGFTPDVVAATTFWSGLAQPGPKKFKKNSLIFQTWKDSVVENMNTEPVLLHPLIIECMNKPSPFKATGPDGIFNSYWRQGFIANWVKSLIQRTIQTGEFPASLMCGRTVLLYKNGDTAKPENYRPITCLNGCFKMTNAVITKVIVQRVQDTCALPGEQMALKPKVWACMEAQLRDQALQSEIGNDCKTAWIDFSKAYDSLDHDAIRFVIETLALPDGMEKYLLKSLESWKTKLVLSNRGKVATGRPYKIKRGVLQGDSLSPALFVIATSPIVSHLKRVCPSGRIQLYMDDIKLYGKSETELRMLIKEVQKVANKLGLQMNLKKCSTYGAGLTESIAGFDPLGDRAYKYLGVPQRSVADTNLAFGELEGKVIRSIEETMACEYLTMRQVVTRLNSVIGPLVRFVAQSVLTSQAKVSWIYNKISDLDSKIRAKLAQTGLRYKKSNVARLYLSKSKNGIGLVNVQQVLVEALVSRAIYCLRAPSLVEIREHILTAEFDPVGAARTVLRRSRIQLEIERVEMASAISAIKTNYQARWMTKFTQSKLYQKWVHHDIDLANSNLWLERGEISPQNARIAVAAQDNTLLCRGFVGNRESEKQCRMCNMGIETCSHILTECSYHRAHMYIERHDSVARNIYAVLAKDHGLWIPHYSQPVSSVTKTPTCELYWNYKFPCTRALEACRPDIVLIDRAKRTILIVEVAVSYVTRLKQMVSRKVYKYGVNGEKGADGESRGWNMIRELSEVYNMKVNLCAVVIGASGEVLPCTVKAIQSISSKTSSRQLLERCQRSAVLGSTRVVKRHLAEFH

SEQ ID NO: 1504 - protein, 1177 aa, synthetic construct
  source 1..1177: note = Description of Artificial Sequence: Synthetic polypeptide
MEILWEDLRLKIEDRYGVTLPQRSASSLKNQYPKVILRGLPDSGLPWAGVQVNDTGQVVVVDHAEAATLRGSSPAAVDGEAEEPVVPPLPAAEVVESAADAAVPDPQSEIVADQGVETRPVENPPANSRETETEPVEVEPYLEGQYKFFVSKILGKSMWRKPIKYPRRVPETLWRQANELIERSIRQGEVSIQSLNCMVYAAGCAVKSSLDKKDQEAKRRESEWYACRKAEIKALERYLNFIDLELKRRSASRPLTSRQRQNLGVLITKYGRARVRSGVRLSELQAMLRDALVGIRKCMAKRSADKKRKQGKFVPIQRYLEPSSAEPRLSPDTVRAYWNDIVGSSQQSTSDSTIQDWSSNLSVPSQELNASKIMGWWRAAVSKSKPNKAAGPDGIPGVLWKRFRSASEWVCTWLYRLLQKRRIITPRWLSVGRVVLLPKKGPLEDPANYRPIACLNTVYKLITSVVEMAVREQIQACPGLVPYEQIANRKGVWGCTHASIVDRMITGASREGKGGGFPDLRVLFYDCKKAFDSVNRDHMFAVLRVANVNVKVVHLLHTLSQQWCVRYELRRNNRVERSSPLRVKRGLLQGDTLSPTWFCLCMAPISASIKTLNPGPTLRPNMGNGRNRGQVAIQVSHVFYMDDLKVYCPRVADQRRMEQNIPQLFGEIGLSINASKSAAAAAVGRYVESELPVLGTKDEYKYLGIESGFVVNEVAALDRMQAVLLNRVEAILSVKEHTVGQRRDAIRAKAIPGGAYILGHIILSDLDPRGAAERMRRLDIEIRRLVKSAGILHDKCSTARIHLSCEQGGLAWPSMERAYYVAVAYSASYLLTSQDETISRARDYFVSGRLSNKFTVYKHLTSIVDSLGLSVELPDPNGLPTGQPSVLARTIARAIDAKLEAQWKETLLTYQRAGRVERADPTVVDHANSYHWLRKAWINEKAYQHAVSVMEGTLLEGVNPHGVLTMCRACKAPSASIAHIITGCAELRKSHMKVRHDGVTRWLYNALTEVDGSLPKFHYTQQIPAEMRGERLTVRYDSDIVTPNKPRHNRPDLVVFDSTRKVIYIVEVSVTWLSVLQKQYDNKLNRYAVNSNHEFSESIPYPPGVNLANEIRVLYPQFTGGVKVFPMIISPTGEVHMQFVPHLAELLENPNIPRILEKIQRSVVLGTDYIIRSYFAM

SEQ ID NO: 1505 - protein, 1353 aa, synthetic construct
  source 1..1353: note = Description of Artificial Sequence: Synthetic polypeptide
MPCSTNSFFERGTPEPHREPISGTDSSESLGMGTHRSPRLNDDEVINGPKGHESDPVHVVRAPRTLHPRRLELPIGVNNLGEASQLRQDSAIAEEAQLESTENHDGRRPPLRGGRKLWSEKEIATLRRLCEAYGNRQVCWKEVQRKFADFHEERTVAALATKWGALKRPRAPMVGAPPTPDHDPERGPAGEGDGGTTSQENVPTDDPIPANGPTEGKESDVRPAVACRCTEPEEQLMESDVRPPAVVRLADPEQHTMKSGVKPVALDGSADLEERPKEKDIEQMGVDFEGEPRFRAFRKAFYGYFRWAVNSFDREPVKRVRRDCPKVFYAYADYLIATGSSKALGPNQSRIGRLNGLVYAAARTIHQFWREEVGHRQQGEKGWYTKTKATREDLQMLISMMESELARRKEKRKPGAKELENIHKLVARLGTRSTSGIVRRLEMTRQRLKLLEDRISLHEQEKRRKRLRKQFAETPSLKLLTKGAKDRGDTMVTMKSVMDFWRPIIGRRVTSNPDQLQVLRDWRDEQKKAYPADLDLEKADLEEKYEGAIRRIQPWKAPGPDGLHAHWWKALPSAKRLLGELVVDWLTTGKVTTGWMCRGRTILIPKKGDRGDPSNYRPITCLNTCYKVLTSVMNSVILSHLSRGEALPMNQRAMRKREWGCTHAMVLDRAMVMDAMAQKKHSLSVAWLDYRKAYDSVSHEYIRWAINSVNIPRSVQLTLKRLMSDWETRFESTQCRPKLRSDKMKVLNGIFQGDSLSPTLFVLCIAPISYALNKGVGQCQSSSGWSAGYGFEIGHQFYMDDLKLYARTPAMLDSQIQVVSEVSEAMGLHLNLSKCAKAHYAPHGAGGAQEAVEGAEGSRKGEIPILGLRSTYKYLGVEQRLLPMEVALKEFEDKFMDRAETIFASELTWGQMATAYNTIAIAGLRYVYSNTNGASPKLLEALKRAATLDTRIRDLLRRHKCRFRNSFVERLYIPRECGGYGLKSVEDTLRESILATWSYIATNPHLAGQQYFFERLAARGKRTPMADGVKILLDLGVEPQVDLKRRTVTVDGIVFEDPTKLHRYLVGKLLKARTEARIRRWKEASLAGRLVNDTSIDMRLSCLWMKKGFVSARNLRDALAVQEGSLLTRACPALKGKGGQEVCRCCHAAPETAEHITSACRYWLPSLYVERHDSVARNLYYVICCRYGITPVHYSNRVSPLSENSQCRVLWNMDMQTRTPMKHRKPDIVVFDLKREKILMFEVSIAHASGLLKQREIKINRYTVNSEELPDETITPYPPGPNLAADLAATYGWQVEFAPVVVGTCGEHVPAVKEDLQRTLDLKPHQVEALLERISRSAVIGTARVVRAHLACS

SEQ ID NO: 1506 - protein, 1368 aa, synthetic construct
  source 1..1368: note = Description of Artificial Sequence: Synthetic polypeptide
  VARIANT 435: note = Any amino acid
  VARIANT 572: note = Any amino acid
  VARIANT 607: note = Any amino acid
  VARIANT 611: note = Any amino acid
  VARIANT 757: note = Any amino acid
  VARIANT 1272: note = Any amino acid
ITYTANMALVTLFMENMENKRYNLRPLPGGRRGASGANAGCHSMRTVGDGGLSRRVPLEKNVTAEQSSSPLTSSSSHSPVSSIPSPSSTRTLLNSPNSSPTSSHSSLVIRSADVVQEALANYPAPTAGSIRARKKWTDIMNRYIWRTYLIITKCETTLLNNYLEPLHQEFSSKFPEMQVTRQRIGDQRRAIIRNKLLSDDTLAQILIEVKELLQIGDQPLTQNNIHSTQLSHSNTRIKWSNELNEEIVKCYFEVTLLEVNKTSYRKNLYSLFISRNPHLSHLTEQRIADQRRLIFMNKSVHNDRIIELKREVEIKLANSNSLTKNITESNSPSSQTNEINDSAYVQSNLQPVEPLDQHCINRHNLIEKHYVEQEFNNALIQFNNTNPETRPYIPRQKSSRKFSQIVSFLNSEVLPKHLNNELDFNALHNIIYTAXYTASLCNGTKFSFIDNYRPRNSKPSWQRRLESRIDKYRLQIGRLTQYISGNRNRKILKTVEEIKTQYKIHSHHEEPNTELPHFLDTLKQKLNATSNRLRRYLTCTKRKQQNNTFVNNEKHFYRTLSSTNQNTTTQLXEHPTENNLQQYWANIWETSIEHNADAEWLNKIPDXEINXMKFKDISIETFNQIIQRTHNWKAPGTDNIHNYWYKKLTCTHSLLLKHINQFIQSPCTLPLFITNGITYMLPKGLDPTNPANYRPITCLQTIYKIITACITDIIYKHIDQNNILAEQQKGCRKNSQGCKEQLTIDAIVMKQAHNKNXNTMYIDYRKAFDSVPHSWLLYILKKYKIHPILITFLSSVMLSWKTRLKLINNNETLITDWIKIQRGIFQGDALSPLWFCLALNPLSELLNNTNTGFKLKHNNTYHIISHLMYMDDIKLYASNNKELKILADLTQSFSTDIRMEFGIEKCKVHSIKRGKSQQNTYILNTGEQIESMDENSTYKYLGFQQAKQIQQKQTKIELTNKFKFRLNQILRSQLNSRNIIKAINTYAIPILTYSFAIINWSQTDLSNLQRIINTHMTTHRKHHPKSCIQRLTISRLDGGRGLIDIRNLHNNLVTKFRNYFYAKAEISELHKFIVNIDNKYTPLNLNDRNIQLNQTLITKQQKIEAWSLKSLHGRHLADLSQTHVDKVASNEWLRRGDLFPETEAFMMAIQDQVIDTRNYQKHIIKRPNMVNDLCRRCYSSPETIQHITGACKTIVQTDYKHRHDQVAAIIHQHLAFKHSLITQAQKTPYYKYSPQAILESTNFKLYWDRTIITDKTVHYNRPDILLHDKVKXSVYLIDIAIPNTHNLASTFSNKIDKYTDLTIELKSQWKVQSVTTVPIVLSTTGVVPHTLHTSLETLGIHRLSYILLQKAAILNTCRIVRKFLSSNN

SEQ ID NO: 1507 - protein, 1136 aa, synthetic construct
  source 1..1136: note = Description of Artificial Sequence: Synthetic polypeptide
  VARIANT 5: note = Any amino acid
  VARIANT 131: note = Any amino acid
  VARIANT 269: note = Any amino acid
  VARIANT 354: note = Any amino acid
MSGTXTDRVIPARTSPGSTRSASGVGEPGPPDVKLATGTRHSWSRAENVVLMECYYGSNPSERGYMQRMWEKWVLRNPTSSLTKKQLLAQCSNIRNKKLLSQLEIDEARRCASPTVQICYGKGEPGRQVSXGVISSSPPNIEIGYKAPMTDGLGTRAADLRERIMKSWGNSTTSLPRLTHKVPDQSLLEDMNTALSTIPTTTITETNQLMYAAATVILQMLGYKMKSMNSQKEQMAPWRRRLEAKIMATRREVSLLTELSRGVNLRTEXPKKYNKLSTTEALETAKQRLTALATRLKRYTREVEARRINKVFSTNPAKVYSQWQGNKMTTDPPRAETEQYWKSIWEKEATHNTXAQWLQDLQTEHSQLPEQDPVVITLADIQTRVSKMKSWTAPGPDKIHAYWLKKLTALHERLAAQMNQLLTSGNHPEWLTQGRTVLIMKDPQKGTIPSNYRPITCLSTTWKLLSGIIAAKISRHMDQYMSRAQKGIGNNTRGAKHQLLVDRAIAQDCRTRHTNLCTAWIDYKKAYDSMPHTWILECLKLYNINRTLREFIQNSMKLWNTTLEANSKPIARVSIRCGIYQGDALSPLLFCIGLNPLSQIITKSGYGYQFRSGTTVSHLLYMDDIKLYAKNERDIDSLIHLTRIYSKDIGMSFGLDKCGRMISRRGKVIATDGVELPEGNITDVQDSYKYLGIPQANGNHEEAARRSATAKYLQRLRQVLKSQLNGKNKIQAINTYALPVIRYPAGIIPWPLEEIQATDIKTRKLNGKHKIQAINTYALPVIRYPAGIIPWPLEEIQATDIKTRKLLTMHGGFHPKSSVLRLYTKRKEGGRGLVSVRTTVQEETTSLREYIKKMAPTDRLLSECLRQQKPTKEEEPEGLSWKDKPLHGMYHRQIEEVADIEKTYQWLEKAGLKDSTEALLMAAQEQALSTRAIEARVYHTRQDPRCRLCGDAPETVQHITAGCKMLAGKAYMERHNQVAGIVYRNICTEYGLEVPGSRWETPPKVLENKQAKILWDFQIQTDKMVVANQPDIVVVDKHQKTVVVIDVAIPSDSNIRKKEHEKLEKYQGLKEEMERMWGMKATVVPVVIGTLGAVTPKLSRWLQQIPGTTSEISVQKSAVLGTAKILRRTLRLPGLW

SEQ ID NO: 1508 - DNA, 250 bp, Homo sapiens
  source 1..250: mol_type = unassigned DNA
ccggtcccccccgccgggtccgcccccggggccgcggttccgcgcggcgcctcgcctcggccggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaag

SEQ ID NO: 1509 - DNA, 250 bp, Homo sapiens
  source 1..250: mol_type = unassigned DNA
gcggttccgcgcggcgcctcgcctcggccggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacg

SEQ ID NO: 1510 - DNA, 250 bp, Homo sapiens
  source 1..250: mol_type = unassigned DNA
tcccccccgccgggtccgcccccggggccgcggttccgcgcggcgcctcgcctcggccggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtag

SEQ ID NO: 1511 - DNA, 250 bp, Homo sapiens
  source 1..250: mol_type = unassigned DNA
cggcgcgctcgccggccgaggtgggatcccgaggcctctccagtccgccgagggcgcaccaccggcccgtctcgcccgccgcgccggggaggtggagcacgagcgcacgtgttaggacccgaaagatggtgaactatgcctgggcagggcgaagccagaggaaactctggtggaggtccgtagcggtcctgacgtgcaaatcggtcgtccgacctgggtataggggcgaaagactaatcgaaccatctag

SEQ ID NO: 1512 - DNA, 250 bp, Homo sapiens
  source 1..250: mol_type = unassigned DNA
gcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagc

SEQ ID NO: 1513 - DNA, 250 bp, Homo sapiens
  source 1..250: mol_type = unassigned DNA
gtagccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccg

SEQ ID NO: 1514 - DNA, 250 bp, Homo sapiens
  source 1..250: mol_type = unassigned DNA
cgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccggccctgcgggccgccggtgaaataccactactc

SEQ ID NO: 1515 - DNA, 250 bp, Homo sapiens
  source 1..250: mol_type = unassigned DNA
ccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccggccc

SEQ ID NO: 1516 - DNA, 250 bp, Homo sapiens
  source 1..250: mol_type = unassigned DNA
tagctggttccctccgaagtttccctcaggatagctggcgctctcgcagacccgacgcacccccgccacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgcc

SEQ ID NO: 1517 - DNA, 250 bp, Homo sapiens
  source 1..250: mol_type = unassigned DNA
tgaaacttaaaggaattgacggaagggcaccaccaggagtggagcctgcggcttaatttgactcaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtccc

SEQ ID NO: 1518 - DNA, 250 bp, Homo sapiens
  source 1..250: mol_type = unassigned DNA
tagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccct

SEQ ID NO: 1519 - DNA, 250 bp, Homo sapiens
  source 1..250: mol_type = unassigned DNA
ccccccgccgggtccgcccccggggccgcggttccgcgcggcgcctcgcctcggccggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagcc

SEQ ID NO: 1520 - DNA, 250 bp, Homo sapiens
  source 1..250: mol_type = unassigned DNA
gcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagctgaaacttaaaggaattgacggaagggcaccaccaggagt

SEQ ID NO: 1521 - DNA, 250 bp, Homo sapiens
  source 1..250: mol_type = unassigned DNA
ggccgggcgcgacccgctccggggacagtgccaggtggggagtttgactggggcggtacacctgtcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggat

SEQ ID NO: 1522 - DNA, 19 bp, Homo sapiens
  source 1..19: mol_type = unassigned DNA
gtctacggccataccaccc

SEQ ID NO: 1523 - DNA, 38 bp, Homo sapiens
  source 1..38: mol_type = unassigned DNA
atcgcttctcggccttttggctaagatcaagtgtagta

SEQ ID NO: 1524 - DNA, 250 bp, Homo sapiens
  source 1..250: mol_type = unassigned DNA
acctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccggccctgcgggccgccggtgaaataccactactctgatcgttttttcactgacccggtgaggcgggggg

SEQ ID NO: 1525 - DNA, 250 bp, Homo sapiens
  source 1..250: mol_type = unassigned DNA
aaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccggccctg

SEQ ID NO: 1526 - DNA, 250 bp, Homo sapiens
  source 1..250: mol_type = unassigned DNA
ggagcctgcggcttaatttgactcaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgag

SEQ ID NO: 1527 - DNA, 250 bp, Homo sapiens
  source 1..250: mol_type = unassigned DNA
aactggcttgtggcggccaagcgttcatagcgacgtcgctttttgatccttcgatgtcggctcttcctatcattgtgaagcagaattcaccaagcgttggattgttcacccactaatagggaacgtgagctgggtttagaccgtcgtgagacaggttagttttaccctactgatgatgtgttgttgccatggtaatcctgctcagtacgagaggaaccgcaggttcagacatttggtgtatgtgcttggc

SEQ ID NO: 1528 - DNA, 102 bp, Homo sapiens
  source 1..102: mol_type = unassigned DNA
tgaacgcgcccgatctcgtctgatctcggaagctaagcagggtcgggcctggttagtacttggatgggagaccgcctgggaataccgggtgctgtaggcttt

SEQ ID NO: 1529 - DNA, 150 bp, Homo sapiens
  source 1..150: mol_type = unassigned DNA
tctgttcttatcagtttaatatctgatacgtcctctatccgaggacaatatattaaatggatttttggagcagggagatggaataggagcttgctccgtccactccacgcatcgacctggtattgcagtacctccaggaacggtgcaccc

SEQ ID NO: 1530 - protein, 25 aa, synthetic construct
  source 1..25: note = Description of Artificial Sequence: Synthetic peptide
KRASSQALGTIPKRRSSSRFIKRKK

SEQ ID NO: 1531 - protein, 7 aa, synthetic construct
  source 1..7: note = Description of Artificial Sequence: Synthetic polypeptide
RKKRKKK

SEQ ID NO: 1532-1533 - skipped (2 entries)

SEQ ID NO: 1534 - protein, 5 aa, synthetic construct
  source 1..5: note = Description of Artificial Sequence: Synthetic peptide
EAAAK

SEQ ID NO: 1535 - protein, 5 aa, synthetic construct
  source 1..5: note = Description of Artificial Sequence: Synthetic peptide
GGGGS

SEQ ID NO: 1536 - protein, 4 aa, synthetic construct
  source 1..4: note = Description of Artificial Sequence: Synthetic peptide
  REGION 1..4: note = See specification as filed for detailed description of substitutions and preferred embodiments
GGGS

SEQ ID NO: 1537 - protein, 5 aa, unidentified
  source 1..5: note = Description of Unknown:Thrombin-sensitive sequence
CPRSC

SEQ ID NO: 1538 - protein, 18 aa, Thosea asigna virus
EGRGSLLTCGDVEENPGP

SEQ ID NO: 1539 - protein, 19 aa, Teschovirus A
ATNFSLLKQAGDVEENPGP

SEQ ID NO: 1540 - protein, 20 aa, Equine rhinitis A virus
QCTNYALLKLAGDVESNPGP

SEQ ID NO: 1541 - protein, 22 aa, Foot-and-mouth disease virus
VKQTLNFDLLKLAGDVESNPGP

SEQ ID NO: 1542 - protein, 4 aa, unidentified
  source 1..4: note = Description of Unknown:RT domain motif sequence
YADD

SEQ ID NO: 1543 - protein, 4 aa, unidentified
  source 1..4: note = Description of Unknown:RT domain motif sequence
YMDD

SEQ ID NO: 1544 - protein, 4 aa, synthetic construct
  source 1..4: note = Description of Artificial Sequence: Synthetic peptide
YVDD

SEQ ID NO: 1545 - protein, 1145 aa, unidentified
  source 1..1145: note = Description of Unknown:Porcine endogenous retrovirus sequence
MGATGQQQYPWTTRRTVDLGVGRVTHSFLVIPECPAPLLGRDLLTKMGAQISFEQGKPEVSANNKPITVLTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLPMIETPKAPEPGRQYTLEDWQEIKKIDQFSETPEGTCYTSDGKEILPHKEGLEYVQQIHRLTHLGTKHLQQLVRTSPYHVLRLPGVADSVVKHCVPCQLVNANPSRIPPGKRLRGSHPGAHWEVDFTEVKPAKYGNKYLLVFVDTFSGWVEAYPTKKETSTVVAKKILEEIFPRFGIPKVIGSDNGPAFVAQVSQGLAKILGIDWKLHCAYRPQSSGQVERMNRTIKETLTKLTAETGVNDWIALLPFVLFRVRNTPGQFGLTPYELLYGGPPPLVEIASVHSADVLLSQPLFSRLKALEWVRQRAWRQLREAYSGGGDLQIPHRFQVGDSVYVRRHRAGNLETRWKGPYHVLLTTPTAVKVEGISTWIHASHVKPAPPPDSGWKAEKTENPLKLRLHRVVPYSVNNFSS

SEQ ID NO: 1546 - protein, 1149 aa, Cynomolgus macaque simian foamy virus
MDPLQLLQPLEAEIKGTKLKAHWDSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHCNTTPSLDAELDQLLQGHYPPGYPKQYKYTLEENKLIVERPNGIRIVPPKADREKIISTAHNIAHTGRDATFLKVSSKYWWPNLRKDVVKSIRQCKQCLVTNATNLTSPPILRPVKPLKPFDKFYIDYIGPLPPSNGYLHVLVVVDSMTGFVWLYPTKAPSTSATVKALNMLTSIAIPKVLHSDQGAAFTSSTFADWAKEKGIQLEFSTPYHPQSSGKVERKNSDIKRLLTKLLIGRPAKWYDLLPVVQLALNNSYSPSSKYTPHQLLFGVDSNTPFANSDTLDLSREEELSLLQEIRSSLHQPTSPPASSRSWSPSVGQLVQERVARPASLRPRWHKPTAILEVVNPRTVIILDHLGNRRTVSVDNLKLTAYQDNGTSNDSGTMALMEEDESSTSST

SEQ ID NO: 1547 - protein, 1771 aa, Mason-Pfizer monkey virus
MGQELSQHERYVEQLKQALKTRGVKVKYADLLKFFDFVKDTCPWFPQEGTIDIKRWRRVGDCFQDYYNTFGPEKVPVTAFSYWNLIKELIDKKEVNPQVMAAVAQTEEILKSNSQTDLTKTSQNPDLDLISLDSDDEGAKSSSLQDKGLSSTKKPKRFPVLLTAQTSKDPEDPNPSEVDWDGLEDEAAKYHNPDWPPFLTRPPPYNKATPSAPTVMAVVNPKEELKEKIAQLEEQIKLEELHQALISKLQKLKTGNETVTHPDTAGGLSRTPHWPGQHIPKGKCCASREKEEQIPKDIFPVTETVDGQGQAWRHHNGFDFAVIKELKTAASQYGATAPYTLAIVESVADNWLTPTDWNTLVRAVLSGGDHLLWKSEFFENCRDTAKRNQQAGNGWDFDMLTGSGNYSSTDAQMQYDPGLFAQIQAAATKAWRKLPVKGDPGASLTGVKQGPDEPFADFVHRLITTAGRIFGSAEAGVDYVKQLAYENANPACQAAIRPYRKKTDLTGYIRLCSDIGPSYQQGLAMAAAFSGQTVKDFLNNKNKEKGGCCFKCGKKGHFAKNCHEHAHNNAEPKVPGLCPRCKRGKHWANECKSKTDNQGNPIPPHQGNRVEGPAPGPETSLWGSQLCSSQQKQPISKLTRATPGSAGLDLCSTSHTVLTPEMGPQALSTGIYGPLPPNTFGLILGRSSITMKGLQVYPGVIDNDYTGEIKIMAKAVNNIVTVSQGNRIAQLILLPLIETDNKVQQPYRGQGSFGSSDIYWVQPITCQKPSLTLWLDDKMFTGLIDTGADVTIIKLEDWPPNWPITDTLTNLRGIGQSNNPKQSSKYLTWRDKENNSGLIKPFVIPNLPVNLWGRDLLSQMKIMMCSPNDIVTAQMLAQGYSPGKGLGKKENGILHPIPNQGQSNKKGFGNFLTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAIPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKGDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINTNLESAQNAHTLHHLNAQTLRLMFNIPREQARQIVKQCPICVTYLPVPHLGVNPRGLFPNMIWQMDVTHYSEFGNLKYIHVSIDTFSGFLLATLQTGETTKHVITHLLHCFSIIGLPKQIKTDNGPGYTSKNFQEFCSTLQIKHITGIPYNPQGQGIVERAHLSLKTTIEKIKKGEWYPRKGTPRNILNHALFILNFLNLDDQNKSAADRFWHNNPKKQFAMVKWKDPLDNTWHGPDPVLIWGRGSVCVYSQTYDAARWLPERLVRQVSNNNQSRE

SEQ ID NO: 1548 - protein, 1755 aa, Mouse mammary tumor virus
MGVSGSKGQKLFVSVLQRLLSERGLHVKESSAIEFYQFLIKVSPWFPEEGGLNLQDWKRVGREMKRYAAEHGTDSIPKQAYPIWLQLREILTEQSDLVLLSAEAKSVTEEELEEGLTGLLSTSSQEKTYGTRGTAYAEIDTEVDKLSEHIYDEPYEEKEKADKNEEKDHVRKIKKVVQRKENSEGKRKEKDSKAFLATDWNDDDLSPEDWDDLEEQAAHYHDDDELILPVKRKVVKKKPQALRRKPLPPVGFAGAMAEAREKGDLTFTFPVVFMGESDEDDTPVWEPLPLKTLKELQSAVRTMGPSAPYTLQVVDMVASQWLTPSDWHQTARATLSPGDYVLWRTEYEEKSKEMVQKAAGKRKGKVSLDMLLGTGQFLSPSSQIKLSKDVLKDVTTNAVLAWRAIPPPGVKKTVLAGLKQGNEESYETFISRLEEAVYRMMPRGEGSDILIKQLAWENANSLCQDLIRPIRKTGTIQDYIRACLDASPAVVQGMAYAAAMRGQKYSTFVKQTYGGGKGGQGAEGPVCFSCGKTGHIRKDCKDEKGSKRAPPGLCPRCKKGYHWKSECKSKFDKDGNPLPPLETNAENSKNLVKGQSPSPAQKGDGVKGSGLNPEAPPFTIHDLPRGTPGSAGLDLSSQKDLILSLEDGVSLVPTLVKGTLPEGTTGLIIGRSSNYKKGLEVLPGVIDSDFQGEIKVMVKAAKNAVIIHKGERIAQLLLLPYLKLPNPVIKEERGSEGFGSTSHVHWVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTALESAQESHALHHQNAAALRFQFHITREQAREIVKLCPNCPDWGHAPQLGVNPRGLKPRVLWQMDVTHVSEFGKLKYVHVTVDTYSHFTFATARTGEATKDVLQHLAQSFAYMGIPQKIKTDNAPAYVSRSIQEFLARWKISHVTGIPYNPQGQAIVERTHQNIKAQLNKLQKAGKYYTPHHLLAHALFVLNHVNMDNQGHTAAERHWGPISADPKPMVMWKDLLTGSWKGPDVLITAGRGYACVFPQDAETPIWVPDRFIRPFTERKEATPTPGTAEKTPPRDEKDQQESPKNESSPHQREDGLATSAGVDLRSGGGP

SEQ ID NO: 1549 - protein, 1738 aa, Murine leukemia virus
MGQTVTTPLSLTLGHWKDVERIAHNQSVDVKKRRWVTFCSAEWPTFNVGWPRDGTFNRDLITQVKIKVFSPGPHGHPDQVPYIVTWEALAFDPPPWVKPFVHPKPPPPLPPSAPSLPLEPPRSTPPRSSLYPALTPSLGAKPKPQVLSDSGGPLIDLLTEDPPPYRDPRPPPSDRDGNGGEATPAGEAPDPSPMASRLRGRREPPVADSTTSQAFPLRAGGNGQLQYWPFSSSDLYNWKNNNPSFSEDPGKLTALIESVLITHQPTWDDCQQLLGTLLTGEEKQRVLLEARKAVRGDDGRPTQLPNEVDAAFPLERPDWDYTTQAGRNHLVHYRQLLLAGLQNAGRSPTNLAKVKGITQGPNESPSAFLERLKEAYRRYTPYDPEDPGQETNVSMSFIWQSAPDIGRKLERLEDLKNKTLGDLVREAEKIFNKRETPEEREERIRRETEEKEERRRTEDEQKEKERDRRRHREMSKLLATVVSGQKQDRQGGERRRSQLDRDQCAYCKEKGHWAKDCPKKPRGPRGPRPQTSLLTLDDQGGQGQEPPPEPRITLKVGGQPVTFLVDTGAQHSVLTQNPGPLSDKSAWVQGATGGKRYRWTTDRKVHLATGKVTHSFLHVPDCPYPLLGRDLLTKLKAQIHFEGSGAQVMGPMGQPLQVLTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPYTSEHFHYTVTDIKDLTKLGAIYDKTKKYWVYQGKPVMPDQFTFELLDFLHQLTHLSFSKMKALLERSHSPYYMLNRDRTLKNITETCKACAQVNASKSAVKQGTRVRGHRPGTHWEIDFTEIKPGLYGYKYLLVFIDTFSGWIEAFPTKKETAKVVTKKLLEEIFPRFGMPQVLGTDNGPAFVSKVSQTVADLLGIDWKLHCAYRPQSSGQVERMNRTIKETLTKLTLATGSRDWVLLLPLALYRARNTPGPHGLTPYEILYGAPPPLVNFPDPDMTRVTNSPSLQAHLQALYLVQHEVWRPLAAAYQEQLDRPVVPHPYRVGDTVWVRRHQTKNLEPRWKGPYTVLLTTPTALKVDGIAAWIHAAHVKAADPGGGPSSRLTWRVQRSQNPLKIRLTREAP

SEQ ID NO: 1550 - protein, 1462 aa, unidentified
  source 1..1462: note = Description of Unknown:Human T-cell leukemia virus 1 sequence
MGQIFSRSASPIPRPPRGLAAHHWLNFLQAAYRLEPGPSSYDFHQLKKFLKIALETPARICPINYSLLASLLPKGYPGRVNEILHILIQTQAQIPSRPAPPPPSSPTHDPPDSDPQIPPPYVEPTAPQVLPVMHPHGAPPNHRPWQMKDLQAIKQEVSQAAPGSPQFMQTIRLAVQQFDPTAKDLQDLLQYLCSSLVASLHHQQLDSLISEAETRGITGYNPLAGPLRVQANNPQQQGLRREYQQLWLAAFAALPGSAKDPSWASILQGLEEPYHAFVERLNIALDNGLPEGTPKDPILRSLAYSNANKECQKLLQARGHTNSPLGDMLRACQTWTPKDKTKVLVVQPKKPPPNQPCFRCGKAGHWSRDCTQPRPPPGPCPLCQDPTHWKRDCPRLKPTIPEPEPEEDALLLDLPADIPHPKNLHRGGGLTSPPTLQQVLPNQDPASILPVIPLDPARRPVIKAQVDTQTSHPKTIEALLDTGADMTVLPIALFSSNTPLKNTSVLGAGGQTQDHFKLTSLPVLIRLPFRTTPIVLTSCLVDTKNNWAIIGRDALQQCQGVLYLPEAKRPPVILPIQAPAVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFEMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLSPAELHSFTHCGQTALTLQGATTTEASNILRSCHACRGGNPQHQMPRGHIRRGLLPNHIWQGDITHFKYKNTLYRLHVWVDTFSGAISATQKRKETSSEAISSLLQAIAHLGKPSYINTDNGPAYISQDFLNMCTSLAIRHTTHVPYNPTSSGLVERSNGILKTLLYKYFTDKPDLPMDNALSIALWTINHLNVLTNCHKTRWQLHHSPRLQPIPETRSLSNKQTHWYYFKLPGLNSRQWKGPQEALQEAAGAALIPVSASSAQWIPWRLLKRAACPRPVGGPADPKEKDLQHHG

SEQ ID NO: 1551 - protein, 1143 aa, unidentified
  source 1..1143: note = Description of Unknown:Human spumaretrovirus sequence
MNPLQLLQPLPAEIKGTKLLAHWDSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNCNTKKPNLDAELDQLLQGHYIKGYPKQYTYFLEDGKVKVSRPEGVKIIPPQSDRQKIVLQAHNLAHTGREATLLKIANLYWWPNMRKDVVKQLGRCQQCLITNASNKASGPILRPDRPQKPFDKFFIDYIGPLPPSQGYLYVLVVVDGMTGFTWLYPTKAPSTSATVKSLNVLTSIAIPKVIHSDQGAAFTSSTFAEWAKERGIHLEFSTPYHPQSGSKVERKNSDIKRLLTKLLVGRPTKWYDLLPVVQLALNNTYSPVLKYTPHQLLFGIDSNTPFANQDTLDLTREEELSLLQEIRTSLYHPSTPPASSRSWSPVVGQLVQERVARPASLRPRWHKPSTVLKVLNPRTVVILDHLGNNRTVSIDNLKPTSHQNGTTNDTATMDHLEKNE

SEQ ID NO: 1552 - protein, 1416 aa, Bovine leukemia virus
MGNSPSYNPPAGISPSDWLNLLQSAQRLNPRPSPSDFTDLKNYIHWFHKTQKKPWTFTSGGPTSCPPGRFGRVPLVLATLNEVLSNEGGAPGASAPEEQPPPYDPPAILPIISEGNRNRHRAWALRELQDIKKEIENKAPGSQVWIQTLRLAILQADPTPADLEQLCQYIASPVDQTAHMTSLTAAIAAAEAANTLQGFNPKTGTLTQQSAQPNAGDLRSQYQNLWLQAGKNLPTRPSAPWSTIVQGPAESSVEFVNRLQISLADNLPDGVPKEPIIDSLSYANANRECQQILQGRGPVAAVGQKLQACAQWAPKNKQPALLVHTPGPKMPGPRQPAPKRPPPGPCYRCLKEGHWARDCPTKATGPPPGPCPICKDPSHWKRDCPTLKSKNKLIEGGLSAPQTITPITDSLSEAELECLLSIPLARSRPSVAVYLSGPWLQPSQNQALMLVDTGAENTVLPQNWLVRDYPRIPAAVLGAGGVSRNRYNWLQGPLTLALKPEGPFITIPKILVDTSDKWQILGRDVPSRLQASISIPEEVRPPVVGVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPTHPPHIICLDLKDAFFQIPVEDRFRFYLSFTLPSPGGLQPHRRFAWRVLPQGFINSPALFERALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTLVLGAWLQPDPVPSYALLYKSLLRHPAIVVGHVRSHSSASHPIASLNNYVDQLLPLETPEQWHKLTHCNSRALSRWPNPRISAWDPRSPATLCETCQKLNPTGGGKMRTIQRGWAPNHIWQADITHYKYKQFTYALHVFVDTYSGATHASAKRGLTTQTTIEGLLEAIVHLGRPKKLNTDQGANYTSKTFVRFCQQFGVSLSHHVPYNPTSSGLDERTNGLLKLLLSKYHLDEPHLPMTQALSRALWTHNQINLLPILKTRWELHHSPPLAVISEGGETPKGSDKLFLYLLPGQNNRRWLGPLPALVEASGGALLATDPPVWVPWRLLKAFKCLKNDGPEDAHNRSSDG

SEQ ID NO: 1553 - protein, 1220 aa, Bovine foamy virus
MPALRPLQVEIKGNHLKGYWDSGAEITCVPAIYIIEEQPVGKKLITTIHNEKEHDVYYVEMKIEKRKVQCEVIATALDYVLVAPVDIPWYKPGPLELTIKIDVESQKHTLITESTLSPQGQMRLKKLLDQYQALWQCWENQVGHRRIEPHKIATGALKPRPQKQYHINPRAKADIQIVIDDLLRQGVLRQQNSEMNTPVYPVPKADGRWRMVLDYREVNKVTPLVATQNCHSASILNTLYRGPYKSTLDLANGFWAHPIKPEDYWITAFTWGGKTYCWTVLPQGFLNSPALFTADVVDILKDIPNVQVYVDDVYVSSATEQEHLDILETIFNRLSTAGYIVSLKKSKLAKETVEFLGFSISQNGRGLTDSYKQKLMDLQPPTTLRQLQSILGLINFARNFLPNFAELVAPLYQLIPKAKGQCIPWTMDHTTQLKTIIQALNSTENLEERRPDVDLIMKVHISNTAGYIRFYNHGGQKPIAYNNALFTSTELKFTPTEKIMATIHKGLLKALDLSLGKEIHVYSAIASMTKLQKTPLSERKALSIRWLKWQTYFEDPRIKFHHDATLPDLQNLPVPQQDTGKEMTILPLLHYEAIFYTDGSAIRSPKPNKTHSAGMGIIQAKFEPDFRIVHLWSFPLGDHTAQYAEIAAFEFAIRRATGIRGPVLIVTDSNYVAKSYNEELPYWESNGFVNNKKKTLKHISKWKAIAECKNLKADIHVIHEPGHQPAEASPHAQGNALADKQAVSGSYKVFSNELKPSLDAELEQVLSTGRPNPQGYPNKYEYKLVNGLCYVDRRGEEGLKIIPPKADRVKLCQLAHDGPGSAHLGRSALLLKLQQKYWWPRMHIDASRIVLNCTVCAQTNSTNQKPRPPLVIPHDTKPFQVWYMDYIGPLPPSNGYQHALVIVDAGTGFTWIYPTKAQTANATVKALTHLTGTAVPKVLHSDQGPAFTSSILADWAKDRGIQLEHSAPYHPQSSGKVERKNSEIKRLLTKLLAGRPTKWYPLIPIVQLALNNTPNTRQKYTPHQLMYGADCNLPFENLDTLDLTREEQLAVLKEVRDGLLDLYPSPSQTTARSWTPSPGLLVQERVARPAQLRPKWRKPTPIKKVLNERTVIIDHLGQDKVVSIDNLKPAAHQKLAQTPDSAEICPSATPCPPNTSLWYDLDTGTWTCQRCGYQCPDKYHQPQCTWSCEDRCGHRWKECGNCIPQDGSSDDASAVAAVEI

SEQ ID NO: 1554 - protein, 900 aa, Avian myeloblastosis virus
RATVLTVALHLAIPLKWKPNHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLIVGQILEPLRLKHPSLRMLHYMDDLLLAASSHDGLEAAGEEVISTLERAGFTISPDKVQREPGVQYLGYKLGSTYVAPVGLVAEPRIATLWDVQKLVGSLQSVRPALGIPPRLMGPFYEQLRGSDPNEAREWNLDMKMAWREIVQLSTTAALERWDPALPLEGAVARCEQGAIGVLGQGLSTHPRPCLWLFSTQPTKAFTAWLEVLTLLITKLRASAVRTFGKEVDILLLPACFREDLPLPEGILLALRGFAGKIRSSDTPSIFDIARPLHVSLKVRVTDHPVPGPTVFTDASSSTHKGVVVWREGPRWEIKEIADLGASVQQLEARAVAMALLLWPTTPTNVVTDSAFVAKMLLKMGQEGVPSTAAAFILEDALSQRSAMAAVLHVRSHSEVPGFFTEGNDVADSQATFQAYPLREAKDLHTALHIGPRALSKACNISMQQAREVVQTCPHCNSAPALEAGVNPRGLGPLQIWQTDFTLEPRMAPRSWLAVTVDTASSAIVVTQHGRVTSVAAQHHWATAIAVLGRPKAIKTDNGSCFTSKSTREWLARWGIAHTTGIPGNSQGQAMVERANRLLKDKIRVLAEGDGFMKRIPTSKQGELLAKAMYALNHFERGENTKTPIQKHWRPTVLTEGPPVKIRIETGEWEKGWNVLVWGRGYAAVKNRDTDKVIWVPSRKVKPDITQKDEVTKKDEASPLFAGISDWAPWEGEQEGLQEETASNKQERPGEDTPAANES

SEQ ID NO: 1555 - protein, 1448 aa, Simian immunodeficiency virus
MGARNSVLSGKKADELEKIRLRPGGKKKYMLKHVVWAANELDRFGLAESLLENKEGCQKILSVLAPLVPTGSENLKSLYNTVCVIWCIHAEEKVKHTEEAKQIVQRHLVMETGTAETMPKTSRPTAPFSGRGGNYPVQQIGGNYTHLPLSPRTLNAWVKLIEEKKFGAEVVSGFQALSEGCLPYDINQMLNCVGDHQAAMQIIRDIINEEAADWDLQHPQQAPQQGQLREPSGSDIAGTTSTVEEQIQWMYRQQNPIPVGNIYRRWIQLGLQKCVRMYNPTNILDVKQGPKEPFQSYVDRFYKSLRAEQTDPAVKNWMTQTLLIQNANPDCKLVLKGLGTNPTLEEMLTACQGVGGPGQKARLMAEALKEALAPAPIPFAAAQQKGPRKPIKCWNCGKEGHSARQCRAPRRQGCWKCGKMDHVMAKCPNRQAGFFRPWPLGKEAPQFPHGSSASGADANCSPRRTSCGSAKELHALGQAAERKQREALQGGDRGFAAPQFSLWRRPVVTAHIEGQPVEVLLDTGADDSIVTGIELGPHYTPKIVGGIGGFINTKEYKNVEIEVLGKRIKGTIMTGDTPINIFGRNLLTALGMSLNLPIAKVEPVKSPLKPGKDGPKLKQWPLSKEKIVALREICEKMEKDGQLEEAPPTNPYNTPTFAIKKKDKNKWRMLIDFRELNRVTQDFTEVQLGIPHPAGLAKRKRITVLDIGDAYFSIPLDEEFRQYTAFTLPSVNNAEPGKRYIYKVLPQGWKGSPAIFQYTMRHVLEPFRKANPDVTLVQYMDDILIASDRTDLEHDRVVLQLKELLNSIGFSSPEEKFQKDPPFQWMGYELWPTKWKLQKIELPQRETWTVNDIQKLVGVLNWAAQIYPGIKTKHLCRLIRGKMTLTEEVQWTEMAEAEYEENKIILSQEQEGCYYQESKPLEATVIKSQDNQWSYKIHQEDKILKVGKFAKIKNTHTNGVRLLAHVIQKIGKEAIVIWGQVPKFHLPVEKDVWEQWWTDYWQVTWIPEWDFISTPPLVRLVFNLVKDPIEGEETYYVDGSCSKQSKEGKAGYITDRGKDKVKVLEQTTNQQAELEAFLMALTDSGPKANIIVDSQYVMGIITGCPTESESRLVNQIIEEMIKKTEIYVAWVPAHKGIGGNQEIDHLVSQGIRQVLFLEKIEPAQEEHSKYHSNIKELVFKFGLPRLVAKQIVDTCDKCHQKGEAIHGQVNSDLGTWQMDCTHLEGKIVIVAVHVASGFIEAEVIPQETGRQTALFLLKLASRWPITHLHTDNGANFASQEVKMVAWWAGIEHTFGVPYNPQSQGVVEAMNHHLKNQIDRIREQANSVETIVLMAVHCMNFKRRGGIGDMTPAERLINMITTEQEIQFQQSKNSKFKNFRVYYREGRDQLWKGPGELLWKGEGAVILKVGTDIKVVPRRKAKIIKDYGGGKEMDSSSHMEDTGEAREVA

SEQ ID NO: 1556 - protein, 1603 aa, Rous sarcoma virus
MEAVIKVISSACKTYCGKTSPSKKEIGAMLSLLQKEGLLMSPSDLYSPGSWDPITAALSQRAMILGKSGELKTWGLVLGALKAAREEQVTSEQAKFWLGLGGGRVSPPGPECIEKPATERRIDKGEEVGETTVQRDAKMAPEETATPKTVGTSCYHCGTAIGCNCATASAPPPPYVGSGLYPSLAGVGEQQGQGGDTPPGAEQSRAEPGHAGQAPGPALTDWARVREELASTGPPVVAMPVVIKTEGPAWTPLEPKLITRLADTVRTKGLRSPITMAEVEALMSSPLLPHDVTNLMRVILGPAPYALWMDAWGVQLQTVIAAATRDPRHPANGQGRGERTNLNRLKGLADGMVGNPQGQAALLRPGELVAITASALQAFREVARLAEPAGPWADIMQGPSESFVDFANRLIKAVEGSDLPPSARAPVIIDCFRQKSQPDIQQLIRTAPSTLTTPGEIIKYVLDRQKTAPLTDQGIAAAMSSAIQPLIMAVVNRERDGQTGSGGRARGLCYTCGSPGHYQAQCPKKRKSGNSRERCQLCNGMGHNAKQCRKRDGNQGQRPGKGLSSGPWPGPEPPAVSLAMTMEHKDRPLVRVILTNTGSHPVKQRSVYITALLDSGADITIISEEDWPTDWPVMEAANPQIHGIGGGIPMRKSRDMIELGVINRDGSLERPLLLFPAVAMVRGSILGRDCLQGLGLRLTNLIGRATVLTVALHLAIPLKWKPDHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLVVGQVLEPLRLKHPSLCMLHYMDDLLLAASSHDGLEAAGEEVISTLERAGFTISPDKVQREPGVQYLGYKLGSTYVAPVGLVAEPRIATLWDVQKLVGSLQWLRPALGIPPRLMGPFYEQLRGSDPNEAREWNLDMKMAWREIVRLSTTAALERWDPALPLEGAVARCEQGAIGVLGQGLSTHPRPCLWLFSTQPTKAFTAWLEVLTLLITKLRASAVRTFGKEVDILLLPACFREDLPLPEGILLALKGFAGKIRSSDTPSIFDIARPLHVSLKVRVTDHPVPGPTVFTDASSSTHKGVVVWREGPRWEIKEIADLGASVQQLEARAVAMALLLWPTTPTNVVTDSAFVAKMLLKMGQEGVPSTAAAFILEDALSQRSAMAAVLHVRSHSEVPGFFTEGNDVADSQATFQAYPLREAKDLHTALHIGPRALSKACNISMQQAREVVQTCPHCNSAPALEAGVNPRGLGPLQIWQTDFTLEPRMAPRSWLAVTVDTASSAIVVTQHGRVTSVAVQHHWATAIAVLGRPKAIKTDNGSCFTSKSTREWLARWGIAHTTGIPGNSQGQAMVERANRLLKDRIRVLAEGDGFMKRIPTSKQGELLAKAMYALNHFERGENTKTPIQKHWRPTVLTEGPPVKIRIETGEWEKGWNVLVWGRGYAAVKNRDTDKVIWVPSRKVKPDITQKDEVTKKDEASPLFAGISDWIPWEDEQEGLQGETASNKQERPGEDTLAANES

SEQ ID NO: 1557 - protein, 1465 aa, Human immunodeficiency virus 2
MGARGSVLSGKKTDELEKVRLRPGGKKKYMLKHVVWAVNELDRFGLAESLLESKEGCQKILKVLAPLVPTGSENLKSLFNIVCVIFCLHAEEKVKDTEEAKKIAQRHLAADTEKMPATNKPTAPPSGGNYPVQQLAGNYVHLPLSPRTLNAWVKLVEEKKFGAEVVPGFQALSEGCTPYDINQMLNCVGEHQAAMQIIREIINEEAADWDQQHPSPGPMPAGQLRDPRGSDIAGTTSTVEEQIQWMYRAQNPVPVGNIYRRWIQLGLQKCVRMYNPTNILDIKQGPKEPFQSYVDRFYKSLRAEQTDPAVKNWMTQTLLIQNANPDCKLVLKGLGMNPTLEEMLTACQGIGGPGQKARLMAEALKEALTPAPIPFAAVQQKAGKRGTVTCWNCGKQGHTARQCRAPRRQGCWKCGKTGHIMSKCPERQAGFLRVRTLGKEASQLPHDPSASGSDTICTPDEPSRGHDTSGGDTICAPCRSSSGDAEKLHADGETTEREPRETLQGGDRGFAAPQFSLWRRPVVKACIEGQSVEVLLDTGVDDSIVAGIELGSNYTPKIVGGIGGFINTKEYKDVEIEVVGKRVRATIMTGDTPINIFGRNILNTLGMTLNFPVAKVEPVKVELKPGKDGPKIRQWPLSREKILALKEICEKMEKEGQLEEAPPTNPYNTPTFAIKKKDKNKWRMLIDFRELNKVTQDFTEVNWVFPTRQVAEKRRITVIDVGDAYFSIPLDPNFRQYTAFTLPSVNNAEPGKRYIYKVLPQGWKGSQSICQYSMRKVLDPFRKANSDVIIIQYMDDILIASDRSDLEHDRVVSQLKELLNDMGFSTPEEKFQKDPPFKWMGYELWPKKWKLQKIQLPEKEVWTVNAIQKLVGVLNWAAQLFPGIKTRHICKLIRGKMTLTEEVQWTELAEAELQENKIILEQEQEGSYYKERVPLEATVQKNLANQWTYKIHQGNKVLKVGKYAKVKNTHTNGVRLLAHVVQKIGKEALVIWGEIPVFHLPVERETWDQWWTDYWQVTWIPEWDFVSTPPLIRLAYNLVKDPLEGRETYYTDGSCNRTSKEGKAGYVTDRGKDKVKVLEQTTNQQAELEAFALALTDSEPQVNIIVDSQYVMGIIAAQPTETESPIVAKIIEEMIKKEAVYVGWVPAHKGLGGNQEVDHLVSQGIRQVLFLEKIEPAQEEHEKYHGNVKELVHKFGIPQLVAKQIVNSCDKCQQKGEAIHGQVNADLGTWQMDCTHLEGKIIIVAVHVASGFIEAEVIPQETGRQTALFLLKLASRWPITHLHTDNGANFTSPSVKMVAWWVGIEQTFGVPYNPQSQGVVEAMNHHLKNQIDRLRDQAVSIETVVLMATHCMNFKRRGGIGDMTPAERLVNMITTEQEIQFFQAKNLKFQNFQVYYREGRDQLWKGPGELLWKGEGAVIIKVGTEIKVVPRRKAKIIRHYGGGKGLDCSADMEDTRQAREMAQSD

SEQ ID NO: 1558 - protein, 1437 aa, Human immunodeficiency virus 1
MGARASVLSGGELDKWEKIRLRPGGKKKYKLKHIVWASRELERFAVNPGLLETSEGCRQILGQLQPSLQTGSEELRSLYNTVATLYCVHQRIDVKDTKEALEKIEEEQNKSKKKAQQAAAAAGTGNSSQVSQNYPIVQNLQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTNPANIMMQRGNFRNQRKTVKCFNCGKEGHIAKNCRAPRKKGCWRCGREGHQMKDCTERQANFLREDLAFLQGKAREFSSEQTRANSPTRRELQVWGGENNSLSEAGADRQGTVSFNFPQITLWQRPLVTIRIGGQLKEALLDTGADDTVLEEMNLPGKWKPKMIGGIGGFIKVRQYDQIPVEICGHKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTVQPIMLPEKDSWTVNDIQKLVGKLNWASQIYAGIKVKQLCKLLRGTKALTEVIPLTEEAELELAENREILKEPVHEVYYDPSKDLVAEIQKQGQGQWTYQIYQEPFKNLKTGKYARMRGAHTNDVKQLTEAVQKVSTESIVIWGKIPKFKLPIQKETWEAWWMEYWQATWIPEWEFVNTPPLVKLWYQLEKEPIVGAETFYVDGAANRETKLGKAGYVTDRGRQKVVSIADTTNQKTELQAIHLALQDSGLEVNIVTDSQYALGIIQAQPDKSESELVSQIIEQLIKKEKVYLAWVPAHKGIGGNEQVDKLVSAGIRKVLFLNGIDKAQEEHEKYHSNWRAMASDFNLPPVVAKEIVASCDKCQLKGEAMHGQVDCSPGIWQLDCTHLEGKIILVAVHVASGYIEAEVIPAETGQETAYFLLKLAGRWPVKTIHTDNGSNFTSTTVKAACWWAGIKQEFGIPYNPQSQGVVESMNNELKKIIGQVRDQAEHLKTAVQMAVFIHNFKRKGGIGGYSAGERIVDIIATDIQTKELQKQITKIQNFRVYYRDNKDPLWKGPAKLLWKGEGAVVIQDNSDIKVVPRRKAKIIRDYGKQMAGDDCVASRQDED

SEQ ID NO: 1559 - protein, 1124 aa, Feline immunodeficiency virus
KEFGKLEGGASCSPSESNAASSNAICTSNGGETIGFVNYNKVGTTTTLEKRPEILIFVNGYPIKFLLDTGADITILNRRDFQVKNSIENGRQNMIGVGGGKRGTNYINVHLEIRDENYKTQCIFGNVCVLEDNSLIQPLLGRDNMIKFNIRLVMAQISDKIPVVKVKMKDPNKGPQIKQWPLTNEKIEALTEIVERLEKEGKVKRADSNNPWNTPVFAIKKKSGKWRMLIDFRELNKLTEKGAEVQLGLPHPAGLQIKKQVTVLDIGDAYFTIPLDPDYAPYTAFTLPRKNNAGPGRRFVWCSLPQGWILSPLIYQSTLDNIIQPFIRQNPQLDIYQYMDDIYIGSNLSKKEHKEKVEELRKLLLWWGFETPEDKLQEEPPYTWMGYELHPLTWTIQQKQLDIPEQPTLNELQKLAGKINWASQAIPDLSIKALTNMMRGNQNLNSTRQWTKEARLEVQKAKKAIEEQVQLGYYDPSKELYAKLSLVGPHQISYQVYQKDPEKILWYGKMSRQKKKAENTCDIALRACYKIREESIIRIGKEPRYEIPTSREAWESNLINSPYLKAPPPEVEYIHAALNIKRALSMIKDAPIPGAETWYIDGGRKLGKAAKAAYWTDTGKWRVMDLEGSNQKAEIQALLLALKAGSEEMNIITDSQYVINIILQQPDMMEGIWQEVLEELEKKTAIFIDWVPGHKGIPGNEEVDKLCQTMMIIEGDGILDKRSEDAGYDLLAAKEIHLLPGEVKVIPTGVKLMLPKGYWGLIIGKSSIGSKGLDVLGGVIDEGYRGEIGVIMINVSRKSITLMERQKIAQLIILPCKHEVLEQGKVVMDSERGDNGYGSTGVFSSWVDRIEEAEINHEKFHSDPQYLRTEFNLPKMVAEEIRRKCPVCRIIGEQVGGQLKIGPGIWQMDCTHFDGKIILVGIHVESGYIWAQIISQETADCTVKAVLQLLSAHNVTELQTDNGPNFKNQKMEGVLNYMGVKHKFGIPGNPQSQALVENVNHTLKVWIQKFLPETTSLDNALSLAVHSLNFKRRGRIGGMAPYELLAQQESLRIQDYFSAIPQKLQAQWIYYKDQKDKKWKGPMRVEYWGQGSVLLKDEEKGYFLIPRRHIRRVPEPCALPEGDE

SEQ ID NO: 1560 - protein, 1145 aa, Equine infectious anemia virus
TAWTFLKAMQKCSKKREARGSREAPETNFPDTTEESAQQICCTRDSSDSKSVPRSERNKKGIQCQGEGSSRGSQPGQFVGVTYNLEKRPTTIVLINDTPLNVLLDTGADTSVLTTAHYNRLKYRGRKYQGTGIIGVGGNVETFSTPVTIKKKGRHIKTRMLVADIPVTILGRDILQDLGAKLVLAQLSKEIKFRKIELKEGTMGPKIPQWPLTKEKLEGAKETVQRLLSEGKISEASDNNPYNSPIFVIKKRSGKWRLLQDLRELNKTVQVGTEISRGLPHPGGLIKCKHMTVLDIGDAYFTIPLDPEFRPYTAFTIPSINHQEPDKRYVWKCLPQGFVLSPYIYQKTLQEILQPFRERYPEVQLYQYMDDLFVGSNGSKKQHKELIIELRAILQKGFETPDDKLQEVPPYSWLGYQLCPENWKVQKMQLDMVKNPTLNDVQKLMGNITWMSSGVPGLTVKHIAATTKGCLELNQKVIWTEEAQKELEENNEKIKNAQGLQYYNPEEEMLCEVEITKNYEATYVIKQSQGILWAGKKIMKANKGWSTVKNLMLLLQHVATESITRVGKCPTFKVPFTKEQVMWEMQKGWYYSWLPEIVYTHQVVHDDWRMKLVEEPTSGITIYTDGGKQNGEGIAAYVTSNGRTKQKRLGPVTHQVAERMAIQMALEDTRDKQVNIVTDSYYCWKNITEGLGLEGPQNPWWPIIQNIREKEIVYFAWVPGHKGIYGNQLADEAAKIKEEIMLAYQGTQIKEKRDEDAGFDLCVPYDIMIPVSDTKIIPTDVKIQVPPNSFGWVTGKSSMAKQGLLINGGIIDEGYTGEIQVICTNIGKSNIKLIEGQKFAQLIILQHHSNSRQPWDENKISQRGDKGFGSTGVFWVENIQEAQDEHENWHTSPKILARNYKIPLTVAKQITQECPHCTKQGSGPAGCVMRSPNHWQADCTHLDNKIILHFVESNSGYIHATLLSKENALCTSLAILEWARLFSPKSLHTDNGTNFVAEPVVNLLKFLKIAHTTGIPYHPESQGIVERANRTLKEKIQSHRDNTQTLEAALQLALITCNKGRESMGGQTPWEVFITNQAQVIHEKLLLQQAQSSKKFCFYKIPGEHDWKGPTRVLWKGDGAVVVNDEGKGIIAVPLTRTKLLIKPN

SEQ ID NO: 1561 - protein, 1475 aa, Bovine immunodeficiency virus
MKRRELEKKLRKVRVTPQQDKYYTIGNLQWAIRMINLMGIKCVCDEECSAAEVALIITQFSALDLENSPIRGKEEVAIKNTLKVFWSLLAGYKPESTETALGYWEAFTYREREARADKEGEIKSIYPSLTQNTQNKKQTSNQTNTQSLPAITTQDGTPRFDPDLMKQLKIWSDATERNGVDLHAVNILGVITANLVQEEIKLLLNSTPKWRLDVQLIESKVREKENAHRTWKQHHPEAPKTDEIIGKGLSSAEQATLISVECRETFRQWVLQAAMEVAQAKHATPGPINIHQGPKEPYTDFINRLVAALEGMAAPETTKEYLLQHLSIDHANEDCQSILRPLGPNTPMEKKLEACRVVGSQKSKMQFLVAAMKEMGIQSPIPAVLPHTPEAYASQTSGPEDGRRCYGCGKTGHLKRNCKQQKCYHCGKPGHQARNCRSKNREVLLCPLWAEEPTTEQFSPEQHEFCDPICTPSYIRLDKQPFIKVFIGGRWVKGLVDTGADEVVLKNIHWDRIKGYPGTPIKQIGVNGVNVAKRKTHVEWRFKDKTGIIDVLFSDTPVNLFGRSLLRSIVTCFTLLVHTEKIEPLPVKVRGPGPKVPQWPLTKEKYQALKEIVKDLLAEGKISEAAWDNPYNTPVFVIKKKGTGRWRMLMDFRELNKITVKGQEFSTGLPYPPGIKECEHLTAIDIKDAYFTIPLHEDFRPFTAFSVVPVNREGPIERFQWNVLPQGWVCSPAIYQTTTQKIIENIKKSHPDVMLYQYMDDLLIGSNRDDHKQIVQEIRDKLGSYGFKTPDEKVQEERVKWIGFELTPKKWRFQPRQLKIKNPLTVNELQQLVGNCVWVQPEVKIPLYPLTDLLRDKTNLQEKIQLTPEAIKCVEEFNLKLKDPEWKDRIREGAELVIKIQMVPRGIVFDLLQDGNPIWGGVKGLNYDHSNKIKKILRTMNELNRTVVIMTGREASFLLPGSSEDWEAALQKEESLTQIFPVKFYRHSCRWTSICGPVRENLTTYYTDGGKKGKTAAAVYWCEGRTKSKVFPGTNQQAELKAICMALLDGPPKMNIITDSRYAYEGMREEPETWAREGIWLEIAKILPFKQYVGVGWVPAHKGIGGNTEADEGVKKALEQMAPCSPPEAILLKPGEKQNLETGIYMQGLRPQSFLPRADLPVAITGTMVDSELQLQLLNIGTEHIRIQKDEVFMTCFLENIPSATEDHERWHTSPDILVRQFHLPKRIAKEIVARCQECKRTTTSPVRGTNPRGRFLWQMDNTHWNKTIIWVAVETNSGLVEAQVIPEETALQVALCILQLIQRYTVLHLHSDNGPCFTAHRIENLCKYLGITKTTGIPYNPQSQGVVERAHRDLKDRLAAYQGDCETVEAALSLALVSLNKKRGGIGGHTPYEIYLESEHTKYQDQLEQQFSKQKIEKWCYVRNRRKEWKGPYKVLWDGDGAAVIEEEGKTALYPHRHMRFIPPPDSDIQDGSS

SEQ ID NO: 1562 - protein, 873 aa, unidentified
  source 1..873: note = Description of Unknown:Avian leukosis and sarcoma virus sequence
TVALHLAIPLKWKPDHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLVVGQVLEPLRLKHPSLRMLHYMDDLLLAASSHDGLEAAGEEVISTLERAGFTISPDKIQREPGVQYLGYKLGSTYVAPVGLVAEPRIATLWDVQKLVGSLQWLRPALGIPPRLMGPFYEQLRGSDPNEAREWNLDMKMAWREIVQLSTTAALERWDPALPLEGAVARCEQGAIGVLGQGLSTHPRPCLWLFSTQPTKAFTAWLEVLTLLITKLRASAVRTFGKEVDVLLLPACFREDLPLPEGILLALRGFAGKIRSSDTPSIFDIARPLHVSLKVRVTDHPVPGPTVFTDASSSTHKGVVVWREGPRWEIKEIADLGASVQQLEARAVAMALLLWPTTPTNVVTDSAFVAKMLLKMGQEGVPSTAAAFILEDALSQRSAMAAVLHVRSHSEVPGFFTEGNDVADSQATFQAYPLREAKDLHTALHIGPRALSKACNISMQQAREVVQTCPHCNSAPALEAGVNPRGLGPLQIWQTDFTLEPRMAPRSWLAVTVATASSAIVVTQHGRVTSVAARHHWATAIAVLGRPKAIKTDNGSCFTSKSTREWLARWGIAHTTGIPGNSQGQAMVERANRLLKDKIRVLAEGDGFMKRIPTGKQGELLAKAMYALNHFERGENTKTPIQKHWRPTVLTEGPPVKIRIETGEWEKGWNVLVWGRGYAAVKNRDTDKIIWVPSRKVKPDITQKDELTKKDEASPLFAGISDWAPWKGEQEGL

SEQ ID NO: 1563 - protein, 9 aa, unidentified
  source 1..9: note = Description of Unknown:LAGLIDADG family peptide sequence
LAGLIDADG

SEQ ID NO: 1564-1568 - skipped (5 entries)

SEQ ID NO: 1569 - protein, 4 aa, synthetic construct
  source 1..4: note = Description of Artificial Sequence: Synthetic peptide
SGGS

SEQ ID NO: 1570 - protein, 4 aa, synthetic construct
  source 1..4: note = Description of Artificial Sequence: Synthetic peptide
GGGS

SEQ ID NO: 1571 - protein, 1367 aa, synthetic construct
  source 1..1367: note = Description of Artificial Sequence: Synthetic polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1572 - protein, 672 aa, Murine leukemia virus
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLI

SEQ ID NO: 1573 - protein, 671 aa, Murine leukemia virus
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLL

SEQ ID NO: 1574 - protein, 660 aa, Murine leukemia virus
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAA

SEQ ID NO: 1575 - protein, 672 aa, synthetic construct
  source 1..672: note = Description of Artificial Sequence: Synthetic polypeptide
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLI

SEQ ID NO: 1576 - protein, 33 aa, synthetic construct
  source 1..33: note = Description of Artificial Sequence: Synthetic polypeptide
SGGSSGGSSGSETPGTSESATPESSGGSSGGSS

SEQ ID NO: 1577 - protein, 1369 aa, synthetic construct
  source 1..1369: note = Description of Artificial Sequence: Synthetic polypeptide
SMDKKYSIGLAIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1578 - DNA, 76 bp, synthetic construct
  source 1..76: mol_type = other DNA; note = Description of Artificial Sequence: Synthetic oligonucleotide
gttttagagctagaaatagcaagttaaaataaggctagtccgttatcaacttgaaaaagtgggaccgagtcggtcc

SEQ ID NO: 1579 - RNA, 47 nt, synthetic construct
  source 1..47: mol_type = other RNA; note = Description of Artificial Sequence: Synthetic oligonucleotide
gggaaataagagagaaaagaagagtaagaagaaatataagagccacc

SEQ ID NO: 1580 - RNA, 110 nt, synthetic construct
  source 1..110: mol_type = other RNA; note = Description of Artificial Sequence: Synthetic polynucleotide
tgataataggctggagcctcggtggccatgcttcttgccccttgggcctccccccagcccctcctccccttcctgcacccgtacccccgtggtctttgaataaagtctga

SEQ ID NO: 1581 - protein, 30 aa, synthetic construct
  source 1..30: note = Description of Artificial Sequence: Synthetic polypeptide
MDSLLMNRRKFLYQFKNVRWAKGRRETYLC

SEQ ID NO: 1582 - protein, 28 aa, synthetic construct
  source 1..28: note = Description of Artificial Sequence: Synthetic peptide
PKKRKVEGADKRTADGSEFESPKKKRKV

SEQ ID NO: 1583 - protein, 22 aa, synthetic construct
  source 1..22: note = Description of Artificial Sequence: Synthetic peptide
RKSGKIAAIWKRPRKPKKKRKV

SEQ ID NO: 1584 - protein, 18 aa, synthetic construct
  source 1..18: note = Description of Artificial Sequence: Synthetic peptide
KRTADGSEFESPKKKRKV

SEQ ID NO: 1585 - protein, 17 aa, synthetic construct
  source 1..17: note = Description of Artificial Sequence: Synthetic peptide
KKTELQTTNAENKTKKL

SEQ ID NO: 1586 - protein, 19 aa, synthetic construct
  source 1..19: note = Description of Artificial Sequence: Synthetic peptide
KRGINDRNFWRGENGRKTR

SEQ ID NO: 1587 - protein, 16 aa, synthetic construct
  source 1..16: note = Description of Artificial Sequence: Synthetic peptide
KRPAATKKAGQAKKKK

SEQ ID NO: 1588 - protein, 29 aa, synthetic construct
  source 1..29: note = Description of Artificial Sequence: Synthetic peptide
PKKKRKVEGADKRTADGSEFESPKKKRKV

SEQ ID NO: 1589 - protein, 427 aa, unidentified
  source 1..427: note = Description of Unknown:[Eubacterium] rectale M104/1 sequence
MDTSNLMEQILSSDNLNRAYLQVVRNKGAEGVDGMKYTELKEHLAKNGETIKGQLRTRKYKPQPARRVEIPKPDGGVRNLGVPTVTDRFIQQAIAQVLTPIYEEQFHDHSYGFRPNRCAQQAILTALNIMNDGNDWIVDIDLEKFFDTVNHDKLMTLIGRTIKDGDVISIVRKYLVSGIMIDDEYEDSIVGTPQGGNLSPLLANIMLNELDKEMEKRGLNFVRYADDCIIMVGSEMSANRVMRNISRFIEEKLGLKVNMTKSKVDRPSGLKYLGFGFYFDPRAHQFKAKPHAKSVAKFKKRMKELTCRSWGVSNSYKVEKLNQLIRGWINYFKIGSMKTLCKELDSRIRYRLRMCIWKQWKTPQNQEKNLVKLGIDRNTARRVAYTGKRIAYVCNKGAVNVAISNKRLASFGLISMLDYYIEKCVTC

SEQ ID NO: 1590 - protein, 420 aa, Geobacillus stearothermophilus
MALLERILADRNLITALKRVEANQGAPGIGDVSTDQLRDIYRAHWSTIRAQLLAGTYRPAPVRRVGIPKGPGGTRQLGITPVVDRLIQQIALQELTPIFDPDFSPSSFGFRPGRNAHDAVRQAQGYIQEYGRYVVDMDLKEFFDRVNHDLIMSRVARKVDKKRVLKLIRYALQAGVMIEGVKVQTEEGTQPGGPLSPLLANILLDDLDKELEKRGLKFCYRADDCNIYVSKLRAGQRVKQSIQRFLEKTLKLKVNEEKSVADRPWKRAFGLFSFTPERKARIRLAPRSIQRLKQRIRQLTNPNWSISMPREIHRVNQYVGMWIGYFRLVTEPSVLQTIEGWIRRRLRLCWQLQWKRVRTRIRELRALGLKETAVMEIANRTKGAWRTTKPQTLHQALGKYTWTAQGLKTSLQRYFELRQG

SEQ ID NO: 1591 - protein, 599 aa, Lactococcus lactis
MKPTMAILERISKNSQENIDEVFTRLYRYLLRPDIYYVAYQNLYSNKGASTKGILDDTADGFSEEKIKKIIQSLKDGTYYPQPVRRMYIAKKNSKKMRPLGIPTFTDKLIQEAVRIILESIYEPVFEDVSHGFRPQRSCHTALKTIKREFGGARWFVEGDIKGCFDNIDHVTLIGLINLKIKDMKMSQLIYKFLKAGYLENWQYHKTYSGTPQGGILSPLLANIYLHELDKFVLQLKMKFDRESPERITPEYRELHNEIKRISHRLKKLEGEEKAKVLLEYQEKRKRLPTLPCTSQTNKVLKYVRYADDFIISVKGSKEDCQWIKEQLKLFIHNKLKMELSEEKTLITHSSQPARFLGYDIRVRRSGTIKRSGKVKKRTLNGSVELLIPLQDKIRQFIFDKKIAIQKKDSSWFPVHRKYLIRSTDLEIITIYNSELRGICNYYGLASNFNQLNYFAYLMEYSCLKTIASKHKGTLSKTISMFKDGSGSWGIPYEIKQGKQRRYFANFSECKSPYQFTDEISQAPVLYGYARNTLENRLKAKCCELCGTSDENTSYEIHHVNKVKNLKGKEKWEMAMIAKQRKTLVVCFHCHRHVIHKHK

SEQ ID NO: 1592 - protein, 1114 aa, Bombyx mori
MMASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 1593 - protein, 1275 aa, Homo sapiens
MTGSNSHITILTLNVNGLNSPIKRHRLASWIKSQDPSVCCIQETHLTCRDTHRLKIKGWRKIYQANGKQKKAGVAILVSDKTDFKPTKIKRDKEGHYIMVKGSIQQEELTILNIYAPNTGAPRFIKQVLSDLQRDLDSHTLIMGDFNTPLSILDRSTRQKVNKDTQELNSALHQTDLIDIYRTLHPKSTEYTFFSAPHHTYSKIDHIVGSKALLSKCKRTEIITNYLSDHSAIKLELRIKNLTQSRSTTWKLNNLLLNDYWVHNEMKAEIKMFFETNENKDTTYQNLWDAFKAVCRGKFIALNAYKRKQERSKIDTLTSQLKELEKQEQTHSKASRRQEITKIRAELKEIETQKTLQKINESRSWFFERINKIDRPLARLIKKKREKNQIDTIKNDKGDITTDPTEIQTTIREYYKHLYANKLENLEEMDTFLDTYTLPRLNQEEVESLNRPITGSEIVAIINSLPTKKSPGPDGFTAEFYQRYKEELVPFLLKLFQSIEKEGILPNSFYEASIILIPKPGRDTTKKENFRPISLMNIDAKILNKILANRIQQHIKKLIHHDQVGFIPGMQGWFNIRKSINVIQHINRAKDKNHVIISIDAEKAFDKIQQPFMLKTLNKLGIDGMYLKIIRAIYDKPTANIILNGQKLEAFPLKTGTRQGCPLSPLLFNIVLEVLARAIRQEKEIKGIQLGKEEVKLSLFADDMIVYLENPIVSAQNLLKLISNFSKVSGYKINVQKSQAFLYNNNRQTESQIMGELPFTIASKRIKYLGIQLTRDVKDLFKENYKPLLKEIKEDTNKWKNIPCSWVGRINIVKMAILPKVIYRFNAIPIKLPMTFFTELEKTTLKFIWNQKRARIAKSILSQKNKAGGITLPDFKLYYKATVTKTAWYWYQNRDIDQWNRTEPSEIMPHIYNYLIFDKPEKNKQWGKDSLLNKWCWENWLAICRKLKLDPFLTPYTKINSRWIKDLNVKPKTIKTLEENLGITIQDIGVGKDFMSKTPKAMATKDKIDKWDLIKLKSFCTAKETTIRVNRQPTTWEKIFATYSSDKGLISRIYNELKQIYKKKTNNPIKKWAKDMNRHFSKEDIYAAKKHMKKCSSSLAIREMQIKTTMRYHLTPVRMAIIKKSGNNRCWRGCGEIGTLVHCWWDCKLVQPLWKSVWRFLRDLELEIPFDPAIPLLGIYPKDYKSCCYKDTCTRMFIAALFTIAKTWNQPNCPTMIDWIKKMWHIYTMEYYAAIKNDEFISFVGTWMKLETIILSKLSQEQKTKHRIFSLIGGN

SEQ ID NO: 1594 - protein, 857 aa, Drosophila virilis
MERSPEPSININGRHAVCTATNMSYAKIKTKYKDSKRTINKFQLTLVKLTKLKSSLKFLLKCRKSNLIPNFIKNLTQHLTILTTDNKTHPDITRTLTRHTHFYHTKILNLLIKHKHNLLQEQTKHMQKAKTNIEQLMTTDDAKAFFESERNIENKITTTLKKRQETKHDKLRDQRNLALADNNTQREWFVNKTKIEFPPNVVALLAKGPKFALPISKRDFPLLKYIADGEELVQTIKEKETQESARTKFSLLVKEHKTKNNQNSRDRAILDTVEQTRKLLKENINIKILSSDKGNKTVAMDEDEYKNKMTNILDDLCAYRTLRLDPTSRLQTKNNTFVAQLFKMGLISKDERNKMTTTTAVPPRIYGLPKIHKEGTPLRPICSSIGSPSYGLCKYIIQILKNLTMDSRYNIKNAVDFKDRVNNSQIREEETLVSFDVVSLFPSIPIELALDTIRQKWTKLEEHTNIPKQLFMDIVRFCIEENRYFKYEDKIYTQLKGMPMGSPASPVIADILMEELLDKITDKLKIKPRLLTKYVDDLFAITNKIDVENILKELNSFHKQIKFTMELEKDGKLPFLDSIVSRMDNTLKIKWYRKPIASGRILNFNSNHPKSMIINTALGCMNRMMKISDTIYHKEIEHEIKELLTKNDFPPNIIKTLLKRRQIERKKPTEPAKIYKSLIYVPRLSERLTNSDCYNKQDIKVAHKPTNTLQKFFNKIKSKIPMIEKSNVVYQIPCGGDNNNKCNSVYIGTTKSKLKTRISQHKSDFKLRHQNNIQKTALMTHCIRSNHTPNFDETTILQQEQHYNKRHTLEMLHIINTPTYKRLNYKTDTENCAHLYRHLLNSQTTSVTISTSKSADV

SEQ ID NO: 1595 - protein, 859 aa, Rous sarcoma virus
TVALHLAIPLKWKPDHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLVVGQVLEPLRLKHPSLCMLHYMDDLLLAASSHDGLEAAGEEVISTLERAGFTISPDKVQREPGVQYLGYKLGSTYVAPVGLVAEPRIATLWDVQKLVGSLQWLRPALGIPPRLMGPFYEQLRGSDPNEAREWNLDMKMAWREIVRLSTTAALERWDPALPLEGAVARCEQGAIGVLGQGLSTHPRPCLWLFSTQPTKAFTAWLEVLTLLITKLRASAVRTFGKEVDILLLPACFREDLPLPEGILLALKGFAGKIRSSDTPSIFDIARPLHVSLKVRVTDHPVPGPTVFTDASSSTHKGVVVWREGPRWEIKEIADLGASVQQLEARAVAMALLLWPTTPTNVVTDSAFVAKMLLKMGQEGVPSTAAAFILEDALSQRSAMAAVLHVRSHSEVPGFFTEGNDVADSQATFQAYPLREAKDLHTALHIGPRALSKACNISMQQAREVVQTCPHCNSAPALEAGVNPRGLGPLQIWQTDFTLEPRMAPRSWLAVTVDTASSAIVVTQHGRVTSVAVQHHWATAIAVLGRPKAIKTDNGSCFTSKSTREWLARWGIAHTTGIPGNSQGQAMVERANRLLKDRIRVLAEGDGFMKRIPTSKQGELLAKAMYALNHFERGENTKTPIQKHWRPTVLTEGPPVKIRIETGEWEKGWNVLVWGRGYAAVKNRDTDKVIWVPSRKVKPDITQKDEVTKKDEASPLFAG

SEQ ID NO: 1596 - protein, 572 aa, Avian myeloblastosis virus
TVALHLAIPLKWKPNHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLIVGQILEPLRLKHPSLRMLHYMDDLLLAASSHDGLEAAGEEVISTLERAGFTISPDKVQREPGVQYLGYKLGSTYVAPVGLVAEPRIATLWDVQKLVGSLQWLRPALGIPPRLMGPFYEQLRGSDPNEAREWNLDMKMAWREIVQLSTTAALERWDPALPLEGAVARCEQGAIGVLGQGLSTHPRPCLWLFSTQPTKAFTAWLEVLTLLITKLRASAVRTFGKEVDILLLPACFREDLPLPEGILLALRGFAGKIRSSDTPSIFDIARPLHVSLKVRVTDHPVPGPTVFTDASSSTHKGVVVWREGPRWEIKEIADLGASVQQLEARAVAMALLLWPTTPTNVVTDSAFVAKMLLKMGQEGVPSTAAAFILEDALSQRSAMAAVLHVRSHSEVPGFFTEGNDVADSQATFQAY

SEQ ID NO: 1597 - protein, 560 aa, Human immunodeficiency virus 1
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRKQNPDIVIYQYMDDLYVGSDLEIGQHRTKIEELRQHLLRWGLTTPDKKHQKEPPFLWMGYELHPDKWTVQPIVLPEKDSWTVNDIQKLVGKLNWASQIYPGIKVRQLCKLLRGTKALTEVIPLTEEAELELAENREILKEPVHGVYYDPSKDLIAEIQKQGQGQWTYQIYQEPFKNLKTGKYARMRGAHTNDVKQLTEAVQKITTESIVIWGKTPKFKLPIQKETWETWWTEYWQATWIPEWEFVNTPPLVKLWYQLEKEPIVGAETFYVDGAANRETKLGKAGYVTNRGRQKVVTLTDTTNQKTELQAIYLALQDSGLEVNIVTDSQYALGIIQAQPDQSESELVNQIIEQLIKKEKVYLAWVPAHKGIGGNEQVDKLVSAGIRKVL

SEQ ID NO: 1598 - protein, 538 aa, Saccharomyces cerevisiae
AVKAVKSIKPIRTTLRYDEAITYNKDIKEKEKYIEAYHKEVNQLLKMKTWDTDEYYDRKEIDPKRVINSMFIFNKKRDGTHKARFVARGDIQHPDTYDSGMQSNTVHHYALMTSLSLALDNNYYITQLDISSAYLYADIKEELYIRPPPHLGMNDKLIRLKKSLYGLKQSGANWYETIKSYLIQQCGMEEVRGWSCVFKNSQVTICLFVDDMVLFSKNLNSNKRIIEKLKMQYDTKIINLGESDEEIQYDILGLEIKYQRGKYMKLGMENSLTEKIPKLNVPLNPKGRKLSAPGQPGLYIDQDELEIDEDEYKEKVHEMQKLIGLASYVGYKFRFDLLYYINTLAQHILFPSRQVLDMTYELIQFMWDTRDKQLIWHKNKPTEPDNKLVAISDASYGNQPYYKSQIGNIYLLNGKVIGGKSTKASLTCTSTTEAEIHAISESVPLLNNLSYLIQELNKKPIIKGLLTDSRSTISIIKSTNEEKFRNRFFGTKAMRLRDEVSGNNLYVYYIETKKNIADVMTKPLPIKTFKLLTNKWIH

SEQ ID NO: 1599 - protein, 328 aa, Bordetella virus BPP1
MGKRHRNLIDQITTWENLLDAYRKTSHGKRRTWGYLEFKEYDLANLLALQAELKAGNYERGPYREFLVYEPKPRLISALEFKDRLVQHALCNIVAPIFEAGLLPYTYACRPDKGTHAGVCHVQAELRRTRATHFLKSDFSKFFPSIDRAALYAMIDKKIHCAATRRLLRVVLPDEGVGIPIGSLTSQLFANVYGGAVDRLLHDELKQRHWARYMDDIVVLGDDPEELRAVFYRLRDFASERLGLKISHWQVAPVSRGINFLGYRIWPTHKLLRKSSVKRAKRKVANFIKHGEDESLQRFLASWSGHAQWADTHNLFTWMEEQYGIACH

SEQ ID NO: 1600 - protein, 320 aa, Escherichia coli
MKSAEYLNTFRLRNLGLPVMNNLHDMSKATRISVETLRLLIYTADFRYRIYTVEKKGPEKRMRTIYQPSRELKALQGWVLRNILDKLSSSPFSIGFEKHQSILNNATPHIGANFILNIDLEDFFPSLTANKVFGVFHSLGYNRLISSVLTKICCYKNLLPQGAPSSPKLANLICSKLDYRIQGYAGSRGLIYTRYADDLTLSAQSMKKVVKARDFLFSIIPSEGLVINSKKTCISGPRSQRKVTGLVISQEKVGIGREKYKEIRAKIHHIFCGKSSEIEHVRGWLSFILSVDSKSHRRLITYISKLEKKYGKNPLNKAKT

SEQ ID NO: 1601 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 1602 - protein, 710 aa, Neurospora crassa
MPNHRLPNCVSYLGENHELSWLHGMFGLLKRSNPQTGGILGWLNTGPNGFVKYMMNLMGHARDKGDAKEYWRLGRSLMKNEAFQVQAFNHVCKHWYLDYKPHKIAKLLKEVREMVEIQPVCIDYKRVYIPKANGKQRPLGVPTVPWRVYLHMWNVLLVWYRIPEQDNQHAYFPKRGVFTAWRALWPKLDSQNIYEFDLKNFFPSVDLAYLKDKLMESGIPQDISEYLTVLNRSLVVLTSEDKIPEPHRDVIFNSDGTPNPNLPKDVQGRILKDPDFVEILRRRGFTDIATNGVPQGASTSCGLATYNVKELFKRYDELIMYADDGILCRQDPSTPDFSVEEAGVVQEPAKSGWIKQNGEFKKSVKFLGLEFIPANIPPLGEGEVKDYPRLRGATRNGSKMELSTELQFLCYLSYKLRIKVLRDLYIQVLGYLPSVPLLRYRSLAEAINELSPKRITIGQFITSSFEEFTAWSPLKRMGFFFSSPAGPTILSSIFNNSTNLQEPSDSRLLYRKGSWVNIRFAAYLYSKLSEEKHGLVPKFLEKLREINFALDKVDVTEIDSKLSRLMKFSVSAAYDEVGTLALKSLFKFRNSERESIKASFKQLRENGKIAEFSEARRLWFEILKLIRLDLFNASSLACDDLLSHLQDRRSIKKWGSSDVLYLKSQRLMRTNKKQLQLDFEKKKNSLKKKLIKRRAKELRDTFKGKENKEA

SEQ ID NO: 1603 - protein, 785 aa, synthetic construct
  source 1..785: note = Description of Artificial Sequence: Synthetic polypeptide
MILDTDYITEDGKPVIRIFKKENGEFKIEYDRTFEPYLYALLKDDSAIEEVKKITAERHGTVVTVKRVEKVQKKFLGRPVEVWKLYFTHPQDVPAIMDKIREHPAVIDIYEYDIPFAIRYLIDKGLVPMEGDEELKLLAFDIETLYHEGEEFAEGPILMISYADEEGARVITWKNVDLPYVDVVSTEREMIKRFLRVVKEKDPDVLITYNGDNFDFAYLKKRCEKLGINFALGRDGSEPKIQRMGDRFAVEVKGRIHFDLYPVIRRTINLPTYTLEAVYEAVFGQPKEKVYAEEITTAWETGENLERVARYSMEDAKVTYELGKEFLPMEAQLSRLIGQSLWDVSRSSTGNLVEWFLLRKAYERNELAPNKPDEKELARRHQSHEGGYIKEPERGLWENIVYLDFRSLYPSIIITHNVSPDTLNREGCKEYDVAPQVGHRFCKDFPGFIPSLLGDLLEERQKIKKRMKATIDPIERKLLDYRQRAIKILANSLYGYYGYARARWYCKECAESVIAWGREYLTMTIKEIEEKYGFKVIYSDTDGFFATIPGADAETVKKKAMEFLKYINAKLPGALELEYEGFYKRGLFVTKKKYAVIDEEGKITTRGLEIVRRDWSEIAKETQARVLEALLKDGDVEKAVRIVKEVTEKLSKYEVPPEKLVIHKQITRDLKDYKATGPHVAVAKRLAARGVKIRPGTVISYIVLKGSGRIVDRAIPFDEFDPTKHKYDAEYYIEKQVLPAVERILRAFGYRKEDLRYQKTRQVGLSARLKPKGTLEGSSHHHHHH

SEQ ID NO: 1604 - protein, 4 aa, unidentified
  source 1..4: note = Description of Unknown:Polymerase family B motif sequence
DTDS

SEQ ID NO: 1605 - DNA, 26 bp, Homo sapiens
  source 1..26: mol_type = unassigned DNA
ctgacccttctctctctcccccagag

SEQ ID NO: 1606 - DNA, 15 bp, Homo sapiens
  source 1..15: mol_type = unassigned DNA
tttctctcccacaag

SEQ ID NO: 1607 - protein, 1008 aa, synthetic construct
  source 1..1008: note = Description of Artificial Sequence: Synthetic polypeptide
MSLRVLQLNLHKSKVASAELLIAMEQGSADVALVQEPWIASGNAVAGLKSSNYNAFYTPSVSRNRTAVLVRKGLQANLMSHYSSDDLTVVLLESKKKRLLVASCYMAHDRPAPPEELRSLVEPGPKDQQLIVGADANAHHSVWGSPDINDRGESLLDFILSTNLYIANVGEEHTFVGPTSSNVLDITLVAGQSTMVSDWKVLERPSFSDHRYIQFQCEFDHSPKPTVFRNPRNTNWGKFQDIISRKLATSPGTVKSDEDIEKSLETLSKELLGAYHASCPISRSKKRTRPPWWNKDLSLQRDDLREFFKLAKQAKDDIINEEYKILLRNYKKEIRRAQRSSWRNFCSNIETAPETARLRKLLSKQPTIQSQLKRDDGQWTEGSEEALTALMHGHFPGCTKITNTHPAISFWIGNLLSCRRVQSDWGTASMVKGAHRGTPQGGVLSPLLWNLVVDDLIRRFERKAPKITAYADDISIIITGVCPSTLSSIMESTLREICEWTDKVGLSINADKTDLILFTKRYKVPPWIPPKINTTRLTPKTQVKYLGTVLDSKLAWKPNVLERVKKATIALYASKKMLSSTWGLSPALMHWVYISVVRPTLLYGVLVWWQAMEKRTYKKLMERTQRQALLCISGALRSTPTKALETIIGIDPLDIHAQLTAGKAAQRLVALGSMSTKGYGHSSIGRTMSSVSDYMTPRTCPDVKTSTFMGPEDWKTVQDHARYLNIYTDGSKMEGGVGAGIYCTDPETRLSYKLPSHCSIFQAEVFAIRKAAELAQEIARPCEAVNLFVDSQAAIRSMQSSAVSSKNVLASRDALDILSTTTSVRIYWVPSHQGIEGNEIADELAKEGVGLAIDRTENVPVSLRTLQSELERRADVRAKSRWRGNSATCKTSKIMCKERNDKLSHYVLHLSRKDCRLLVGLLTGHCLAAAHAVKLGITNNGNCRKCDESEATETLEHLICKCPALTQARVKHLGAPVLASLADASKRSPGELLAFAKTTAILKDFNTA

SEQ ID NO: 1608 - DNA, 105 bp, Homo sapiens
  source 1..105: mol_type = unassigned DNA
  misc_difference 1..105: note = This sequence may contain 10-35 cag repeating units
cagcagcagcagcagcagcagcagcagcagcagcagcagcagcagcagcagcagcagcagcagcagcagcagcagcagcagcagcagcagcagcagcagcagcag

SEQ ID NO: 1609 - DNA, 62 bp, synthetic construct
  source 1..62: mol_type = other DNA; note = Description of Artificial Sequence: Synthetic oligonucleotide
cactcctccccatcctctccctctgtccctctgtccctctgaccctgcactgtcccagcacc

SEQ ID NO: 1610 - DNA, 122 bp, synthetic construct
  source 1..122: mol_type = other DNA; note = Description of Artificial Sequence: Synthetic polynucleotide
caggacacagccttggatcaggacagagacttgggggccatcctgcccctccaacccgacatgtgtacctcagctttttccctcacttgcatcaataaagcttctgtgtttggaacagctaa

SEQ ID NO: 1611 - DNA, 306 bp, synthetic construct
  source 1..306: mol_type = other DNA; note = Description of Artificial Sequence: Synthetic polynucleotide
tgcctgtcatacgaaaccgagatactgacagtagaatatggccttctgccaatcgggaagattgtggagaaacggatagaatgcacagtttactctgtcgataacaatggtaacatttatactcagccagttgcccagtggcacgaccggggagagcaggaagtattcgaatactgtctggaggatggaagtctcattagggccactaaggaccacaaatttatgacagtcgatggccagatgctgcctatagacgaaatctttgagcgagagttggacctcatgcgagttgacaaccttcctaat

SEQ ID NO: 1612 - protein, 102 aa, synthetic construct
  source 1..102: note = Description of Artificial Sequence: Synthetic polypeptide
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 1613 - DNA, 108 bp, synthetic construct
  source 1..108: mol_type = other DNA; note = Description of Artificial Sequence: Synthetic polynucleotide
atgatcaagatagctacaaggaagtatcttggcaaacaaaacgtttatgatattggagtcgaaagagatcacaactttgctctgaagaacggattcatagcttctaat

SEQ ID NO: 1614 - protein, 36 aa, synthetic construct
  source 1..36: note = Description of Artificial Sequence: Synthetic polypeptide
MIKIATRKYLGKQNVYDIGVERDHNFALKNGFIASN

SEQ ID NO: 1615 - DNA, 303 bp, synthetic construct
  source 1..303: mol_type = other DNA; note = Description of Artificial Sequence: Synthetic polynucleotide
tgcctgtcttatgataccgagatacttaccgttgaatatggcttcttgcctattggaaagattgtcgaagagagaattgaatgcacagtatatactgtagacaagaatggtttcgtttacacacagcccattgctcaatggcacaatcgcggcgaacaagaagtatttgagtactgtctcgaggatggaagcatcatacgagcaactaaagatcataaattcatgaccactgacgggcagatgttgccaatagatgagatattcgagcggggcttggatctcaaacaagtggatggattgcca

SEQ ID NO: 1616 - protein, 101 aa, synthetic construct
  source 1..101: note = Description of Artificial Sequence: Synthetic polypeptide
CLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 1617 - DNA, 159 bp, synthetic construct
  source 1..159: mol_type = other DNA; note = Description of Artificial Sequence: Synthetic polynucleotide
atgaagaggactgccgatggatcagagtttgaatctcccaagaagaagaggaaagtaaagataatatctcgaaaaagtcttggtacccaaaatgtctatgatattggagtggagaaagatcacaacttccttctcaagaacggtctcgtagccagcaac

SEQ ID NO: 1618 - protein, 53 aa, synthetic construct
  source 1..53: note = Description of Artificial Sequence: Synthetic polypeptide
MKRTADGSEFESPKKKRKVKIISRKSLGTQNVYDIGVEKDHNFLLKNGLVASN

SEQ ID NO: 1619 - DNA, 12 bp, Homo sapiens
  source 1..12: mol_type = unassigned DNA
ctggggctgggg

SEQ ID NO: 1620 - DNA, 12 bp, unidentified
  source 1..12: mol_type = unassigned DNA; note = Description of Unknown:Myoclonic epilepsy of Unverricht and Lundborg repeat sequence
ccccgccccgcg

SEQ ID NO: 1621 - DNA, 133 bp, synthetic construct
  source 1..133: mol_type = other DNA; note = Description of Artificial Sequence: Synthetic polynucleotide
tcccctccaggccgtgcatagttttagagctagaaatagcaagttaaaataaggctagtccgttatcaacttgaaaaagtgggaccgagtcggtcctcgtcgatggtcagcacagccttatgcacggcctgga

SEQ ID NO: 1622 - DNA, 20 bp, synthetic construct
  source 1..20: mol_type = other DNA; note = Description of Artificial Sequence: Synthetic oligonucleotide
tttgttgaacttgacctcgg

SEQ ID NO: 1623 - DNA, 118 bp, synthetic construct
  source 1..118: mol_type = other DNA; note = Description of Artificial Sequence: Synthetic polynucleotide
accattaaagaaaatatcatgttttagagctagaaatagcaagttaaaataaggctagtccgttatcaacttgaaaaagtgggaccgagtcggtccaccaaagatgatattttcttta

SEQ ID NO: 1624 - DNA, 20 bp, synthetic construct
  source 1..20: mol_type = other DNA; note = Description of Artificial Sequence: Synthetic oligonucleotide
aaagatgatattttctttaa

SEQ ID NO: 1625 - DNA, 118 bp, synthetic construct
  source 1..118: mol_type = other DNA; note = Description of Artificial Sequence: Synthetic polynucleotide
gtaacggcagacttctccacgttttagagctagaaatagcaagttaaaataaggctagtccgttatcaacttgaaaaagtgggaccgagtcggtccgactcctgaggagaagtctgcc

SEQ ID NO: 1626 - DNA, 20 bp, synthetic construct
  source 1..20: mol_type = other DNA; note = Description of Artificial Sequence: Synthetic oligonucleotide
tggtgaggccctgggcaggt

SEQ ID NO: 1627 - DNA, 118 bp, synthetic construct
  source 1..118: mol_type = other DNA; note = Description of Artificial Sequence: Synthetic polynucleotide
ttggtgactgccacgcccaagttttagagctagaaatagcaagttaaaataaggctagtccgttatcaacttgaaaaagtgggaccgagtcggtccacaccccttgggcgtggcagtc

SEQ ID NO: 1628 - DNA, 20 bp, synthetic construct
  source 1..20: mol_type = other DNA; note = Description of Artificial Sequence: Synthetic oligonucleotide
ggccagcagtgaacacccct

SEQ ID NO: 1629 - DNA, 118 bp, synthetic construct
  source 1..118: mol_type = other DNA; note = Description of Artificial Sequence: Synthetic polynucleotide
actcaggaacactgctggttgttttagagctagaaatagcaagttaaaataaggctagtccgttatcaacttgaaaaagtgggaccgagtcggtccttcactgaaccagcagtgttcc

SEQ ID NO: 1630 - DNA, 20 bp, synthetic construct
  source 1..20: mol_type = other DNA; note = Description of Artificial Sequence: Synthetic oligonucleotide
ttggttgaaaatgattttgt

SEQ ID NO: 1631 - DNA, 129 bp, synthetic construct
  source 1..129: mol_type = other DNA; note = Description of Artificial Sequence: Synthetic polynucleotide
ccagggaaaacgcacccacggttttagagctagaaatagcaagttaaaataaggctagtccgttatcaacttgaaaaagtgggaccgagtcggtcctcccagcggtaggtgccccgtgggtgcgttttc

SEQ ID NO: 1632 - DNA, 20 bp, synthetic construct
  source 1..20: mol_type = other DNA; note = Description of Artificial Sequence: Synthetic oligonucleotide
ctccttctttgcgctcccag

SEQ ID NO: 1633 - DNA, 118 bp, synthetic construct
  source 1..118: mol_type = other DNA; note = Description of Artificial Sequence: Synthetic polynucleotide
gccctccccttctctgcccagttttagagctagaaatagcaagttaaaataaggctagtccgttatcaacttgaaaaagtgggaccgagtcggtccggtactgtgggcagagaagggg

SEQ ID NO: 1634 - DNA, 20 bp, synthetic construct
  source 1..20: mol_type = other DNA; note = Description of Artificial Sequence: Synthetic oligonucleotide
tcaggcaacgccaggtactg

SEQ ID NO: 1635 - DNA, 188 bp, synthetic construct
  source 1..188: mol_type = other DNA; note = Description of Artificial Sequence: Synthetic polynucleotide
ctcgaagggtccttgtagccgttttagagctagaaatagcaagttaaaataaggctagtccgttatcaacttgaaaaagtgggaccgagtcggtccgtgatccccccagcagcagcagcagcagcagcagcagcagcagcagcagcagcagcagcagcagcagcagcattcccggctacaaggaccct

SEQ ID NO: 1636 - DNA, 20 bp, synthetic construct
  source 1..20: mol_type = other DNA; note = Description of Artificial Sequence: Synthetic oligonucleotide
atcacaggactggagctggg

SEQ ID NO: 1637 - DNA, 252 bp, synthetic construct
  source 1..252: mol_type = other DNA; note = Description of Artificial Sequence: Synthetic polynucleotide
accactgcactccagcctaggttttagagctagaaatagcaagttaaaataaggctagtccgttatcaacttgaaaaagtgggaccgagtcggtccgtgtctgtctgtctgtctgtctgtctgtctgtctgtctgtctgcctgcctgcctgcctgcctgcctgcctgcctggctgcctgtctgcctgtctgcctgcctgcctgcctgcctgcctgcctgtctgtctcactttgtcccctaggctggagtgca

SEQ ID NO: 1638 - DNA, 20 bp, synthetic construct
  source 1..20: mol_type = other DNA; note = Description of Artificial Sequence: Synthetic oligonucleotide
gcctcagcctcctgagtagc

SEQ ID NO: 1639 - DNA, 188 bp, synthetic construct
  source 1..188: mol_type = other DNA; note = Description of Artificial Sequence: Synthetic polynucleotide
gggggcgtgcggcagcgcgggttttagagctagaaatagcaagttaaaataaggctagtccgttatcaacttgaaaaagtgggaccgagtcggtcctgcgggcgctcgaggcccagccgccgccgccgccgccgccgccgccgcctccgccgccgccgccgccgccgccgccgccgcgctgccgcacg

SEQ ID NO: 1640 - DNA, 20 bp, synthetic construct
  source 1..20: mol_type = other DNA; note = Description of Artificial Sequence: Synthetic oligonucleotide
gctcagaggcggccctccac

SEQ ID NO: 1641 - DNA, 188 bp, synthetic construct
  source 1..188: mol_type = other DNA; note = Description of Artificial Sequence: Synthetic polynucleotide
caggcgcgcgacaccacgccgttttagagctagaaatagcaagttaaaataaggctagtccgttatcaacttgaaaaagtgggaccgagtcggtccaacccagtatctactaaaaaatacaaaaaaaaaaaaaaaagaagaagaagaagaagaaaataaagaaaagttagccgggcgtggtgtcgcgc

SEQ ID NO: 1642 - DNA, 20 bp, synthetic construct
  source 1..20: mol_type = other DNA; note = Description of Artificial Sequence: Synthetic oligonucleotide
cgcttgagcccgggaggcag

SEQ ID NO: 1643 - DNA, 221 bp, synthetic construct
  source 1..221: mol_type = other DNA; note = Description of Artificial Sequence: Synthetic polynucleotide
ggcggctgaggaagctgagggttttagagctagaaatagcaagttaaaataaggctagtccgttatcaacttgaaaaagtgggaccgagtcggtccagtccctcaagtccttccagcagcagcagcagcagcagcagcagcagcagcagcagcagcagcagcagcagcagcaacagccgccaccgccgccgccgccgccgccgcctcctcagcttcctcag

SEQ ID NO: 1644 - DNA, 20 bp, synthetic construct
  source 1..20: mol_type = other DNA; note = Description of Artificial Sequence: Synthetic oligonucleotide
cgctgcaccgaccgtgagtt

SEQ ID NO: 1645 - DNA, 214 bp, synthetic construct
  source 1..214: mol_type = other DNA; note = Description of Artificial Sequence: Synthetic polynucleotide
tgagccccggagccctgctggttttagagctagaaatagcaagttaaaataaggctagtccgttatcaacttgaaaaagtgggaccgagtcggtccacaaggctgagcagcagcagcagcagcagcagcagcagcagcagcagcatcagcatcagcagcagcagcagcagcagcagcagcagcagcagcagcagcacctcagcagggctccggg

SEQ ID NO: 1646 - DNA, 20 bp, synthetic construct
  source 1..20: mol_type = other DNA; note = Description of Artificial Sequence: Synthetic oligonucleotide
tccagttctccgcagaacac

SEQ ID NO: 1647 - DNA, 152 bp, Strongylocentrotus purpuratus
  source 1..152: mol_type = unassigned DNA
aaggtggttcagttcctccgtttagaaacaggggcttaaaatttgcccatttgaatattcatagcttagttgctaagattgacgaacttagattacttctgagaaatgcatcatttgatgttattggtttaaatgaaacattttgcgactcc

SEQ ID NO: 1648 - DNA, 272 bp, Strongylocentrotus purpuratus
  source 1..272: mol_type = unassigned DNA
tgaatggctcagccgtacatacactacgtgcatgttctgtaatatttacatgtcttattcacataattgcgacttaattaatattttcctattgacattactgcttactaggttaatgatatatgttaattttgcaaacgagtattatttttgtaactgttctgtataaatgttataaacgatgtaaatatgttcattcagggccccatggaagaccactacttgctggtgaatgggctaccctgtcaaaagatcagaaataaataaataaa

SEQ ID NO: 1649 - protein, 903 aa, synthetic construct
  source 1..903: note = Description of Artificial Sequence: Synthetic polypeptide
MIDDSELYIDDYILLRRDRTRHGGGVAVYISKRFNYKRRDDLISSTLECLWFELHYPNKSPILVGEFYRPPNSHVDFFEELDGNLDSALSEDMSCIILGDFNCDCMPHQLDLNAEKLMFYTNMYGLSQLIDTATRVTNTSSTLIDLIFVSDKELYNEWGIFETSISDHYLVYTVRDFSAKIHNKSEYAEFRSFKNLDEEKFYSELRSTPWQVIKDIDNVDVAWDMWLTLFNNIINKHIPVCKKRIRKKACPWISDEIVKLMTERDKVLKAAKANKSDDLWDTYKYLKNTVIHLMRKRKREYNADQISQNHNNSKQMWRCLRNLVPKSLPISPNSINVDGANVSDNANIAEAFNDFFISNATKITKDLRRNKSQLRVDEDNNIGPTHSQFNLNLITEDFVLKQIDNLSIDKATGEDHISCKLLKMTKNVIAESLCDIINKSLSTGVVPREWKKARVVPIFKSGDISSLNNYRPISILPIVSKIIERAVHQQLSEFLDVNKLLHPNQSGFRPKHSTATALAKLVNQWSLNIDNKEISGVAFIDLRKAFDTVDHELLLHKLACIGCSNRTIYWFKSYLGDRQQVTQFKGAKSHPSTIKLGVPQGSILGPLLFSIYVNSLPECTPEGIIDMYADDTTLTVSANDATVVEEKLTVALNRVMAWIKENRLVLNTEKTCVMLIGSPANLKKIESFTISLNGNLIKRVQFTKCLGLLIDEELKWSKQIENVSKLTQKNISMIKRAKSFLPQKSLKLLYNSLVLPRLDYCSVVWSNRFHSHTTKLQKIQKRAARIILNKTYDTPSADLFTSLKWMTLDKRFELSRVMMIYKCVHNLAPSYLQVGLINPNDVHEHHTRQIDSGCLRVPRFHTDCYKCSPIVSSIFEWNKLDNSLRTASSVNSFKRLFKQSCNL

SEQ ID NO: 1650 - DNA, 275 bp, Ixodes scapularis
  source 1..275: mol_type = unassigned DNA
tgatcagttgaagcgctgatgtagtatttgctttttgctctcacacctggtgatgtctctgttttgtgcttttgatttcccttgttaatctgagtgtttttcatacttgttaatatttttattctcagactggagaactacgttctccttctgcactcgtgtgtatgcgtgtttgtatgtgtgtgtttttgctcatttttttttagtgtgccagcactaagaccgattggttgttcctggacactttaataaacattgattgattgattgattga

SEQ ID NO: 1651 - protein, 765 aa, synthetic construct
  source 1..765: note = Description of Artificial Sequence: Synthetic polypeptide
MRQHNNILNDQGNALDLCFSNTDGIHVARSELSMVPEDSYHPALDVVLSIFDPPVLSPSNGPSPHTSYKYSAGDYTGMYHHLSGVDWASILESSDINGQVYLLTTVVQEAMDMYIPLKTSKKSRFPIWFSRELRTLLKRKDFLHRRFKKSGLPKWEVEFKICRKRCKKILNRDRQAHSDSVESDLVKNPKKFWRYAKSRLGKNIESEIVLNQHSDSAKGMSELFADHFASVYINNNNCSSSILPHSDVFGDSLGSVVVDEECVRLCIKKMKPTLSAGHDGIPAAIVKAYHELLTPILCTIFNNSLTSGIFPDDWKLAVVVPVLKSGNSGDVLNYRPISLLSSFSKLFEMVIHQFLSFKFRSIVIPNQHGFMSGRSTSTNLVSFMSAASEVVCNRGQLDVFYFDLSKAFDVVNHNILLYKLSSYGVCGSVYNLLKSYLSDRHAYVRVNNTTSSLYKASSGVPQGSVLGPLLFNIFVNDVSRVILNSSFLQYADDIKLYKKISTLEDCIALQNDAYSFGRWCLDNDLRLNHSKTKIMTYSRKTHDIFFPYSYHGELLSRVSELRDLGVVFDSTLRFDTHVIKVVQSALRTLGAVSRITKEFKSPSAFFTLYCSLVRSQLEYASVVWNGISKTNSSSVERVQNKFISIFKYRYLENGDPCLNGVCNSQLVNLLSLQQRRVKADLLFLFKTLHGSINSPSLLSEVSLRVPRVPTRLQSSFYIARHFSNLNPIQRSAECYNRYSDTIDIFNSCGSKFGNAVQIFLLQEKG

SEQ ID NO: 1652 - DNA, 94 bp, Drosophila simulans
  source 1..94: mol_type = unassigned DNA
tcgagctttattgcaagaccaaccaagcagatattcttctcatatccgaaacccatttttcagacaggtcctacttcaccttaagggggtatga

SEQ ID NO: 1653 - DNA, 42 bp, Drosophila simulans
  source 1..42: mol_type = unassigned DNA
taaaattaaattatatacatacattattatatacatcataca

SEQ ID NO: 1654 - protein, 846 aa, synthetic construct
  source 1..846: note = Description of Artificial Sequence: Synthetic polypeptide
MPRVSHPPEWFSILIRSSIKFDTQPPIQEDWVQCARISVSTTHGDITLAAAYCPPRFRATDDCFSSLLDSLGPKFVIGGDFNAKHTWWGSRVCNPKGRALCRQVLSRNLNCHGTGTPTYWPTDPAKTPDILDFAISGGLDPARIQTREVEDLLSDHSAIAVSVYASAMLRSAGKKLIFKTSDISKYHHWLNNSTVTNPPLDTPELIDAAVVNLTSQIQEAATYAAPRFSNQTRDRSRDVHFWNPRVNELKSEKRRLRRVWFLSRNPRDKTALNRATKELKETLVRLRKEALDSFVGNLAPGDPHHNLWNVTKRIKRPLKRIPPIRRQDNSWCRTETERANAFAEHLEEVFTPANRCSPNEAAETARLLSEPLFDSESIPQATEEEISNLIAAMGNHKAPGDDAINAIALKLLPPISKSLITTIINKCLQLGHFPSSWKRAEVVMILKPGKHEANPASYRPISLLPVLSKILERVFLTRVLPVIEEAGLIPDHQFGFRRRHGTPEQGHRVAQYILDAFENKKYCLAVMLDIKQAFDRVWHPGLLLKLKNGLPQPYFKFLKSFLEGRRFAVRCGEARSDVKEARAGVPQGSVLGPLLYNAYTADLPVIPSQYIMAATYADDTAFLTTADTPAEASQTMQEQLDLLNTWHTRWNISVNSDKSTATTFATRRGTCPPVSFNGFPIPEVANPNYLGFTLDRRLTWRPHLLKKRKQAENRVREFYWLMGRQSKLPTSTKLLIYKAIIRPIWTYGIQLWGTASKSNINIIQTFENKTLRTVTNAHPFHDNATIHEVLSFPWVKDEIKKSSRQYMQRLQDHPNNLAQDLLDTSQRTRRLHRSHPLDLSGIRHAN

SEQ ID NO: 1655 - DNA, 428 bp, Melopsittacus undulatus
  source 1..428: mol_type = unassigned DNA
tgatgaagggagtggaacacctcccttatgaggagaggctgagggagctgggtctctttagcttggagaagaggagactgaggggtgacctcatcagtgtttacaaatatgtaaagggtgggtgtcaggatgatggagctaggcttttttcagtgatatccagtgataggacaaggggcaatgggtgtaaactggagcataggaggttccacgttaacatcaggaagaacttctttactgtaagagtgacagagcactggaacaggttgcccaggggggttgtggagtctcctacgttggagatattcaaggcccgcctggacaagttcctgtgtgatgtactctaggttaccctgctcttgcaggggggttggactagatgatcttttgaggtcccttccaacccttgggattctgtgattctgtga

SEQ ID NO: 1656 - protein, 165 aa, synthetic construct
  source 1..165: note = Description of Artificial Sequence: Synthetic polypeptide
MAFDTVSHSILIDKLRKCGLDDQVVRWIKNWLKGRRQRVVVNGAESSWRSVTSGVPQGSVLGPVLFNIFINDLDEGTECTLSKFADDTKLGGVADTPEGCVAIQRDLDRLESWAGRNLMKFNKGKCRVLHLGKNNPMYQYRLGVDLLERVKGKGPGGPGGAEPQR

SEQ ID NO: 1657 - DNA, 232 bp, unidentified
  source 1..232: mol_type = unassigned DNA; note = Description of Unknown:Blumeria graminis sequence
taagtcctggcgaaatagaggtttttcaggacaaagagttgtgaggaaggagggaatgcgcagggcgcttaattttcttggaacttatttctttatttatgttttacgtatagatttgacaagcaaactatgtacttaggttgtagtgtgtcccgagggagcatagacccgtatcacgcctattgggtgtagggcgtaagcctgatacgaaatgaaatcaaatcaaatcaaa

SEQ ID NO: 1658 - protein, 637 aa, synthetic construct
  source 1..637: note = Description of Artificial Sequence: Synthetic polypeptide
MKIAECGVPQGSPLSPLLFLLYIAILLQDENKNTKFGYADDIAILSIGNTASEAVAEAQKEVDKLVQLASENRIDFDSTKSELLVIGGGPKKKLDTSGLSVQIQGHSVPTSPYVRWLGVWLDSQLNFKQHVQEWCGKAQRITQFMRQTNSVQRSAAPGPMIKVVQACVLSTALYGAEAWWPGLTRITTQRGKKVCTGVGWHTDLLDSTILKAVRAALPVWRTTPNMALHRESGITPSAVILQQRNILAAARIQRLDDWHPLVFRSREDPKDTISRLGLCICQKNRSFKFPEWYLTRLEISAKNVPMAEGPGKLYFPEAESIRKNTGSDFQDEADYAKQWIASLSAETVCAYSDSSSCGPARSAWGYTLYKGGQVIGSDSGPLLGAEVYDAEIFGAQKALERALGKAGNCPIKVLLDNTTAVRALRTGQTKSSQEAVEVFTRLARQARSVEIRWIPAHAGVMGNEDTDRLAKEALRNLPDETDTSPSEMRDRPKYTFAALTRFVRQRCDEVVESWWRDHRPSRYEELDLQMKRKRPPELALPRWAHHRLITARTGHGDFIKYHERFGHEFENCECVCGREKRPWHFAECRIALQQWRNLKHEPPPRGREMLAEKGWERFLQFLTVTKCYERQTLHRED

SEQ ID NO: 1659 - DNA, 325 bp, Esox lucius
  source 1..325: mol_type = unassigned DNA
ctccttgaactgccaccttaacgtggtggaggggtttgagtacccgagtgaccctaggagctatgttgtctggggctatatgcccctggtagggtctcccaaggcaaacaggtcctaggcgatgggtcagactaagagcggttcaaaaccccttaatgagaaattgtgccgtgacgtcgcccggcatggcgcagccggggccccaccctggagccaggcccgaggagcgacatggggccgccctcccgtgggctcaccacccacaggagggaccataaggggccggtgcgagaggatcgggcggcagtcgaaggcgggggcctga

SEQ ID NO: 1660 - DNA, 27 bp, Esox lucius
  source 1..27: mol_type = unassigned DNA
taagcggaagatgatgcaatgcaatgc

SEQ ID NO: 1661 - protein, 975 aa, synthetic construct
  source 1..975: note = Description of Artificial Sequence: Synthetic polypeptide
MQPDPRTRKLALGTWNVTSLAGKEPEMVREVERFRLEVVGITSTHGLGSGTTLLERGWTLHHSGVAHGERRRAGVGLLIAPQLCRHVLEFTPVNERVVSLRLRVGDRSLTVVCAYGPNGSAEYPTFLESLGGVLESAPTGDSIVLLGDFNAHVGNDSDTWRGVIGRNGPPDLNPSGVQLLDFCASHSLSITNTMFKHKGVHQCTWHQDTLGRRSMIDFVVVSSDLRPYVLDTRVKRGAELSTDHHLVVSWIRWRGRKLDRLGRPKRTVRVCWERLAESPVREIFNSHLRQSFDWIPREVGDIESEWTMFSTAIVEAAARSCGRKVSGACRGGNPRTRWWTPEVRDAVKLKKESYQAWLACGTPEAADGYRQAKRTAARVVVEAKTRAWEEFGEAMEKDYRLASKRFWQTIRRLRRGKQCPTNAVYSRGGQLLTSTGDVVGRWKEYFEDLLNPAVTSSIEEAEDEGSEVDSSITRAEVTEVVKKLLGGKAPGVDEIRPEYLKSLDVVGLSWLTRLCNIAWQSGTVPLGWQTGVVVPLYKKGDRRVCSNYRGITLLSLPGKVYARVLERRIRPIVEPRIQEEQCGFRPGRGTLDQLYTLYRVMEGSWEFAQPVHMCFVDLEKAFDCVPRGILWRVLREYGVLGPLLRAVRSLYDRSRSLVRIAGSKSDLFPVHVGLRQGCPLSPVLFVIFMDRISRRSQGPEGVRFGDHTISSLLFADDVVVLAPSSQDLQHALGRFAAECEAVGMKISTSKSEAMVLSRKRVACPLQVGGECLPQVEEFKYLGVLFTSEGRMEREIDRRIGAASAVMRSMYRSVVVKKELSRKAKLSIYRSIYVPTLTYGHELWVMTERTRSRIQAAEMSFLRRVAGRSLRDRVRSSVTREELRVEPLLLHIERGQLRWLGHLFRMPPERLPGKVFRSRPTGKRPRGRPRTRWRDYVSRLAWERLGVPPEELEEVSGEREVWASLLRLLPPRPGPG

SEQ ID NO: 1662 - DNA, 980 bp, Aedes aegypti
  source 1..980: mol_type = unassigned DNA
catacgttgagtgactaccgttgagagcggacgtgtctgtgcttgcgtgctgttacagtggttcgagtgaaaagatcgtttttgcgattgtcgtaggaggaattgtgctggggtttttgggtttccggaagtgccgtgttggagcagttgggaggttaccgtgctgggtttccgacggattggactggatccgtgatttggccagcaactcggctgggtgaaataggcttttcggagagtagtgagaaaacgaaaaagcagctggtagtggagtgcggaggaggtagaagcctagtggaggagtgcggagggggtgaaagtgcggtgagggctgtagtcggtaaattccgcatttcagattgctgattgttagtgtcctgaagagaagactaaattcctttaattggggcagctggcgtggttaagggattgttccggggaagcggaaagggagtgtgaagtgtttggccagaggaagttggcggaaaaaaaaattggaacgccgaagaaagaaaaaagttttgaggcgagagtggcgggggggtgttgcggtcgaaagcttcaacggaagaaaacacgagtggtgtgagtgagaagaccttgatcggttttggcggtaaagctcgttgcaggagttcggaaaaaaaaaaaaagaaaattggaagcgagagtgagtgccacgtagaagcgaagtggagaaaagtggcatcgcacactgtgagaggaggaagtggagcatcgaaataggcaagcggctgagtagcgacagagagagagtaagtgagaaagcgcatctgtagcggggaggcagaaataagaagcagggctgctggtcgatccgtggcgaatgcggtggagagcacgaaggaagattccaacgcagcgagactgagtgcaccggtttcattggtggcagtattggtgagtcattcactttctcgttccaataatttttccaagtatctcgaagtttggtcctc

SEQ ID NO: 1663 - DNA, 538 bp, Aedes aegypti
  source 1..538: mol_type = unassigned DNA
tgatgcgattcagaacgactggagttgaagaagagaggagagaagatcaccatattgtgcattgccagaataaaggtattgtaagtacaaatcaatgttttaaatatgtaaaatggaagtcaaacaagtatacgttatactgggaaggtttaatttaatggtaagtgaaattattacaaaacataatcaatagcaccaatcgtaattttcatatattatatatcaaacaggacacccaattgaagcaatatggatgaggagagtggaattgccaactccttatcgctaacatactgttgatagagggatggtccttaaaccccactcattgagacatccttttgtatgatgaaatgaccggtagatcggtgaccagtatctaggttataatttttggaatgccttaggtaaaccttaaataatagcaaagaactgaaacaatcaactggataacatcatataaaacggacagtctactgtctaacggctgtgccatgcaacaatgagtggttacccttacatacatacatacatacat

SEQ ID NO: 1664 - protein, 1554 aa, synthetic construct
  source 1..1554: note = Description of Artificial Sequence: Synthetic polypeptide
MMTMTFNGIRRLGWFLSVLSLVKQRLLNSSHESNSLSKLILKQICVKLNGVNFTQEDVDELNSIILSKIEGWEQDLNKFIEFFDNIQFEVFDIAEMANHCLLLAVSQIFECEVRVSNDKDDCKIIGEGYKNSWFGVLEIGMESSERVEKVTRALKGSSKIKLGKCGKDRQVNGMAGKGNEPLIVKEECLWYTTIGNWIIEIESKGEDDGKLYSGLMMNVIQKMNEGEIGEQEMMEMLKQIDLFFEMYGEILNRLEEEVMINGNALYEIWKIVSKLAVALNREIIVLMRGGEEIVLGVTERKRKFASFWLVAEFQEVGVRYYSIKSSKLIQEWKENMSIKPAIDVFEKRAEEVSYNLRFKESNQQAVIKRIDGDGSCLIRAMLDQMGRIDQNYYMSDYNVTKIRNNIASYINNSRERFNVYLYEHIEEVGTIERVIENIREKSYWLGEEAIITVAELFEKQVEVYTNQGLSVRIGVRKDNESALRIFYTGNHYDSVISIAEEEAGEIEAEMININEAEGNKMQAGGESRAVKSNKVREVNESSSHSKKITQYGKQSTNTTGDSNNHEQSKKKVEKQLRKDSEIKDKENKALKIVSWNVRGCRRKVKRDEIDDILVANDVMIAALQEVNTIGDDLSTNNYSWQVKDNHTNKARGLAIVVRKNQRIRILQAKECRKGIMWIKLTINGVKLIVINVHAPNSNQKNFLSYLNEIVTRESDRKSLIVLGDFNAQIGSEDLQPEDRVWIGTKLGHRYCNDNGELFKYFLHLSKLKNVSTKIGKSIEITWRTKDKSSQIDHVLVPQYTSFRIRYIKGCWTDLKTDHVMLTIGLVFTNNPVLKKSNKDTARINVDLLKIPEKQKCFREKLSSIPTKTDIQTDTLDKCYEEMASRLRIAAYNTLKVSTVPNTPRRKYALDRLRDALKVSKKHPDMINYKYRVANRRHEYQIAVKEHREKEITDFFKNLNDYDAGVRVRKTYNYLKDFVKRKKQKKAMISSRVWEDILKTCEGPEVEFCAEHDYTPLPNPPTNDEIKSILFSACNGKSPGSDRVVAEYIKAADEETLERIIEIIKAVYIRNDMPKEWKKSTQIPIPKKSGASEADHFRRISLCNVVYKIYAKWIAKQLRAYAGEPGLHQAAFTANRSTDDHIFVARRMMEEYWNSGQDLFILALDISKAFDNVKLQSIGKVLIDLGVPSRLVDRVLSCVKDEVTRIMWENQYSAEVKRGKGIKQGCPLSPLLFNYLIQDVLKKVVAEIPELKLMGINQLILPLILVFADDILIIARTKAELEKILHELELQLAKVGLEINRDKSQVLIRYPNDKAQHPKEILLNNKIFKVSDSLAYLGICLTATLNRKLTCKQRCLNAVKSSRIIVEFCKTFKPSWELGKLMYKTVIAPSLLYGTKVSVMTKKSRLKIGNYEKLILRNIYQYCKKPKDLKFNARKLLDGKTINRRIRVGRISYFGHVRRREKNHPLKLAYKLKFDKKKEGRPSLTWLKSLDQDFERYQNMNRSSWEELSKDREKIKKKLDEIYKNEESEISDGESSDGDQNSRYKHWKWKRRNEK

SEQ ID NO: 1665 - DNA, 89 bp, Oryzias latipes
  source 1..89: mol_type = unassigned DNA
taatttatatctttttactttttattatgtatactgtatttgtatcttttttctatggaccacatctgagtctgaaataaaagtgtgtt

SEQ ID NO: 1666 - protein, 282 aa, synthetic construct
  source 1..282: note = Description of Artificial Sequence: Synthetic polypeptide
MVVKWGNVLSEPFYVSNGVQQGGILSPFLFNVYIHDLSTNLNLCKTGCVVGCQTFNHLMYADDLVIFSPYSAGLQTLLKVCSDYGRDFDIKYNPSKSKVMIVRTKDDRNVNFPVFKLCGTTLEQTSSIKYLGHFITDDWRDDRDIQRQYCKLYAQANMLMRKFSACSLQVKCSLFRAYCTPLYTAPLWWNYGRGTFHKFLVAYNDAFRLLLQVPRWYRASQLFVDAHIPTCEALLRKLTYSLMERLDKSKNSIIMSLTDPKRSSCRYTSALRKHWIQRLYSF

SEQ ID NO: 1667 - DNA, 139 bp, Solenopsis invicta
  source 1..139: mol_type = unassigned DNA
aaagatcaatgaccagctaattaaagactggttacgaaccacgggaagattcgttagggagcatcctaatattttgtttaccagagcggacaagggtaatgtaacagttgcccttgacaagaatgattatatctcgaag

SEQ ID NO: 1668 - DNA, 465 bp, Solenopsis invicta
  source 1..465: mol_type = unassigned DNA
taggttcatcaccccttctccttctattcctttcgttcgggccaccgaggctatctcgtttcggtctatattatttgtatctattctcaccgagatgtaacatcccatctcaaggctgtgacacgagttttggtgcttagaggtaatttgtatttgattttcgctttgacttatctcctctttttcccttttttgttgaatttacattactttatagaagtgtattttttacaattttatatctaatgacttgtacagcttccatttttattcttatttatttatttattgaattttttacttatattccgcttattcttcttttttaactatttaattttcattgttgtatgccacaagttttatagtcatcattttaacatctttctcttatttatttatttatttgttagcaaccaatcgatgttgtttcacaaaactcttgtctcggcacacgctctgtga

SEQ ID NO: 1669 - protein, 530 aa, synthetic construct
  source 1..530: note = Description of Artificial Sequence: Synthetic polypeptide
MEGMLSDESTYVKLSKDPIQKLTKEARSLLSIWKDKGFIEQHIYRSLLTTDGVLPRAYGLPKIHKPNNPLRIIISSINSPLHSLAYFLHNIIYNSIPEADSFVKNSFHLVNKLNGLHVESDHVLVSLDVVSLFTNVPKNLAVESVTTRWDLISKNTTVPVNEFLKALNLIIDSTYFKFNNTCYKQIFGLPMGSPLSPILADLVMQDLECKALKLLSFHLPFYCRYVDDIILAAPANSLSGILDTFNSMHDRLQFTMEREIEGKISFLDVMLINVNNRIIFDQYRKPTFSGRYLNFFSHHPLCHKKGVIFGLVDKLLLLSHPQFHCKNFINLVNILLENNYPLNFIFSMINSRLKHLFYKDDTYVEDKRVRRFFTIPYIESVSEKFSSFSCKFDCSVAFTIPSKLNKFITTGKDHTERLSCNDVVYKINCKDCDSSYVGQTKRQLKTRVSEHKADIRKASSPSVISLHRIGENHEFDWENVKILDKEPSYVKRSISEMLHIKNQMHGLNKQSDTELLSDAYLPILERIPPS

SEQ ID NO: 1670 - DNA, 59 bp, unidentified
  source 1..59: mol_type = unassigned DNA; note = Description of Unknown:virilis group sequence
ggtcgccagagccatcaataaatatcaacggaaggcacgccgtatgcacagcaaccaac

SEQ ID NO: 1671 - DNA, 216 bp, unidentified
  source 1..216: mol_type = unassigned DNA; note = Description of Unknown:virilis group sequence
taaaataatgtatgtaaaatgttcgaaataatgtttaatttattgtattataattgttaattgttttttgtatcttggtgttagtgccctgaagacggtttgccgatgtgcaaccgaaatatatcggaagagaattgaataaaattgtttttcattgtttgttttaacaaacacggacctcgagccagccaacaaataaatattgaaatatggaaa

SEQ ID NO: 1672 - protein, 835 aa, synthetic construct
  source 1..835: note = Description of Artificial Sequence: Synthetic polypeptide
MSYAKIKTKYKDSKRTINKFQLTLVKLTKLKSSLKFLLKCRKSNLIPNFIKNLTQHLTILTTDNKTHPDITRTLTRHTHFYHTKILNLLIKHKHNLLQEQTKHMEKAKTNIEQLMTTDDAKAFFESERNIENKITTTLKKRQETKHDKLRDQRNLALADNNTQREWFVNKTKIEFPPNVVALLAKGPKFALPISKRDFPLLKYIADGEELVQTIKEKETQESARTKFSLLVKEHKTKNNQNSRDRAILDTVEQTRKLLKENINIKILSSDKGNKTVAMDEDEYKNKMTNILDDLCAYRTLRLDPTSRLQTKNNTFVAQLFKMGLISKDERNKMTTTTAVPPRIYGLPKIHKEGTPLRPICSSIGSPSYGLCKYIIQILKNLTMDSRYNIKNAVDFKDRVNNSQIREEETLVSFDVVSLFPSIPIELALDTIRQKWTKLEEHTNIPKQLFMDIVRFCIQENRYFKYEDKIYTQLKGMPMGSPASPVIADILMEELLDKITDKLKIKPRLLTKYVDDLFAITNKIDVENILKELNSFHKQIKFTMELEKDGKLPFLDSIVSRMDNTLKIKWYRKPIASGRILNFNSNHPKSMIINTALGCMNRMMKISDTIYHKEIEHEIKELLTKNDFPPNIIKTLLKRRQIERKKPTEPAKIYKSLIYVPRLSERLTNSDCYNKQDIKVAHKPTNTLQKFFNKIKSKIPMIEKSNVVYQIPCGGDNNNKCNSVYIGTTKSKLKTRISQHKSDFKLRHQNNIQKTALMTHCIRSNHTPNFDETTILQQEQHYNKRHTLEMLHIINTPTYKRLNYKTDTENCAHLYRHLLNSQTTSVTISTSKSADV

SEQ ID NO: 1673 - DNA, 144 bp, Strongylocentrotus purpuratus
  source 1..144: mol_type = unassigned DNA
ggtaaaaagtcgcctcatataactaataagtccatatcagacctattgattgtacaatggaacgcacaaggcttgacggcgcatggcgcaaactttttatcttcccttattgataacaatttgttaggtattcacccagatata

SEQ ID NO: 1674 - DNA, 322 bp, Strongylocentrotus purpuratus
  source 1..322: mol_type = unassigned DNA
tagcttttaaagctatcagggatccccttaacttatgtcgatcctgtaataatatataaaatgaagtatttgcggtttttccatgaacaattgcaactaactcccatctcgccttttatgtgcattttatgcaattttaatattgcagctttttttttttttttttttttataaaaccatatcactattaatttcatttcaccaaggaaagtcgctcgtgggcttgatttccgaagcccacgccaaagctatacacgaaattgactggcgcaaataatctttgagattgaagagcgccatctaaacgaagaaccaaccaacc

SEQ ID NO: 1675 - protein, 1206 aa, synthetic construct
  source 1..1206: note = Description of Artificial Sequence: Synthetic polypeptide
MCIQETWFNDFNVLSIPNYVCVCKNRPDGRRGGLVMYLKNDITFQAMDTPRNAEYQKVDIFCKNGVISIFNYYNPCKKIELIDLNNMIRNVPGKYLILGDFNSHNPLWGSNKLDTNGRTVESFIENNDLVLLNDGSPTRLDPYYGTYSNLDLSLVSKELARNTEWKVLSNNFGSDHNLVCLNFKHVYNRPGGENMGQRWSFRKVNWEEYREEIEEALRKEGYENLGAELNIQGRYNVIVKVIKETSNKCIPRVQIAKRRKVNPWWNNACKKAVQERNRLKNRLRRYYDLNDVKKYLKKKAVAQKVIRRAQYDYWLEYCRRMNRFTDIGKVWEQVKRMRDSTMNKHIFHNLFVDGNILKESEEKANAMATYFKSVDESLSVTKNENENILYNNSSTNDDDCINDDFNMSEMGNVLKEMKNSSSGKDDIYLIMIKNLPNKALVYLLNLYNDIWKISLFPHQWYEVIQIPILKSGKDPTQVTSYRPISLISTFSKIMEKMIKNRLTWFLEKNRLLNPIQSGFRKYRNVKDHLVRLETDIHISLKSKKYTVAVFLDLEKAYDSLWKTGLLRKLSILGIGGKMLLFIKAFLLSRISNVRINNYMSRHYTLENGIPQGSSLSPLLFTLMLNDLKINVSDVKLSCYADDIAIWCSNKDLELARRKLQEALHELEIWCWTWKLNVSPTKSAVLVFTNKQKKDILLQIKGHNLPICEQYKFLGVRFDSNLTWSVHIDSIIDKCKKRINLLRCVSGTPWGSKYEILMMIYKGLILSILDYGSEMYDSACISLTKKLDSIQYRALKIITGTIHNVSLEALQVLTGELPLRYRRRLLNDNFRVYLLSSTLNHPTKEVLGDDYDLNNLEWKIGEGPFKLRSFRDEVVVEGQTNLLPKIPEWRLARPQVSFEHHGKVQKKEMPPFEIKSIVLDSIGNSWNGFLHIYTDGSKLEDGKTGAAFYVSHYNVVKFFRLSHVCIMRAELVAILMALEWINTFIESSSVVIFSDALSALQMIDSYFIRCAIVNEILSIINILQFKDVCVAFEWIPSHCDIRGNEIVDRAAKKGAMKRCIDIVIPNTRSELAASRLIHYNKLWQAEWDNAEHGRFLYALHSDVSKPIHRQGLSRREECLIQQLRVGNCSLNYYLFQINQHDTGLCEVCQEDETIKHFIFYCTKYDKDRRLLKERIKLNNPNLKQLLMSNPIFTRELLGYIYDTNRFR

SEQ ID NO: 1676 - DNA, 1041 bp, Xenopus tropicalis
  source 1..1041: mol_type = unassigned DNA
tatccctctgctgtatactgccatataacccactatattgcagcctctttattaatggtaattctcatctgtgtatccctctgctgtatactgccatataacccactatattgcagcctctttattaatggtaattctgtcatctgtgtatccctctgctgtatactgccatataacccactatattgcagcctctttattaatggtaattctcatctgtgtatccctctgctgtatactgccatataacccactatattgcagcctctttattaatggtaattctctcatcttgtgtatctgctatgccaataactcattctattaggcctaccttgatttagtacttgccatagctgtgtcaaactcacatctgtgtccactcctcagtgccaatatttcacaagtgctaggaaaattgcagttaaacaaggcagttcatggaactaactcatatctcttctcacttctaatggtaattctcatctgtgtatccctctgctgtatactgccatataacccactatattgcagcctctttattaatggtaattgtaactcatcttgtatctgctatgccaataactttttctgttaggcctaccttgatttagtacttgtgatagctgtgtcaaactcacatctgtgtccactcctcagtgagcaagagatatttttacagccccaaaacttggttctggtgcttgtaaaagtctccccctccccacacagcctgcttactttgatccctgattgaactgattaattagtcaattagtttctggctttccccaatcagctgcatataaattcagatgcagccttggggatggcactagtgtcaggggcaggcactggtgctaccatttcctaagtgccaacatttcacaagtgctaggaagaagggaatggcagttaaacaaggcagttggacaaggcattgacaaggctacaaactatctcctatcaacactgaacaacgtggaatcgcaagaaaacaactttgcttattcatggtagtttgttatttcctatcccaaa

SEQ ID NO: 1677 - DNA, 243 bp, Xenopus tropicalis
  source 1..243: mol_type = unassigned DNA
tagcaataccctgtgccccacctctcacaactctggtcatgcccattcccacaccttgtgtctcaaccctttctccttgtagattgtaagctcttttgggcagggccctcttcacctcttgtatcggttattgattgctttatatgttactctgtatgtccaatgtatgtaacccacttattgtacagcgctgcggaatatgttggcgctttataaataaatgttaatgtaatgtaatgtaat

SEQ ID NO: 1678 - protein, 1163 aa, synthetic construct
  source 1..1163: note = Description of Artificial Sequence: Synthetic polypeptide
MFYPALLLFALSCFLKHLQPHPPSSQKGITITASLLSSPSLSAHEVFKLLCSITPVNSFSSHKTKTYKSRSHLAFLSFLLLAAGDISPNPGPYPIPVLLGTRSPNPPCTPLKYRTLTPIPKASIQISCALWNSRSVCNKLTSIHDLFIAKSLNLFAITETWLSPTDTASPAALSFGGLHLTHTPRPGNRAGGGVGLLLSPRYSFKVLPPPPSLSFSSFEVHSIRLFSPVSLRIAVIYRPPGPTSQFFDNFSAWLPYFLHIPTSWTDLTILDSFSPPAIHLKSFHLLLLFHFPHLRFTLLGSSPLFRFALRSYTDLLDRPHNSLTTFLPGFLTSFIYRPPGPTSQFFDNFSAWLPYFLSSDSPSIVLGDFNIPVNNPNAPATSKLLSLTSSFGLSLCSDSPSHSNGNSLDLIFTKCCSTSNFTNSPFPLSDHNLLTFQLSLTPSTPSAVPQTYTYRDLQSLNTSHLSSSFDSLHSNILTVSCPNQATSVYYSTLTTALNELAPAKTKRMRPKPLQPWHTAHTKSLQKQSRTLERRWRKSRSESDFCSYKSALLSYNTTLCQAKQTYFTALINSLSKKPAQLFSTFNSLLSPPPPPPCASVTAQAIAEHFKNKIDTIRSDIAQLNPHNHSPPSLHAPQSLLGSFSPVTEEEVSKLLSSSHLTTCPLDPIPTKLLRNANPCLIKALTHLFNLSLSTGIFPSQLKHALVTPILKKPSLDPSNPTNLRPISLLPFISKLLERLVYNRLTLFLSDNNLLDPLQSGFRQQHSTETALTRLTNDLLSAKAKKHYSLLILLDLSAAFDTVDHPLLLQTLRSLGLRDTALSWFSSYLSDRSFSVSYNGESSSPLPLSVGVPQGSVLGPLLFSLYTSSLGKLISSFGFQYHLYADDTQIYLSSPDLNPELLTRVSSCLSAISTWMSQRYLKLNLSKTELVLFPPSNAHIVPEVSITVNNSTITPSSQARCLGVILDSALSFTPHIQSLIKSCHFHLRNISKIRSFITQDAAKILIHSLIISRLDYCNSLLIGLPLQRLSPLQSIMNTAARLIHLSNRSSSAMPLCQSLHWLPLPSRIKFKLMTLTFKAVHNSAPPYISELISRYHPTRLLRSSTDLLLNSSLIPSSHARIQDFARAAPLLWNSLPQTVRLSPNLSAFKRSLKTHLFREAYPNLV

SEQ ID NO: 1679 - DNA, 117 bp, Vitis vinifera
  source 1..117: mol_type = unassigned DNA
ggagtgttcagtgaattattgtgggactagaaagagtgcggggttgcttcagattgctaactgaagtttgggtttgttggtccagtgaggggagaggggcttattaagatggatgtt

SEQ ID NO: 1680 - DNA, 150 bp, Vitis vinifera
  source 1..150: mol_type = unassigned DNA
taagggtgtggatagggtggctcttcgttccttggcaggctgctagggagcgtggggtgtttttctttctttttcttttctccttcttgtacttttagccactgcttcggtggtttttaatacaatctctttatttatcaaaaaaaaaaa

SEQ ID NO: 1681 - protein, 1217 aa, synthetic construct
  source 1..1217: note = Description of Artificial Sequence: Synthetic polypeptide
MKLRVLSWNVRGANDSEKRKVIKALIKSQKVDVVCLQETKMQEMSRMIVRSLGVGRCLDWKVLNSRGSSGGVLVFWDKRVLHLLEAEVGNFSVSCRFKNCEDDFCWLFSGVYGPSLMKEREDFWAELGAVRGLWSDPWCVAGDFNVVRFPVESSRGGRLSASMRRFSEIMEDLELRDLPLQGGSFTWKGGLNNQSHSRLDRFLISNEWEDHFSGSVQYVLPKPTSDHFPILLDGGGVRSGPMPFRFENMWLKEEGFKEKMQGWWVGLNFSGSASYVLVSKLKALKSLLRDWNKLEFGKVEVNKALALSQVDFWDKMELSRTLSVQEVDARRGAKEDFKKWALMEEISWRQKSREVWLREGDRNTKFFHKMANAHRRGNMLSRVKINGVWLTKENEVKEGVVNEFKAMLSSAGGWRPSLRGLSFERLEAVDAASLEEPFSEQEVMEALKGFCGDKAPGPDGFSMAFWQSSWEFVKEEVLGFFREFHNHGRFVKSLNATFIVLIPKKGGAEDLRDFRPISLVGGLYKWLAKVLANRLKRVVGKVVSKAQNAFVQGRQILDAVLVANEVLDSVLKNKEEVVMCKLDIEKAYDHVEWSFLFSVMRKMGFGEKWIRWMKWCISTVSFSVLVNGSSSGFFQSSRGLRQGDPLSPYLFVLVMEAFSSLLRKAVAGGFVSACKARSRGGEGVNVSHLLFADDTLVFCGASKVQLLHLNWILMWFEAMSGLRINLDKSELIPVGCVNNVEELAAAIGCKVGSLPTSYLGLPLGAQYRSRAVWDGMEERMRKKLARWKSQYISKGGRITLIRSTLANMPIYFMSMLSMPRKVRLRLERIQREFLWGGGALERKIHLVKWELVCLEKDNGGLGVKSLSILNKALLCKWSWRFAMEREAFWNQVIRGKYGEEQGGWSSKEARGETHGVGLWKTLRKEWEVVKSRLVFVVGNGKRIKFWKDIWCGDEPLCVSFPSLFALAVSKDAWVKDVWRCNEGGGSWSPLFSRPFNDWELEEVCSFFVALNRKQIQQGVDDRVIWRETNCGKFSVKSLYKSLVSGHPISFPSSAIWKVTVQPRVSFFGWEATWGKALTLDQLQRRGWALANRCYLCQRHEESIDHILLHCDKVRTLWVLLYSMFGVQWVLPATVKETLSGWNGSFVGKKRKGVWKASPLCLFWTVWKTRNKVAFEEEELSIQRLKASFVYFLWSETKRSIKDGPSTLVDFVGWVASR

SEQ ID NO: 1682 - DNA, 363 bp, Schmidtea mediterranea
  source 1..363: mol_type = unassigned DNA
gtcatagggtgaactgcaattctgacacgatgaccgagctgtgtcagtttgcagctagtcgctaaagactcgatcagtccgccaagtgaggtggccgggtatctgcagcactagagccactggtatcaagagcagagatacgcgagtggaagttgagtacgactaccttcacggggtcctcctgataaccacagtggactgtgggaactaaatgtgtgctcagcgttccctactttctcgtagggtaaagggtaagataacccagagaatatcccatgggagatatccatggaaaaagcaccacgttagacaatccgatggtctaactcggctccgaggggctaactatcccaaagggcttaa

SEQ ID NO: 1683 - DNA, 257 bp, Schmidtea mediterranea
  source 1..257: mol_type = unassigned DNA
tagaagggaaacaaaggaaaaacgaaatgactggtaactatgaaggatatagctgaaagccgaaaggaaggctaagtcctgaaaccgatctacatcttcgatcccaagaggaactgtgggttaagcttgagccgacggaaaaagcgaatgcatgttagacgacgaggtacagtcacctcctcgtggtatttggcgggcaatgctcactaaattaactgtgagtagctgagaactgtatgtgtatcatgaaaaaaaaa

SEQ ID NO: 1684 - protein, 1128 aa, synthetic construct
  source 1..1128: note = Description of Artificial Sequence: Synthetic polypeptide
MRKELVTIKNLIEESGATAPAPVPLEVAVEVHQSSSVPEITDQSTTTQEGSYSEPPIHRCENCGREFRTRAGVQQHRRKAHTNEFMEEKEKAAPTKKLRWTDEEKEILIESEIKIIKEGSLKEQHEINKILASRMPGRSQDGIAKIRQKQEHKAEIQRRLHGTVTTDETRGSRTSEITEPIRSLPINTKNWSEDELKRMLAEEVKLRNKNEKDINKKLAEIFPNRTMGSIKSKRTKDKEYQDLVKLTMQTISENPDNETDFNTSNTENNSTDAEKEVKNYLNMLLLSNNEEEWLTSTLKEAATLALQGKKTEASEKLNEYASKTLFPGLKITNQTRKREKKISKRETRRQEYAEIQKLYKKNISSAAEKAINGKWSIKPEEEYHNNKDLIKAWKPILEAPPFSDCRPIENIKEMDYALMEISTAEIFLAIRAMGKTAPGPDGIKYSKLKKNIQSMAILFNTCLLTSFLPLPLKIARTILIPKQENPGILDYRPLTIASVVTRVFHSILAKKLDNNAQLSQRQKGFRKCDGVAENIVILETILTNSRSEKRPLCMAFVDLRKAFDSVGHESIIRGAKRVGVPPMLLEYISSSYQNASTNLFGEILNSRRGVRQGDPLSPILFNFVIDEALENLNRNIGYLLKEEKVSCLAFADDIVLIAETKGGLENHIEKLLEKLNGAGLELNASKCATLMVMKNGKEKSTYISTKVIKIKENDIPTMKATETYKYLGLQMGFKAREQNANEVITEGLENITRAPLKPQQRIHILRDFLIPRLIHKLVLGRVAKKSLKRIDQNIRKKVRNWLHLPKDTTAAFIHADAGDGGLGVPALEHTIPLLKRERITNLRKSNDPVTKECLRMEYTKQVLGKWSRPTKIGETLATNKSQLKEAFRKQMLITLDGKGLKDHHETPTIHKWIRRGENMTGKQFITAVKIRGNLVATKSRNSRGRPEQEKLCEAQCGRPDSLGHILQGCWRTHGMRVERHNNICRRIKAIMKGKESEVVEEPRLQTNEGLRKPDLLICHKGKIIICDAQVVADSSNCSLESENQRKIDYYKKDSVVAEARKLIGRDDEDIIIMAVTFNWRGAISKTSIRDLDMLLDIKSKEVIKMSRKIIRDNSIMVEMHRNRTEKRR

SEQ ID NO: 1685 - DNA, 102 bp, unidentified
  source 1..102: mol_type = unassigned DNA; note = Description of Unknown:Nasonia vitripennis sequence
ccattccttcgtacgggttttcgtgccggcatagccgggtgggagactcgcgcgggggaggtcatatctcaccaccatcttcgagctttttgctgcacctga

SEQ ID NO: 1686 - DNA, 257 bp, unidentified
  source 1..257: mol_type = unassigned DNA; note = Description of Unknown:Nasonia vitripennis sequence
tagtggggccataacacctaggccccacagtgtggcgatgtccatgtgtgtcgtccttatttatttatttatttgtcctgtcgagctgtttaatttattcacatgtatgtgttgtgtgtgtcgtccctcgtagcagttttattccgtccaaccagaggtcgaccaagattaaaataagcatggcttgaagcaggccaagcgccatgttctaaccccgttttaggggaagttacttaacctaaaaatacaacttttcc

SEQ ID NO: 1687 - protein, 1204 aa, synthetic construct
  source 1..1204: note = Description of Artificial Sequence: Synthetic polypeptide
MSGLTGREVKCITVNVLMEQQPHTKAIREGDFIVILLPQSDDETLCCPLCVGRGRYSGKTRVECLNRHVKEVHPDLTTTFRCWGCGFAAPGDKKYPRKIVTQHCATCVPEVSSAPSGRVDGERRVNTRRRLGIAAATEASPVRRTRRNGLASPPVEQDISQSAAPPEPARVPQHPEIVALGESADDEVFRSPVNSPPRDWRAAAPQQAASSSPPAVPGITAATPSNTTRTGNGSANSILAEHPIPTPPPTNTTEANGRADIPRSGRTPPPGQQAARRRAPTTEQRRIVGLLEAATGREQLEEATTQAMLFLARLTGRRPEPRNAIRPGPRQRHPAQEDVQAQAPDRIQEAKKLQRLYRTSKKRAVQKILAGPNMNCQIDKNTITAHFVELAARRDGGEDWPDVFDREEPTAASGEALCTPITREEVFRRLKGRNNTSPGPDGITYRDLAKADPGAHVLAALYNSIWRIEATPALWGVSNTTLIYKKGDAMDISNWRPISLGDTVPKLFAAILADRIKRWAVANGRYSASQKGFLEFEGCYEHNFVLQEAIREAKGGRKELVVAWLDLASAFTSVPHSSILQALEGHGLPSKARNIISSLYTGMTTRFHTAEGPTDPILIQSGVRQGCPLSPDVFNLTLEVVLREIQRTGEGYTIEGRRTSHLAYADDVAILADSPAGMRRLLFAAERGARAVGLTFNPAKCATLHIAGRGEEAVRPTEFSVQGTPVRALASEEAYEHLGIPTGYQVRQTPINTLRDLLADIGSIDRSLLAPWQKLDAVGTFLLPRLDFIMQGAHIDKGFLTEADKIIKKAAKSWLSLPQRASAELVFLPPSQGGGGLLTVAHSYKMLYSSDVTVSTIAGSTLRRTVSERLKKRASNIDIARFLSGDLDLPRSTSPSTFWTKVRSAALRIKTKLGLRWSWCQEGEVLLMACGDPRAPGTRVSPQTKHLVTTSLRRCLNRHYAESLLAKKDQGKVFEVTRRSGQSNHFLRSGSFTRFCDWRFIHRARLDVLPLNAAKRWQRGMDKRCRRCGSDLETLPHVLSHCGPHSAARQKRHNNIQDRLVKAASRCPGTISVNQTVVGVRGPDAALRPDIVVRDDVNRRVTIVDVAVPFENRLEAFDGVREAKIAKYTPLARQLTDSGYTVTVEAFVVGALGAWDPRNERVLSLLSISRYYAILMRRLMVSDTIRWSRDIYVEHVSGIRQYRE

SEQ ID NO: 1688 - DNA, 209 bp, Schmidtea mediterranea
  source 1..209: mol_type = unassigned DNA
aaacgacatcatgaacgcttggccgcaacaatccagttatccctgcggtaacattgtggaactcataagacaagtactaaaagaagaattagaaaaattagaagaaaaaattgaaaataatttatttataaaatttaaaaatttaaatttaaatttaaatgaagataaaaatttatttaatccaataaataatcaagaaaatcaagaaa

SEQ ID NO: 1689 - DNA, 500 bp, Schmidtea mediterranea
  source 1..500: mol_type = unassigned DNA
taaaagggcaaaaagatatttcaagatgaattgtggactcatctaaaaaatgaccacctcgagcccaaataagcctagctatcatggttgctgatggaaacagtaaggcacctgatagctaactcttcaccgtgggtgtcttcagacactcacggtgacaagaaaggacaccactagtaaaaaccactagttttctgacacctcttgctacaaactctgtaaaaatcaaaaggatcgataggccgcgctttcacggtctgtattcgtactgaaaatcaagatcaaggaagcttttcccattttagtcaacaccaggtttctgtcctagttgagcttcccttgggacatctgcgttaccatttgacagatgtaccgccccagtcaaactccccacctgtcctcaaaacagttcaattgcatccaaagatcgcaattttttcactaaaaaaaattaacaaaagttaattatactgcttcattgagtaagtagaaaaacaatc

SEQ ID NO: 1690 - protein, 1522 aa, synthetic construct
  source 1..1522: note = Description of Artificial Sequence: Synthetic polypeptide
MMDSRQLNTPKIRKYQNPKMTNDIMKSYNYAVLSDVTPQETTQQTTHLNVDIDKETTQPKQPLTKSGKPKSKPIAVSYKFKDATFIWDTTPQTNPPKDCTKLIDKTRPRKTIFKKSAFQTYLKKELSNETFVEVKTFLMATHKYRFKDENSRLLAYRIINRYVMETANEFKETEFDMARFAKFFTIPENWLKHLKPYSTATETSPADRIKVQKLVDLTCRYPFKTQEEQTSVANFLHFFTQRSIIGISRDYKFQKCIPFMARKTNGQETTSTINTTPPTEENRLPMVIITPLEEPKIEHRRPEKRGASNDTIVLSDEEFPLLKRRTLPTRKSKNPTGAGNVPTETECTDEVKFILNNEYQIECKECGKVWENVRNGMNHLRQKHDFPNRTDVMVSCVRCEVPIKGAECVNHIKNHKKDDKEESQAGSLVANTQDIPNESSLSQAAIEVYLRNILKMKENQERNIQYLEPSTANFLINRNLRAFYQNVKIEKLIGWEQVIWLIHWNKCHWIVYLANCDSKTSVILDSDNQMTLQQRCNIKAKFDKFLEGTFEEKAVLGTLERNVPQQPNNFDCGVYVIQYISDFLKDPQRMDYHTPDSKRIRKEIGELILEEMKNPASKIKNPNKEIQSLLQKFRLLQINVNDVFHWFAEEYQKSLPKIRTKRDGKLNKLSCSYQIQRLFGLAPKRAVKEIYFQETSTADLETRVLNEHFKKDESMMKECKIKNGNHYQDWITKAQIDNKEILEALKNSTDSAPGEDNIPLRQWIIWNNDGVLFDMFNYIKRTHDIPEMWKNYTTTLLIKPGKSQESNIPANWRPISILPTSYRIFMKVLNKRVLDWANRGELISKWQKAVDKANGCDEHSYVIQALIEKANRSYYKNEQCNLAFLDLADAFGSIPFQVIWHTLKNMGMDEKTINLLKEIYKDCSTKYKCGKNESEKIKITKGVRQGCPLSMTLFSLCIQYLIQGIAEKKKGATIAGQEVCILAYADDLVIVANTAKDMQMLLTTIENLAKQADLIFKPAKCGYYRDPRDKKSMMKIYGKEISIVDEKNVYTYLGVRIGDTKKKDLNVRFEEVKKKTTAIFKSKLRSDQKLEAYNIFCQSKFVYILQGEDIAKTKIETYDEEIKKMIKEDILKLQDKSPFTDFVIYSPREKGGLGITKIIDEQIIQTINRTAKLLNSSHRAIRAIIYEELIQVANLRGEKEINSIEEALKWLEGTNKYKKNSNAKTTWITRVREAFQTLEKKHKIKVRFVPKENGIGYKIKCDTQEKVEELDNSKELSKSLHWMIKEAYFKEWKTLKCQGYILSLKTSEFMEWKMPRGLPDPDWRFLTKVRANMLDINMKQANQGGRLGNTKCRKCEDKESASHVINHCASGNWSRVEKHNQVQNELAKELTKRNISFEKDCIPKETKGTLRPDLVIRLKDKIMIVDIKCPFDEESAIESARNKNIDKYRELAKEIQAKTVLPTTISTFVVCSLGTWDKRNNELLRQMGIRYEESKEMRINMIHKAIHGSRKTYDQHRNFNNG

SEQ ID NO: 1691 - DNA, 175 bp, Taeniopygia guttata
  source 1..175: mol_type = unassigned DNA
gtctagttacaactgggcatcgctgcagagatcgcacctcctcgtggtcccgctggtagcccttcgaagggtgactaagtcgatctctgccccaggtacggagccgttgggactcaccagtccaacgtaactcctgcctaaactcggtgaaacaaattcctcggtaaaaagcccc

SEQ ID NO: 1692 - DNA, 328 bp, Taeniopygia guttata
  source 1..328: mol_type = unassigned DNA
taattcaggttatttagatgcttagtttatgtacctttcttgatttgtctaggattttgatagtgttattatttttatatttttgtacgattgcataatgttcttttttatacagctctgttttaataaaatagacgatacctagagacgttagggcagccacaagccagttaggtagcggatagtaggtaggaacagacttttactatttcataacgcgtcaattaccacctgatttggaccaattcacgggatttgtccaaggtggacgggccacctttacttaaccaggaaaaggaacatatataatttatgtgtgttcgataaa

SEQ ID NO: 1693 - protein, 1390 aa, synthetic construct
  source 1..1390: note = Description of Artificial Sequence: Synthetic polypeptide
MASCPKPGPPVSAGAMSSESGLTTHSVLAIERGPNSLANSGSDFGGGGLGLPVCLLRVSVGTQTSRSDWVDLVSWSHPGPASKSQRVDLVSLFPKHRVDLLSKNDQVDLVAQFLPSKFPPNLAENDLALLVNLEFYRSDLHVYECVHFAADWEGLSGLPEVYEQLAPQPCVGETLHSSLPRDSEPFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKTRLLSRKPAEETREEPGVCHRTRRAAASLRTEPEMSHHAQAEARDNGPGRRPLPGRAAAGGRTMDEIRRHPDKGNGQQRPTKQKSEEQLQAYYKKTLEERLSAGALNTFPRAFKQVMEGRDIQLVINQTAQDCFGCLESISQIRTATRDKKDTVTREKRPKKPFQKWMKDRAIKKGNYLRFQRLFYLDRGKLAKIILDDIECLSCDIPPSEIYSVFKTRWETTGNFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLQTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIANFERDKISNHWIQYYRSIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRQLTNAKDVTFVGFPLGARGKWHQDNFKLLTELGLSKSRQVKMAETFSTVALFSSVDIVHMFASRARQSMVM

SEQ ID NO: 1694 - DNA, 579 bp, Aedes aegypti
  source 1..579: mol_type = unassigned DNA
acggattaatggtgtgaatgtgaacgggaggtttcgaaagacaaatgcatgaacggagctagcgagtgataaatcgggagcggggagacgaagtgagaggttggtgcgagagagacgaagtgaaaggtgggtgatagtaaagtaggtgagatgtgtgagaggtaaatatatagacactggagtgaagtgaccattggattattagtagtagtgtaggtcaatcaagaagtggtgaaggtggtagtgacgatgacggttaggatgccatagataatatataaagcgacttggtggtgttgaagaaatgagaagggtgtagagaagagcggaaaagaaaggtgaattgaaacacaggggtgttcaactgaattgggctacgtgacaggattggagcgataagagaaaaataagtgaaaggtattaattatttaaaactaaggtaagacgactgatgactggaatgcattctaatacactgatgaattaaggtaagactagatataagcaaatatatattatgagttttctttttctttatcaattatagcataacatttataactacacaaagagtacaaa

SEQ ID NO: 1695 - DNA, 4172 bp, Aedes aegypti
  source 1..4172: mol_type = unassigned DNA
tagtaaataattgaagaagtatcaaaaaaaaaaaaaaacatacacaaaaacctacaaaatttacacacacgcataaacatattggaaaataacacatatgagtatgcacaaatacgaattatacatataaaaagatacgaaaacaaatatacatacacaaaaacatatgataactcacacgaaacactaatacactcaatcactcataaacacatacaaaataatcaataatgaaaattactctgaaaatacacaaaacatagatactaaaataaacacacacataaattacacataaacacatatacagtattgaacagaacatttgcaactttttcggttttccatacggaatggccggttttggtaggtttgatctcggttgtttgtgggccgaattgagtgagattttcacggagcattggatttcggcacgtgtttttgaatggtttttccgattatgggtttggatgtagtggcggtttgactgaagtgaaatttgaaatttaatacccctacacaaaaactgtcttcagcaaacttgttcatagcgtcaaaatagacaactttgctgaaaatatcatcaagctattctgttaacgtgttgagttatgtcaataaaaaaaaaatcgtaataagggtcgctttggtcaaaccattaatgcttttgaactcgtggttggggggatcagtcggaggcatgtgttgaggttcgggttgtgcctggtgttctgtgggggtttcattcggatcggtccgtggatagctggggtctggcttgccggggttggtcgtttcgtgtggggaccggggaggttgcgagtgttttgtcaaatactgtaaatacatacaagacaaaataacacaagcacatgtatatatatatgagaacacatgcagaaatagacattgacttataacacaaattaaagctgttttaaaaagataattactcaattttaataataaacacatagcattagtacaagaatgacatgcagtcatcagtcgtttgagttggttaaaagaaaataaaattgttcgatttaaaaaatgcaaggaatttgaatatcatataattaactagaaataataactacacttgtttactttcgaggaatgattagaatatctcgcgttcggtatcgtggctgtggtgatcggtttcacttcgtcgattttccttttaactaattacttggccgggcgactgtttttgactgctatttagattgagattgtccattgtcatgctaaatcgtaaagtgttaccaaaatctattgaacttcgtgtattaacccttactcgacgaagagagatcgatcactgcgggtacgcctgtatgatgctgaacgcaagttatgaatatagaaaactcttctcttcacttttgcatgggatgttttagattagcagtgtttgttcgttttactggtgattttagtgatgtcattgtgttgtgtgggtttttcttttatagccagtagattgttgcagagcgcccaaaggggttcagattatgatcatagtggaatttattattttcttgttataaataatataagaatataaagaataattacaattatcttcattgtacaatgcaaatcataaactgaactccttaataataaatgtctagttattttttatatgttaaccaattagaagttttgaagtagtacaataaagtagattagtaaatgtgtatatgccgaaaaaaagtcttaatgccaaccaaagttataacaaggttcagtcgtagcattaaaattcagaataacttgtcatgccgactgaatgttgtttataaaaatcaaagaagaataatcataataataaaaataaacatggtggagggaaatgatagcaacgagaagcatcataataattctatgagaaacttatagcaggttataaataaatatgatgattatttctactgttaacttattattcaaatctttaaaaatagttatagaatgaaacattgctattgcctgatatgaaattaaaataattgaaaaaacattaataaaatcaataattagttttgaattcaaaaaaaaaaataaataaatacaaatattaaaaataataaagatacataatgatttggatgatgtgagggaggatgggaggtcgttgctatcatttgtctgtatgtataaacataaaataaatgttaaaataaacaagtatgtataattttagtcgctattaactgatggatatactggtaagaatacatattcgtcttgtttgcgagcagtgaacagtaaattatacatctattgcagtttaacctgatgaaactacagagtataatgaccgttacataaccgaattatattaacactagtatgttaaattcaaatttctaatgaattaaatttcatttctattaaatttatagagaacaaaataggaataatcgatggatcgatgttggagctgcaaacagactaaagctgcatattgcacacggtcctctatggagttatatttcataatttcttctctctatatataaaacattttaggggcagcagcaggaaggtgtgagcatttaaatagtgttaaaattgaagctctgaaccgtatttctcttaggtacgaaaagcgttaaaaacaaaacgtaggatgtacggagtatcataatggttatattatattgtagtttattgtacgagaccttttagaacaataaatcgtcaattgggaaattcggatatgaagtggtgttgcacgaaagtaacatcagtagcaacagtgttgtcgtttcatacaagggactagtgtgtaatgttattttatgttatattgtgtagcgttgtactatatctactgttcataggtaataaataggtatacaaataattcctttggcgcataaaataacagataattcttattccttatagctactagtccagtggaggtgcacgaattacttatttataattgttttgttatactaattcattggcagaaattccagaagcgtcatggagtcatcggagatactaacataatcactgctattaatatttcagcagttctattccgaaaactgtaattcgtccttactctggagactacctaacgaggttcaattcatcacaatttaagaatggaaattctgaaacatctatattcatatcatatacaactataaattccattctatatattttattatagttatttcatttattatatgctgggtattgagagggtgcattagggcatcagagaagtcacagatggacgatgtagtagggtgtcagccgaaatctaggagaatgtgccgtaacatccttacactacatgctgctacttataaatgactttaatgtaattatctttgtttactacagtaggctatagcgaatgaaacgaagcgtcggatgtattattattttgtttgtactccatgaacatatggaagctggaattttgtttttgatgtatccggaaactttattaacatatcactgatttttttatttttattcaaattatttgtttattcttatcattcttctgtcgaccagcctaggagcatctgtagcacaaatattcaaaagaaaattatatgtcggccgatataatactgcatgctgtttcactgcgtcataatttattgtaactaccattttattttcatattttattatcatattattatatatatatacattataatcttatctactatataacatatcaatataattgaatttttcatgatttgggaagggagggagcatcagggcatcattgaaattacaactggacaatgaagtggagtgccaatcggagtcaggaggaaaagtggtagtcgttcacgtctagtacttttctctccaacagttgtgaaagatttgacgcgcccttcttctaacaaacctttccgtggaaagctcgacaagtaatgcaaattctaatactcaatctgttggatcatatggctggaaggagattctctatttcccgcgggtttcgcgtaagtgtttctacttacgggtccgccaccccccttttggcccttcatacagcgatatgttgaatgcagattggtaataaaatttgaccttactgttgagtggagccgcatgcagagcaagactcaagcaaggattggtggctacctacatacatacataca

SEQ ID NO: 1696 - protein, 1584 aa, synthetic construct
  source 1..1584: note = Description of Artificial Sequence: Synthetic polypeptide
MDLFNFDINDFQTAVVQKIPAGSFITAIMLQINKINSEFKNHQLNEMEFCCLIADFIRCNDHLFSKMWEEDIKEVVHKIFSMESGVEVHMAQAIVELFQTKICFYQKKREVEVIQPNSCSNTNMLTEINILFTFEDGTEKFYSIQSITDKKSSGKKESGYNEQPRNELYKVKEYESGREMMVKKIKGDGNCFIRAIIDQMNKSEDYYRCNLSDIIELRNKIANHMNKNRERYEMYLIESLEENGFLKFIEDIRKPGVYLGHESMVAVTEIFDKCILLYQTDSETLRIGEEKDREEDVLRLLYTGENGVKNHFDSIRIVKGQTEENTGTEKTSVEEVKEKESYTSMHGKHNDDSEEISTIRYRKTQDTPITGKQIKETGKLVQEEGKQWQWNKERNNQKKSDDKKAVEKNMDERGNETRKITREKHKPINKDRAITKDFITDNRKEEILDLEEKRRRQRSKEREDRLEQLATQIKTNEERSMLINGSQRQGWEENDSQERLDREKQAKTDKNTRGRIQMDVQGKTEEPLSIVNDEQVRKENNTKDVKLGDKKENPRISTKQRNDRKRAKNERVDEEGVQENSDTMDGGTKKHRNHVAEERGETRKGQVIESEESRATGVKATGEIGEENEEVKESIMLIATLNIRGCSKLEKRQEIDNMLESFNIDVAALQEVNVKAELITTRNYEWRIGGQGQNKSRGLAILIRKDKGIDVMEWKEIGKYGLSISLLSKGRKIILINVHGPNKNGYIFYSSLGKLISQDHLRSNLIMVGDWNAQIGKDSVMPEDAECIGNRLGFSNNNDNGEEFKMFLTIHKIKNMSTVIGKNTDITWKSGKKESQIDHVLKPREGKIEIRFIKGYWTGINTDHKMIVTGIRTREKENKEKGKKKIPIDASVLKYDTIKEKYQEALKKYEIRQEKGNTIEQDFKAVAGKMKKAANEVLRSARAPLTPIRKAALNKLKTAINLSNKHPDIFPYRWKLKDRRMEFQAAIRSHNERKIKKFYKELNDFDVAVRIKKSYQFLKGFLKRKKHKNVYIPMSQWNEALKESEGPEIQLMDEHDTCPVTVPPKEEEMMQIVQQQCNGKSAGADGIRMELLKYADKQTQQELADIWKRVWIENHLPEDMEKTIQVPIPKNAKAKGVQDFRRISLCNVAYKPYAKWIKQRLREFTGEPDINQAAFTEGRSTDDHMFVTRRILEEYWNAGNPLYVAALDISKAFDNVSLLQLRSILAKLNVPSHLIDRVLQCIRKEKIRVRWQNQYTTECNRGKGVKQGCPLSPFLFNIVMQDVVRKVKEKVPELNLMNTGSLKLPLILIFADDILIITKDEEGLKRILIALEESLREVGLEINNDKSQILIRAPNATKRPPNTINLNGRNYDVKTSMRYLGAWLTDTLNRPATTKQRCVNAAKVSKLVVEFCKKFKPTWEIGKLIYNTVIAPSILYGTKTATLTKRSRVQLGKYEKQILKDIWNQCRKTDERKFNVRKELKGKTINRRVRVNRISYYGHIQRREETHPIKMAMKLKFNKKKHGRPSFTWKKSLEQDFNRYNGITEEEWSQIAQDRDKIKKKAEEIYRNNESEISDGEDSTEQDM

SEQ ID NO: 1697 - DNA, 15 bp, Folsomia candida
  source 1..15: mol_type = unassigned DNA
tgcatcattgccaaa

SEQ ID NO: 1698 - DNA, 45 bp, Folsomia candida
  source 1..45: mol_type = unassigned DNA
taagtgtatttcatactttatcaatgtttatgttaataaataatt

SEQ ID NO: 1699 - protein, 1376 aa, synthetic construct
  source 1..1376: note = Description of Artificial Sequence: Synthetic polypeptide
MPLFNRPPQCRQLCPNPLLSANNATIQVLDSPVSTHNETSRSTQLDAHRSNFVGGSQIAKVESSDLDRSSPFNGVFYRIETGKIIAQPSSSPLPPSSSPLLPSSSPLLPLSSSSSSTPLPLSSSSSPPPPSSSSSPLLPLSSSSSPPPPSSSSSPLLPLSSSSSSTPLPLSSSSSPPPPSSSSPRPHPGPRKKRNKQKKRTKPRKLPPPTSSQPLPHTTEGLNPVFEDLFCPVSGCPGPSSIGTDEWILCNACLIWYHTSCLFLQAIPEGDWFCANCPQIDTQIGPQINSNTSSPANQSYLGTHIQLTQSIPFTNPRASQPISTLSTPLSNFISSKETCTSLTLEWLNNHIVPGGVIEKAILHDAYRRDSLGIFKPINDAEMGKLIKNSFSNIRTKRIRTELHGTSKYHYVGIQFKSEHSADSVFDFQTIISSLRQNCPTLKQCPKACRIPVAQVLKSAVDKCISENTPEAWHLLLTFPYITLQCESKANIKNGQSLNSKIRNNLSIFESLDKNTYQDYLITLSSKNSAHDKPGSTIKDIGPKVISKVSEGNIRGAIRLLTSDDIIAPNSSETLETLVEKHPPQPLDNFTVLDEPNIPPFTTTVEQVISAIFSFPSGSAGGLDALRPQILKDLVSQHTGDVGTQLLESMTKFCNFMLAGKVPLDICPFIYGASLTALKKKSGGIRPIAVGCTYRRIVSKICVKVMNHVFQDYFSPVQVGFNVKNGAEAGAHAARRFFSFPHKSPTAFLKIDFKNAFNMVDRGKLLSSVHELVPTLYPYINQCYRFSSSLVWNSSLIESCRGVQQGDPLGPPLFCLILHPVVSNLGSEFNMWYLDDGTLGGDPTTVLDDFKHIISCANEVGLELNFDKCEVSVLGLQTNTQCILESFQSVAPGISCMTQENAELLGAPLTYESIEHVFRKKINAFSNMAGRLNSIPNHIAYYLLKHSLAIPRLVYLLRAAPIFKSPHLLEEFDSLLHDTLEQITNCQINPLSLEEIALPVKLGGLGIKQSKTLATPCFLASSFATTDLVSLILPSYVTALSDSLVTEAQDLWKSISCDELPRSTISSIQSSWEIPIFNQVCSRILDSSTTPINTARILASRSKESGAWLQALPSRNLGTLLDDNSFRIAIGLRLGLKLCFPHKCVCGTQIDELGLHGLSCKKSAGRHSRHTQCNDIIKRALISADIPSIREPLGCCRTDGKRPDGLTLIPYKQGRSLIWDFTCTDTFAPSYLSHTLRHAGTAAKLAETKKHKLYSELEKQYIFVPVAVETSGVWGMEGLKFIQDVGRRMKDVTGPMSTTFLIQRISLAVQRGNAASIMGAVPSQRGLEELFYILNDRSFYLQKSCKGPNGDLGRLSGSSKGFPNPPTSGFSSTPQAN

SEQ ID NO: 1700 - DNA, 304 bp, Nematostella vectensis
  source 1..304: mol_type = unassigned DNA
aaacgggagatctaatctcatccttggcctcagtgagacgtttttggacgaatcatggacggataccgagttggctatagatggttactcgctggttagagctgatcgcacatacaactctggtgacgggctgctagttttcatacccagccatatttccttcaaaaggcgcgtggatcttgagtttgaaggtattgaagccatttggcttgagctattattccaccgatcgagcccgtgctttgcttgttttatttaccgtcgtccttcttctacctctgcatacatagctcttttggacgaa

SEQ ID NO: 1701 - DNA, 321 bp, Nematostella vectensis
  source 1..321: mol_type = unassigned DNA
taaaaccggatatccattctcatgttaattgttattgcatgttaattaatgtttgtctgtttgcacttgtttctatgttgacgtctgcctgtttttgtagttagttttgtcgttagtttttagttgctttatcaagatgtagtattagtgatgtcttgtatagtttaatttccaagtttcccctttgtatttccgtaaatgtctaacatagttttttttattattatcataggtacttagatatagggagggccatatattataaaactgtaaaaggttaatatgaaaccctcgttaaataaagtttattgtattgtattg

SEQ ID NO: 1702 - protein, 867 aa, synthetic construct
  source 1..867: note = Description of Artificial Sequence: Synthetic polypeptide
MFSHASSAISQQVMVLGDLNFDLLERPLPAPTKQYLSIFDSLGYQQLITKSTRPISNSLLDHIFVSSSDFVIEADTISNTASDHLPIFVAWKLKAGYTRPTGHKVLRFRSRKNFCIESFMHDLSLVPWSTLDIYDDVNDALDQWYKLFNDILTVHAPIKEHRIKRPLKLDWFNAEISAAIKARNCLHRIATSLKTDTSWSEYRRARNHVVHLIRKAKKTFYNDAIKNNLENPKNLWKIIRNISPAKHVNLPNRLTVNDTLYEDTFDIANFFNEHFSNISSQVCNDAVPEFPDRSVLTNFINFKHQPGSYFSIPPISEDFVLNSPSRLDFGKAAGLDELKVFFLKSAAPEIFRSLTKILNLSISSCVFPDPWKSAKVPPLFKDGSLFDRTNFRPISVLCILSKVLERHIHTSFYYFLTSQDLLTDFQFGFRWFRSCELATINLSDSILKNMDSGLPSGMLLIDLKKAFALVDHNTLLLKLGLYGCDELTLKWFKSYLSGRTQKTCFKGVLSNALPINVGVPQGSILGPLFFLLFINDLPLFLSSDLVTDTTMFADDTTFLISGASVPDIELKLNKLATDVHKWATLNRMVLNTKKTKSMLIGSHQKVSNLAESSLSVTLNSCPIEQVNIARVLGVVFDNHFTCEPHIELFCKYINSRISLLRSIAPFLTPAGAIHYYNACIHSQFPYCASVWGNCSQTLQLLLLRSQKRAARTILSADFSVPSVSLFSRLNWLYICDLIKQRKLWTLFSILINPDCPLCLRSKFSFVSHERRTRSSTPNNLVLPQPRTDAGKRTFSFSAISLFNLLLPSLKQLAFSRFLNLNQLPNVTSLAKKKVRDIFHSHLNSVSHLEQLFCHACRFYIDCRCYFS

SEQ ID NO: 1703 - DNA, 111 bp, Aedes aegypti
  source 1..111: mol_type = unassigned DNA
ggtattccaacgggaatgtcttcttacgtaaggatgaaagttctaaggcaatccatgtgagtgatgttagtgttctatcatcgattgtgtaatatttcctgattaagttaa

SEQ ID NO: 1704 - DNA, 181 bp, Aedes aegypti
  source 1..181: mol_type = unassigned DNA
tgagatgtccatattgaattactgaaatgtaatgagttaatgttagtattaagtagaaaataagaaacattgttagattatatgcttgctccctcgaaatattttacttttcgagtggctggacacagttaattatgtaacttttaaagctgcgttgttaaataaagcaaaaaaaataaaa

SEQ ID NO: 1705 - protein, 960 aa, synthetic construct
  source 1..960: note = Description of Artificial Sequence: Synthetic polypeptide
MITLIKINYKAELINELNINFCLEEIKLDKENLNILYLNTRSCRNKEEELYQLINEFDGSVHVVVFAETWLYKNEIFNLLGYDAYHGCRDGRGGGVSIFVLSDYRSQLMLVINSEDNNFLMVELIDQNVKIMGVYNPGRSFNLFFEQLEQILHNYKRIIVCFDFNINLLDSSGELIRQYTYKIQSLGYIILNKLDARYATRISNTIATVIAHIITDIFEYDLQFGIKDTERLISDHRTLTLSMRIENHKKNKPDHKKICVNYENIIRSTSQNTFEICQQFSDIVVVLNEIMTKNRTEILSRKKAMVIRKPYINNALIAEIQNKNELYRQYRTAPGGVLKDELYILYARKRNMLKNKIKFAKEQYYGRKMHKNINNYKKTWSTLREIIFQNGSENITPQALTLKENGKIIDSAAQIAKCLNEYFINIGWNIQQNGTGNDNFLIYLNNMPETRFSFSVVETEKAKNVINSLKSGVAVGLNKISTKCIQKCVTLIAPKLTEIVNNVILSSQFEDCLKIAKIVPLYKSGDKFSKSNYRPVSIIPALSKIPECIMNEQIKHHLLQNELLNKNQFGFLPKKSTETASLELLNFIVKGLDDGEYVGCIFIDLRKAFDCISHELLIAKLSFYGFTPSAVSLLKSYLANRKQQCQVNGVLSEPLLIKSGVPQGSIIGPILFNIFINDLFNIPLKGKLQCYADDAVLKYRAKDLETLQSMMQHDLQLLPSWFSANKMQINNKKTNFIIFSLKTSNVSLDLFINNERLSQVTEVDYLGLAIDKNLNWKSHITLVKNKITPFIFALRRVRGCLSTKSCWQLYNAFILPHLSYMNTVWGSAAASHLNVLKVLQNRVIKTIRKLPFLFPSASLYSPEVLPINLLHKYNCLILVYKIKYKLVESNIRLTEFHDLHSHSTRARQNFYVSRPRTELSLKHFIYSGITQFNALPNHLKLEIHLSSYKKKLKKYLFENN

SEQ ID NO: 1706 - DNA, 59 bp, Aedes aegypti
  source 1..59: mol_type = unassigned DNA
taagtaaatcagtctgtaggaaatttatccaagacgttgcaaataaataaataaataaa

SEQ ID NO: 1707 - protein, 917 aa, synthetic construct
  source 1..917: note = Description of Artificial Sequence: Synthetic polypeptide
MWLRPDVLNSELCSNYTIFRCDRSEQTSSFQRGGGVLIAVNASFRCTSVSLNDCDSLEQVVVSVNLPMSTIYLCGIYIRPTSPPEAYSMHATAIQSICNFSSETDAIIVVGDYNLPGLSWISDEELNSYLPCNASTEAETTFVEAVMATGLYHVNSIRNVNNRILDLAFVSDVCDIEVLEAPSYLLRMDAHHKSFVLRVQIWETRNNSSSDSNDETDFDFSLCDFESLNASLSMINWTNELANKGTDEATAHFYDKLYDVLHSNVPRKRLRPKQKGKLPWWSPELRRLRNGVRKARKRYYRSKSHVVRQNLHVIESRYNKCKVFTFRNYINSIESNLKNNPNSFWSFVKSRKSKNRIPEQIRFQNRTSANVDESANLFADFFSSVNSTISPTLSTATRHSIPTHDITLSFLNFTEQDVKTTLTSLNVKKGAGADRLPPSYWKECAESMKLPISLIFNRSLADRKFPAVWKTASVVPIHKSGSINSVDNYRGISILCCIAKVFESMMHMVLYNATRHLISDSQHGFVKKLSTVSNLMCYTNFLSSEIERRQQVDAVYFDFSKAFDKVPHDLAIKKLEQMGLPDWITEWLRSYLSGRKAFVRIGDTQSRGFDITSGVPQGSVLGSLIFVLFINDLSHRLKSCKLFYADDLKIYRAITSVIDCYALPSDINELLLWCSENGMQLNNSKCKCITFTRSLSSIYFNYEINGSIIDRVTTINDLGVTIDSKLKFSKHVRVTTAKAFAVLGFIRRNSQAFQDIYTLKTLYCSLVRTILEYAACVWSPYCTTQVLHVEKVQRSFLRYALRSLPWNDPVNLPDYESRCMLLNMETLSFRRTKLKQMFLFDLITHNIDCSDLLAEVGFLAPSRYLRSRQLLAPRTHRTAYGQNSPLTSCIRSFSIVNDVFDFNLSRVEFKRRISSIR

SEQ ID NO: 1708 - DNA, 288 bp, Caenorhabditis sp.
  source 1..288: mol_type = unassigned DNA
tttcgaagacagacgagatgcgatcaagaccctcactacattcaactcaatcaaaagccgcgtgaccggttgtcacaacgccaccattcgtcaggacatgtccaaaccggagctgtcaaaatttcgggactcgtggaagcaggccatcaagaacaacaacgaagctggacaagggatctggactgtgagaaacctcgagctggtcagaattccctacaaggacaatgaaactcctcacccttggacagtgcgaaacagaaccaagtaaagtttttctcccttgcccat

SEQ ID NO: 1709 - DNA, 70 bp, Caenorhabditis sp.
  source 1..70: mol_type = unassigned DNA
taacatgtaactatttgtttgatgtataagaggcctattggtctttcactcaataaactcatcatcatca

SEQ ID NO: 1710 - protein, 913 aa, synthetic construct
  source 1..913: note = Description of Artificial Sequence: Synthetic polypeptide
MNCFSIKNKLPQLDLVSSTNNFDVICLSETKLDDSFPDSLLSLNNKFSVVRKDRNKHGGGVAILITKKVKFCPIEIPKHFSSPEISGVDILLRGTTVRVIVAYHPSHTSSLERLVQSLEFLLCSQKHCVVLGDFNMPHINWETLTACDSPCKTFLAFVTNNGLTQHVLSPTRLNPDNILDLCLSNTKIVRDVQVGELFSDHKIISVTLKLSNSAKKVVKRVQLFRKANFQLINYNLSMINWDVEMSCMSLEEKYEFFVSVLQHQIALHVPCKNINVLAKKHGPKILSLQKEKLRIWRAAGNSDNYKKISLILKEELIQEDQMNTEKSLTYGTSKKFFKFINSRYKSNDEIGVIKDSQNIPVNSNILKAELLSDAFSKVFTVDNSSSTLFPSRTNNVLESMTFEPSVIEKVLLKLVPKCNTTPDEIPAIFLKKVGTSIAIPLSIIFSESFRTSQVPRLWKTAIVKPLHKKGPRTDPNNYRPISLTSSVCKVMEKLVRKNLTDYLNSQQLFSRAQFGFRSNMSTESQLTSYFSTLISNHSLRKPTYSVYVDFKKAFDTVSFEKLTCRLMSYGIKGQLLDWIVCFLTNRTQRVNVNGVLSQEKFVLSGVPQGSVLGPLLFLLFINDIGDKFQSHFLLYADDLKLFSTNPSTIQTDLGLLSEWCDKWQMSVAPNKCENIIFNLTKSPRTLNFDFTIKGSKIPRTKKIRDLGLILSSDLPFSEHIDTILRRSHQRINIFFNILRRASFETFIKCYTIYVRPILEYGSIVFNPVLKEQIKRIESVQKSFVYRVFKKFHIPYLNYFDALSVCNLTSLELRRLHADLVFLYKVIVSKETLLYPPFFTLPSLPNIRKHKFYFRSNSKNSNKFFSQFISNRSLNCWNDLSPSVFPPTPHSINFISNISYCNFQKYLTLNPHNF

SEQ ID NO: 1711 - DNA, 516 bp, Caenorhabditis elegans
  source 1..516: mol_type = unassigned DNA
agctggttaattgcatgtaggctaatgctcgttccattgcatcgcttgaaaaacttgaatttgtccataagttcgtagcctctaatagtttagacatcttgtttgttaccgaaacatttctaagtaatgcttttactgatttctcatgctcttcacctcactatacctgcataagatctgatcggcttgagtgccatccaaaaaatgcggcggaggtactgctgtgttttttcataaaaaatgggctcttacgcctgtctcaattgcaccttccttttatctctcgcatttttgtcaaattctggcattagaccataagcaatccaaaactagatttatactgatataccgcccccatccactaccgcaagtagaaccgctgagctctttaaaaatctaaaccagcttctcgactgcccctcctatacttatgtcctcctcggtgatttcaattttgcaaacaccaagtggaattcaaattttcttcccacgggctctgagtatttctataattgg

SEQ ID NO: 1712 - DNA, 219 bp, Caenorhabditis elegans
  source 1..219: mol_type = unassigned DNA
tgatctcatttcctcactcatttgtacatgatgtcatatttttttatttatttttttattattttctcatcaacttttcttggaaatcatttgtatcatctgacctcggacatgttccaatcgtgtcaccttatcattcacatttcttacctcatctcatttttattcctcattttgctcttaattttcaaggcaagaaatagtgaataaataaattaa

SEQ ID NO: 1713 - protein, 746 aa, synthetic construct
  source 1..746: note = Description of Artificial Sequence: Synthetic polypeptide
MKFHDLAQMVNFPTRFSKLNSGTFLDLIFTNNSGVLQNLKPGTPFINSDHISIFFSLSLPQPTPAHSAPPKSFMNFRKCDFFNLNRYMVSYNWPKQLSFFAPPDSKLNHFLNIFNELISDFTPQYPTLRVQSPKVTGRKLYRKLRKHHPDTESSVLKKRVKSRLKFLKKKNMAFENKLIHSKNSKSLFSYIRNRIKPSSSLTHFSVDNNNVDKPIEMAEVLVKEFSKSVVTHDPPFPTFPSCESTPSPVDTSPLTIASTILKLKPKIGYSLDNINFFILKKCCDSISIPLSLIFKEFITTNSFPSCWKTSIVIPVHKKGNSSDPKNYRPIALTHPLSRLFERIVLNPTRKTFSHKISKFQFGFLNNRSCITAHLNASSNYHKILSVPNQFVDIILFDFAKAFDSVPHELLLCKLRNFGFDDNICLWFKAFISDRVSKVKIGDSLSNSSFKNSSGVLQGTVTGPFLFLVYINDLLDLFPPDVHVIAFADDLKLFSNNCQSLRSSIKIIENWCKIWQLKLAENKTKVLHVGKKNPKYKYYVNGQNIECCSKACDLGIWVDDQLAYEKHILVKVNAAMFKCRQILKNFRSLNMMFYFKLFNTYIRPILEYGCEIYHPKSASLTKKLEQPLRYFSRHVFKKCKTQYDSYEHRLNQSNQQSLKHRRVFLILKTFHNIITGKYHFPNLALYLKNSKSPRFPYQMTAIGKTNNNSFLHTHLTIWNLVTKHFPVPVSGYTFSKRISCLPLESYV

SEQ ID NO: 1714 - DNA, 318 bp, Caenorhabditis sp.
  source 1..318: mol_type = unassigned DNA
cttcttctgtactgagcctcttcgcggcgaagaagatcaacagatgtcacacttctacaaacccggcgagttcgtcacgccgggagtgaaacatctggccaagaagtacaacgtctcacgcaggtcagaggtagcgtcgaatactctctgtgaccgggcggctttagcattggtttagcagaccatagtaaagtaatcagagacacccaaaccgctcaaaacagcaccaaaacctgcctcagtcctccgcactcggcctctgcaactgttacggtagattcagtagcacgtcgagagaggcgatctaatcccggagtt

SEQ ID NO: 1715 - DNA, 43 bp, Caenorhabditis sp.
  source 1..43: mol_type = unassigned DNA
tgagcgaagaacggatcgactaagtaactaagtaagtaagtaa

SEQ ID NO: 1716 - protein, 968 aa, synthetic construct
  source 1..968: note = Description of Artificial Sequence: Synthetic polypeptide
MDVYHSKRTKLTRPKTRKTDLRICTFNCRSVATDNRLAELLEETNRIKYDIIGLSETKRSAEVHMTNRDGTGVILGKRNDSSVSGGVGFIINKSLMPKIKEIKIVNHRIGYLTLQVNKNQYTIIQGYAPTADYEEEDHSNFYENLEDVYKSCKSRYKMVIGDFNARIGERKGNEVFIGPHSMENRNDSGERLATFCEVNRVFHMNSQFIKPTHRRWTYISPDKQHRHELDHILANGKYITDVSVVPSFTNGSDHRMLRANVHINAKQAKFEQVKRRKPPRRVLDPTAALLATENLDSCEDQDIDKEYDTLVHVLKKAQDAAVTIPTNHSRNRLKDSTRLLLSKRRFTDRSDPNFKTLSKECRQAVKRDHENFAKDRLLNAANQRKSLRKVARDINEYQSYIPCLLSGETGEKLTSREKMEIEVRRFYSNLFATKQSKATTIIPQQTKALPPFLPEEIQHSLNSFQNGKAAGEDKLSADFLKSCHSSVHKLLANKFSRYLQEGKVPTKWKSSKTTLIFKKGDKENLENYRPICLLPVLYKVFTKCILNRIRKSLEEAQPVEQAGFRRSFSTIDHIHSVQRLLEVGREYQIPITMVFIDFKKAFDTIEPTALWESLKTQGIDSGYIKLLKECYNDCSTTITPFYNPVNIPITRGVRQGDPISPNLFSACLESAFRRMSWPHLKEDKDDYDNSPGIRINGRNLTHLRFADDIILISKTPQIAEKMLQELVNSCETVGLEINASKTKVLRNKFASSHQIHIRKNNTMSAIEDVEEYVYLGRLLNTKNDLEPEIHRRRRSAWAALNNIKNTTDALTCPKIRAQLFDSIVLPALTYGSETWTFTKALSERVRITHAALERKLVGITLTEQREKNLHREDIRKMSQVKDPLVFITKRKLSWAGHVMRRNDNRWTTLLQEWIPRNEKRPVGRPPMRWADSLKKEISVRQGTQLIEPWSTIAKDRKKWIAVIRAHTN

SEQ ID NO: 1717 - DNA, 838 bp, Caenorhabditis sp.
  source 1..838: mol_type = unassigned DNA
ccaactctcatcgtattaacctacggtattcctcctagtgagtgtaataaaggttaattacgttttctcttaccaaagaaaaagaaatttcgaatcctttttgtgtaactcacaaactgacagagacctatcgaatttcttttgtttcgtatataggaatagtcactctggaccacgaagtggacagttgttggcggacttccaaagttgagagaaaaggtgtgaagagaggaggtctagaaacacttcggctgtctaggaccagttcctgagtggaaagaggaaggtctagaaacacttcggctgtctaggaccagttcgtgagatctcttgtgaagagttgaaaacagttagctgaggctactgtatttcttgatagccccgcccccaatccccctcccccccccctcgacagaattttctgtttgacctcctggaatttgcgaggagtgcgcgagaattttcgaattcttcgcgcgttttctcgaaattttccagaagattcgagcggagaatcttcgagaaagtgagccgaatttcgcgcgaatttttcgcgattttcaaattatcaatttttgtcggaaaatttattttctggcaaaatttgatttagttcacgcgggagagaaggatttggtggaaaagggtattgatttttgtggcggaggaaactcccactgaatcaataactctcaaaggagaactcatcgaacaacctcgggtgacctgaatcttgggcgaaattttcgcattgacacaagataacacaaattactgttgaaaacaaatcagaacaaactgtcaaaaagaaagacaaaaagtattgattaacaacatc

SEQ ID NO: 1718 - DNA, 635 bp, Caenorhabditis sp.
  source 1..635: mol_type = unassigned DNA
tgaataccgtcagataagcccccaacataaaaataaaagtcggcgttagctaatcactaaaccggctcctcattgggggagagtatcattccggtgctctccgtttgggcggtagggaggagttgggtagcgacccggaagtatggatgcccaaccaccgcaatctgatctggcaatgtgtttcggatggtctctgtctctagatctgaaatagagctctggcctgaagaacacacgcgcggaccggttggatgccgacttgatctggagggtgcaaacctgaaagggaaagttgaaggccgtgaggctcctggcgggaaactccgtcatagtcagtggtgtgccaacacccgacgactatgacatagttggaggaatcctgatctgataataatcattgttcatataagggagggggatggtaaatacccagggtccgaaaccatcaaagcagctactgaccagcatagtagtgatgaacacatagaccctggggttccctgaactcgacccatctgcacaaacccactttgtacaaatgaaccaaactgatgaagagtttaatgatttcttacatcacagctagcggacctaccgtgaggtagactcccgccgctgtagcaggctcgccattg

SEQ ID NO: 1719 - protein, 1723 aa, synthetic construct
  source 1..1723: note = Description of Artificial Sequence: Synthetic polypeptide
MTNVYLKPVNDNQTNKTGDNSRNTMSNSQCEMTWKPVARTYAQAASTNPADDKTVTVLGCKYNLLKLGNTPQTTKRSPPKPSRGGARISSVYTLTDELEITHREEGKITFAIDLPNKNNILCPLCRECTQTRGRGSSFTKHMKLHVKEKHQLKATFIYKCSMCNEYEPEKKCGTKWIQTHLQKVHNYKYDESAIVVPVPPNTRQQIANELNNAAPFVDIRKPKANVVEEKKTENGALLKFLTKSNKDEQEHSQSNDSPNVESPEKANQALTIDPKGNNSPSKSSMRSSQSSASSICQEIQEIITLSEDEEPKAARPKPGINVWSLINEKGKDAYIDTDIMMAFLKMRVENYDSVNIIDPLNYQFPARVDLVPLIQRNLEDGKKRVVFPICADEHWTLLTISNGIAAFYDPTGSRMSSYIEELVNELGLIIPKEQDEQPRQRDSYNCGVFVMKMAEAFIQDTEWEMEEVEEDVKNFRRNLLEELKPNYEIFAEKIKYYNSPGKSFAQSRPTSRSSQCAVCPTCSRSATPMMDVGNMEVDPVPQQQETPKSREPEQDEGWKVVGNTRKRGVVTERSPNISPEAKRQFTGPEIKVVSPGKFHPLVGETEEMEVTCDSPPTKEPTTEPKVTPSLPAMRIVSPEVTKKQTSKKKGKYGKKKQQTKKAQPPKGEPTKKAQPKGEPAKLIEQVRTWFDKQMKSYQEQGSNIQTLTWIADSLTAAIFKANNGNKYLVDKITARCPPPLLNEGEMATQTSRRTEAVKPKDRFVKESNEPLRIQYAKNRAKTFNVIIGKHSARCEIDINVVENHFRQTLKAQPVTEKALNTVCSGIKKAEVDPSIEGPISSGEVKAILAKIKDTSPGTDGVKYSDLKWFDPEGERLALLFDECRQHGKIPSHWKEAETVLLPKDCTEEERKKPENWRPISLMATVYKLYSSVWNRRISSVKGVISDCQRGFQAIDGCNESIGILRMCIDTATVLNRNLSCSWLDLTNAFGSVPHELIRRSLAAFGYPESVINIISDMYNGSSMRVKTAEQKTQNIMIEAGVKQGDPISPTLFNICLEGIIRRHQTRKTGYNCVGNKVRCLAFADDLAILTNNKDEMQDVLNQLDKDCRSVALIFKPKKCASLTIKKGSVDQYARIKIHGTPIRTMSDGDTYKYLGVQTGNGGRASESESLTQIAAELQMVHDTDLAPNQKLDVLKAFILPRLQHMYRNATPKLTELKEFENTVMKSVKMYHNIPIKGSPLEYVQIPVKNGGLGVMSPRFTCLITFLASTLFKLWSDDEYISSIHKKALSRITAKVMGLKTQTATLQEQCDYLNTKKAITKGGYNLFSRMNEASRTLSVNLGAPLKSMQFIPENGEIALEVQASENSQIKVFSKADSMKLVTKLKDLVKSAMLKNFLENKKVKSQVVQVLQHHPQSNKFVNDGKNISISSQKFVHPARLRLLVCNGNSYGKDHPKDCRRCGYECESQAHILQHCTYNFSTGITQRHDRVLNRILHEVIKGRKNNDYYDIMVDTEPGPTRERPDIIMIQKDGPEVLLADVTVPYENGVVAIEAAWEWKIEKYSHFIEYFARLGKRAVILPLVVGSLGTYWPDTSNSLRMLGLSDGQIRNLIPDISMIALESSKQIYWRHIFGDSYRIVTELYCTKNKQEARFGDEPMENVQVSDRFQPFKTREREKKSEEEKKRRSKSKKGKTWRGSKKQTDSRQSGKSYQNQGFQRSVGQGGSR

SEQ ID NO: 1720 - DNA, 161 bp, Caenorhabditis sp.
  source 1..161: mol_type = unassigned DNA
tgatttttttttttctttctttattctccctcccccttgcccaacacctattttataattccttattcccggtttcctttctcaggtttagtctcgtgagggactgtacctgacctccagtgacattttctgtatatttaaatagttaaataaaatatcaa

SEQ ID NO: 1721 - protein, 787 aa, synthetic construct
  source 1..787: note = Description of Artificial Sequence: Synthetic polypeptide
MSAQSLALIDHLDEYLPLKSCILAETLITHLLLESSIFNHPFSLSSSLKSLPERPFPTRILPHLQEPPLLNSDHFSVDFSLITTVSNHSSASLPTSPTFRNEHRLNYKKCDFKSLNADIANVDWDLVLSSISSPTDKFALFSKMLSDFIISHTPLSTPPKPHRTSFSIRQLKRARQRYSKLLKLPNPPADQIFRLRTLIASTSKRIKSNMVSEERKILSAPNSRSARLLIKKRTRTSLKIPPLYVNNELISSNAAKSSIFSSVFFSNYNCSPSSSLIPVSNNSSNNISPSELFLPWIIENTLRKVPPRCGFTTHHANFYIIRNCATTLAIPLSIIYSDSFLKSHVPASWKHAIIIPIPKKGSLTSPENYRPISLTDPFSRVCERILCNYIKINLFRNISRFQHGFLSKRSCSSSLVHSISEYRLLLSSHKSLDVVYFDFRKAFDQVDHQFLISKLDSFGIPSNIISWLTDFLSDRTFSVKIDDFVGTPSASIPSGVPQGSVSGPLLFLVFINDLLLKLADISSLCIAAFADDIKLYSHDPLALQMGIDLVESWASDNSLPLAHSKTALLRLGPRNSSHPYTIGGSLIDSVDSVRDLGLLIEPNLKFTRHINRAVALALLRSKQLLKSFKSNSPQFYIFLFKTYVLPLVEYCSVVYSPPPSSKLAHKLETPLRFFSRKILQRCNTPYCSYSDRLSQLDLFSMRHRRLKAQLLLLYNLIIGASYFPSLETHVRLSSSSRRPMSLICINPNCSNFFSTVIPIWNALTINVPHFLCPSEFNSLLVNNIARF

SEQ ID NO: 1722 - DNA, 90 bp, unidentified
  source 1..90: mol_type = unassigned DNA; note = Description of Unknown:Copidosoma floridanum sequence
actcctgtagccaacaacaacaatgattcaaagtggctgtttaatctttctaatgttactataccagaagaagtctataatattttgaaa

SEQ ID NO: 1723 - DNA, 456 bp, unidentified
  source 1..456: mol_type = unassigned DNA; note = Description of Unknown:Copidosoma floridanum sequence
tagagcaacagatttactgtaatttaaatttgcgagttcgttgacttgtactggggtggggtggctgtagcgttgtgtgacttaaatatactcatgtacagtgtcacacttacactgaccgatagtatataagcacgatcgtaacttaagaagtgcgtatttttcgatctaccatctatcgtgatgcctatagtcgctattgtcgtggctatgtgagtgttcattattgtgcgattttcttgtaaagtattgatgacttgaaatataattgtttcatatttttatatttttataattgttatttagaaagttgtacctgatgagggccttgtaacgtggtttactgtacgggccggaacgttgtttacagcaataaacgattttgatggcatcacgaagagagtcattatttcttgataaaaattatctgcaatcacgagagccactgacgaacta

SEQ ID NO: 1724 - protein, 633 aa, synthetic construct
  source 1..633: note = Description of Artificial Sequence: Synthetic polypeptide
MIRETSYFTTNMNTHSKFEFFKLLETSLHFVPTVTDKIRTNLLKMFDKFLKSTIAQKFDNQKIINDINKTALFLKHNKELLVTKVDKGNPTVVLDRSEHINSVEEQLNNDKYYTELLKNLLNELIKSVTTFVKRWYDLGIFKDCEFDIRSSEISKNDLSKCYGLVKIHMAGNPIRIIVSAVNSPTYNLSKFFTKFLNDNIPKPNSCIKNSFHIKEKLNSFIIPQHHTIISLDVVSLFTNTSESIILKSIKNNWKYLRNKINLSSQEFCEGVSLILNSTVFQFNNKFYKQIFGSAMRSPVSPVLCDLALRCLEEDCLKKLSFFVPFYVRYVDDILICVRNNSIEETITVFNNHDRHLQLTVETPVDNEISFLDLRLIFESDGSIITNWYRKPTHSGRYLNYNSHHPLSQKIAIVYTLVDYSIKLSDSKFHKENLDISKKILFNNQYPLNFINKYIKKRLTILSINTPLNRVVSNNRGLMILPYFQGFDSIIKRYLYKNNINVIFKCIDKFSKFIRLGKDRTKHTDRCNAVYRIVCNDCDSCYIGQSSRRLKTRINEHMNDCKHRREKSALVDHIAKTNHSFNFDEVKILDTESNRFKRLFSEMLCIDSYRNNINRMHDTQNLKLCYKNVITEHT

SEQ ID NO: 1725 - DNA, 153 bp, Crassostrea gigas
  source 1..153: mol_type = unassigned DNA
tgagtttcactttgtataacttttcctaactctataacctttatattaatatatgtttacctctgatcaatttatatgtatattttaatgttatttttgtcctcatgtaccatatgtttgaaatggttttgagcgaataaatgaacttgaact

SEQ ID NO: 1726 - protein, 923 aa, synthetic construct
  source 1..923: note = Description of Artificial Sequence: Synthetic polypeptide
MAVTCRNCSTVDYVLASANVFEILEDLDIHDFCNLFSDVHNPVSFSLSTCYLSRNISTGKNHSGVKLWCPDKADQFRSNIDVHAVKSIENYLNEISNSPGDLCSDNINKVVKDICTVFTDAARDTFGPSHFSPCIEKHNKPWFNRECKSARKQYHLAKSMHNKSKTDDNKNKLKEKSKIYKKAMDNAVKTYNTGITRKLMQLRSTNTKDFWNILNSSKRDSKSPVNIKDMFDFFKNINEGSLSPDSDTLHEPQVDGSSNELLNCEINESEITDAVKKLKNGKAPGYDNIVNEHIASTLNTFLPIYKLFFNAVFDSGLVPEEWLVGIIKPIYKNKGDPTSPENYRPITLLSCLGKLFTSILSKRLELYSEEIELIHNNQAGFRKGFSTLDHILTLQFLSNTLMKCKKKLFCAFIDFKQAFDTVWRNGLWCKLLNYGINGKCFKYITNMYKGIKSLIKMNGTVSDFFSCNVGVRQGENLSPFLFSLYINDLENYLVEKNIAGLQSFTTSIENELCVYIIMCIYIKLLVLLYADDTVILAESGDDLQNALNEFECYCKEWKLNVNIDKTKVLIFSKGRMCKRVFYFNDRVLEIVKEFKYLGIIFSRAGSFLKAKKHLCDQAQKAMYGVIRKIRQFNLPVTCQLELFDKMVVPVLLYGCEVWGFEKLDSIERVHLKFLKHILCLKSSTPNYMVYGETGRFPLSVIVFTRMVSYWCKLISSTNTSITNILYRYLLNQTENTTSTNPWIDCIRHVFNSCGLSNVWHSQFLNIVNQKWVSTAVKQRLQDQFIQKWHADINNSSKGVIYKIFKTNFGYEKYLDILPLKFRKILGKFRTSNHHLPVELGRWEGIPLNERFCPLCNTKRIADEFHYILECDAISQVRNKFIDKKFSARPNVLKFSYLMTTCNMKLLRKLCIFITKIYEVVCPP

SEQ ID NO: 1727 - DNA, 129 bp, Culex quinquefasciatus
  source 1..129: mol_type = unassigned DNA
taaatcatgttttgtttaaatttatgttttgataacttgactatatgtatgtttgtaaagttcttattagttttaagcaaccaaacttcattgagaccaccgggtcagatgatttcaaataaacaaatc

SEQ ID NO: 1728 - protein, 1388 aa, synthetic construct
  source 1..1388: note = Description of Artificial Sequence: Synthetic polypeptide
MEDPRLFVTVVPSHSRNYAFCTSHPSRPGPVFGPRRGVFQNRSVGKYPYAENDLVSLPDARLTSSNVSTNESIRQDSAYRSQDAASQQSNDNADPGRPPTCYMEDLRLSVTVVPPHSRNYAFCTSHPSRPGPVFGPRRGVFQNRSVGKYPYAENDLVSLPDARLTSSNVSTNESIRQDSAYRSQDAASQQSNDNADPGRPPTCYMEDLRLSVTVVPPHSRKYAFCSSHPSRPGPVFGPRRGVFQNHLVGKYPYAENDLVSLPDAHLTSSNVSTNESLRPDSAYRSQDAASQQSTDNADPGRPPIRIMEDPDPPDTVVPPHCCDSSRSGHQSRPGPVFGSREGVFQTPNAGKYQAAFQVGYALDPDPRLLSSDVQTTPVHSDDPTTPVHHDSRRSSAGQPVIFEPIRFYYQNVRGLNTKVDDFFLSCCDCDHDVILLTETWLDGRVTSAQLFGNNFSVYHTYRNPANSKRKVGGGVLIAVRNSLDSVECVQAVAENLEQMFVTIRTPSKRIFVGCWYLPPEKRFETELMEKHLSCIENIRRIAGPHDVIVVAGDYNQGSLVWKHLSGNRSYVDPQLTRTRTEKERLTHGVMLDGMANCNMHQCNLVKNDRNRILDLIFVSDDDCTVVAAADEPLVPLDAPHPALVFDIDASRTVFVQVDNNDRVLNYKRTNFDELQRTLADIDWTPVTSAMDVDTAVREFSNLLNFHLAQHTPQFRTPPKPEWSNARLKRLKKERAAALKTFTLRRCRMTKLAFNAASSRYRRYNRYRYNVYIRKTQSQLRRNPKKFWTFVKSKYKERGLPATMALGDSTATTNDEKCELFARHFSSVFREPEIISSTHHLDAVPRDLVDINTFVISRDMIEKATKKLKSSFSPGPDGIPSAVLKRCANQLIEPLLVIFNLSLRQAIFPTAWKKSFMFPIFKKGSKRSIENYRGITSLCSGSKLLEIIVSDVFLFNCRSYVAPEQYGFMPKRSVNTNLLEFTSVCIDKIAEGRQVYAIYTDLKAAFDRIDHDIALQKFSKLGFSPMLCRWLESYLKGRIIQVKIGASVSLELTNGSGVAQGSNLGSIVFSGFFNDANFLFSGNCKLSYADDFKLFIPIDTLADCYVLQSRLDKFSEWCGHNRLELSSAKCYVISFNRKQSRELFTFDYHLGSHVLERLEVVKDLGVLLDLKLDFHLQLSSVIDKANRKLGFMFKAAQEFDDPLCLRTLYCALVRSHLETSAVVWAPYHQNWIDRIERVQRKFVWFALRRLPWNNPAQLPSYETRCNLLGIETLQNRRTISRAVFAAKVITSEIDSPNLLFQLNARVQPRNLRPTPGFLSRPLVRTVYAENSPIRALATAFNEFYHLFDFHEPVSRFLERLRTELRDRSRSSRTAENPQQRASRTRRSSR

SEQ ID NO: 1729 - DNA, 314 bp, Culex quinquefasciatus
  source 1..314: mol_type = unassigned DNA
taattattttgttagttaattctccgattcattccctcgtttgtatttgtatccatcttgaacacatttatcttggtagttttcttttatttattttcagccgctaatcgccagaaaccgaactccttaaaaggtctacgccgatggagttctggagccagccgcatcaactttgtcgttacatttttatttaattttcaatgacatgtaatctacttaatttgtattgcacattgaaaagaaacagttttttcagtcagcactttgctggctttttctgtcaaataaaaacaatcaatcaatcaatcaatcaa

SEQ ID NO: 1730 - protein, 385 aa, synthetic construct
  source 1..385: note = Description of Artificial Sequence: Synthetic polypeptide
MLDNRDDVLGLFLDLSKAFDTVDRKILIDKLRYAGVRGIALDLFTSYLSNRAQFVCIDGIHSLLTLVNVGVPQGSVLGPLFFIIYLNDFSLLPLKGDLRLFADDSSLFYNNKSTNMNDLNLRDDLTIVIEYFRLNKLTLNINKTNIINIKNSSRSIPNSLSLTTSKFPDLEVVSDTKYLGIILDNRLNWSAHINALILKLHKITGIIFKIKHKLPQKVLFLIYHSLFHSILSYVTAVWGNACGLLINKLQVAQNRILKIILNLPIRSHTVDLYVKNNILPVRGIYVFQVCSFIYLCLNNKTHSNTKFVRSNHQYGTRYHDLLNRPNVTTVPGERSINFNGAQLYNYFNNRFGKSSSLNIFKNQLKQCLSRPDIIEKLLKSVNIFA

SEQ ID NO: 1731 - DNA, 64 bp, Culex quinquefasciatus
  source 1..64: mol_type = unassigned DNA
tgaagtggcatcccataggtgtggctgtgaaggagagcatgtcatgacggtcggcttctctaca

SEQ ID NO: 1732 - protein, 847 aa, synthetic construct
  source 1..847: note = Description of Artificial Sequence: Synthetic polypeptide
MLAIEIHHQQFNGIFGGVYHSPSSSDRDFLDSFENWLQQVMADDKTNVISGDFNICWNNEGYSRDLKNIADAVGLEQKVLEHTRISVRSRTTIDLVFANVEDCTVKVLADWRITDHETLGINVEGVCKINMPEKKTEYTCWRKYSKERLQNTLLCDETLWRNNLPVDEKAQQFSRALATAVGQLTETRMRRSADTKRWFTPHLQAVKLKRDEAYKIFKTTNCAEHWERYKQFRNEYVRELQKAKNSSVQQEIQSCSGDSKKLWRCLKDLIKPGGTPEKEIIFDDKTEPCSDEETANRLNHYFIKSVKEIHDSIPTVNQPQQDPLPTVRTLDISEFSQFQPISMEKLRKIVAAMKNCAGVENISKRVLEDAMDVVGDKLLDIINSSLNLGVFPQEWKKSVVVPIPKVPNSTRAEDRRPINMLPIYEKVLETVVREQLVEYVDRAGLLIEEQSGFRKQHSCESALNLLMLKWKQSIENNKFILTVFVDLKRAFETIDRRKLLEVLRRNRIKGDVWRWFKSYLEYRTQITRYNNSVSEAEAVELGVPQGSVLGPLLFILYINDLTKALRRACVNLFADDTVIYVAGDKLDECYEIMNNELAVFADWLKWKKLKLNVSKTKYMVVTTRRSESNCTISVDGELVERVNAIKYLGVMLDEKLSFAEHVDYTIRKAARKLGVLCRINRYLSFDNKIMVYKTLIAPHFDYCASILFLATNQQRKRMQIVQSKAMRMILRCDRLTPRILMLDSLQWMSIRQRVEYSTLVFIFKVVNGLAPQYLTKTVQCGRDVHRHFTRQAGDIRLLNFKKSCTQNSLFYRGYNLFNMLPESTRATTNLREFKKLCKPFVRQRPLE

SEQ ID NO: 1733 - DNA, 932 bp, Culex quinquefasciatus
  source 1..932: mol_type = unassigned DNA
tgtgtgtgcgccgtgcacatcggtattgtttttcgtaccgttcccgcgaaagtgcaaaatttacacgaaaatacgcgttagtggggtgtgaaattcattgcatccgtgttctgaacccgtctcctggcccgggaaagtgatagtccgtgttttacgaccgcgagtgagacaaatcaatcaccagatttgaccgaatatcgcgttccgccacgggcaattgaaaaaaagtacaaagaactgctaaggcatcgtcgtcgtcgtcgcgatcgatggtcgttgtattgtgtcgcgcggcgtgtggaagtgtaccgcgaagaccatactgacgcgtgtcgtcgtcgtcctcgtcactgtgtctgttgctacgagagtcgtgtatagaagagaagccgttggtgcacggtggggtgaattgctaggaaagctacagaaaaaaaaagtgctgcaaagttttttgggtgaaattaaaaagaaggaaaaatcaagaagcgcaaccctgctgcatacacagcccccccccccccccctctagttccgtttctgggcgtctgcaccccatgttaggggcggcccaaacggactaggtggtcgattccttctatccgtgagcggctgttccccacgttaggggcggctcgaaagaagtggccgacacccccccccccccccccccacccttctttgagcgtctgttccccaggttaggggcggctcaaagaaaccggtgtcctgctctatcgtcgaggtaagcgtctgttctccaggttaggggcggcttacagcagatagagttcggaccccccaccccctccccccatcgagcgtctgttccccaggttaggggcggctcgaaacagcgtctgtaccccaggttaggggcggctgagtaaaagtccttgtgtcggcgtgggactgtaaacagtaccggcacg

SEQ ID NO: 1734 - DNA, 27 bp, Culex quinquefasciatus
  source 1..27: mol_type = unassigned DNA
tagcgccaataaaagtaaagtaagtaa

SEQ ID NO: 1735 - protein, 1028 aa, synthetic construct
  source 1..1028: note = Description of Artificial Sequence: Synthetic polypeptide
MVLRRDRGLVQATRTRRKTPVQEAHDASRTNRHGTGHHMRSHDWKLGTWNCRSLKFDGSIRILSDILRVRKFSIVALQEVGWIGAEEVQAYPRIGCTIYQSRGENKRLGTAFIVLGEMRDRVIGWTPLTDRMCVLRIKGRFFNISIINVHSPHSGSEDDDKDAFYEQLNWTYNSCPKHDVKIVIGDFNAQVGQEEEFRPVIGKFSAHVRTNENGLRLIDFATSKNMAVRSTCFQHNLRDKYTWRSPQGTESQIDHVVIDGRHFSDIIDVRTYRGANVDSDHYLVMVKMRQRLSLAKSVRYRRPPRLDLERLKLPEVASRYAHSLEAALPGEGELLEAPLEDCWRSVKAAITNAAESTIGFVERGRRNDWFDEECRAILEEKNAARRAMLQYNLRDYEEAYGQKRRQQHQLFRAKVRHQEELEFEDMEQLHRSNETRKFYKKLNGSRNGFTPRVEMCRDKNGAILTNEREVIDRWKQHFDEHLNSAEAEAGVQGGRREDFIGTAGEGEEPVPTMREVKDAIKKLKNNKAAGKDGIGAELIKMGPEKLASCLHRLIVRVWESEQLPEEWKEGVICPIYKKGDKLDCENYRAITILNAAYKVFSQILFSRLSPIAEGFVGSYQAGFVMGRSTTDQIFTVRQILQKCREYQVPTHHLFIDFKAAYDSVDREELWKIMDENGFPGKLIRLIKMTMDGARCCVKISGAESDSFTSLGGLRQGDGISCLCFNVVLEGVMRRAGFNMRGTIFSKSNQFICFADDMDIVGRTFKAVADAYTDLKREAEKVGLRVNVAKTKYLLAGGTESLRARIGPSVTIDGDEFEVVEEFVYLGSLVTSDNSCSREIRRRIIAGSRAYFGLHKSLRSRKFSLHTKCSIYKSLIRPVVLYGHETWTMLEEDLRALSVFERRVLRTIFGGVYENDGWRRRMNHELAQLYNEPSIRKVAKAGRLQWAGHVARMPERADHLSQRNQKINPAKLVFVSEPVGTRRRGVQRARWVDQVESDLESVGAPRNWRNAAMDRACWRRIVQQAKLMV

SEQ ID NO: 1736 - DNA, 165 bp, Culex quinquefasciatus
  source 1..165: mol_type = unassigned DNA
tagatccagattagattttagttttttttttctcacccgttcagagaattgacaatttctttggctccaaatgtacaatctccttatcccttccttgccctgatacaaagtgtaaactaacaggatatcgttaccaaataaattacaattacaattacaattaca

SEQ ID NO: 1737 - protein, 557 aa, synthetic construct
  source 1..557: note = Description of Artificial Sequence: Synthetic polypeptide
MKNDPAGDVDADELNAFFSSGHRQLQAVDRSDNSSEPCHRTTADHGDNGFAFRHTDVNEISRKILEVQTNATGTDDIPISFVKLLCPFVLPMLAHLFNHIIDTSSFPAAWKKAIVTPIPKSSSPIQPKDFRPISVLPAVSKVLEKVLLGQISEHLNAAEPPLLAQNQSGYRKGYSTTTALTKVVHDVYSNLDENRCTVMVLVDFSLAFNCVNHQILRKKLNTEFKFTRSACDLITSFLSGRSQIVRFGNSMSAALDVPDGTPQGSCLSALLFSLYINSLPRNLKCEWQLYADDLQVYLSGPIAEVDRIMRDVNEDLAAIADWARVNQLFPNPKKTQAIVFNKTGTVTPQENIVFCDSIIPLSSQVINLGLHMDCNLTWKAQVNDVVRKVYHTLRTFRRFGSVLSLQTRRKLVQAVIVPFFTYCDTVYFPGLSAALREQLHRGFKSALRFVHNLRRRDTTVALRNSIMGHDLPDNYQLRVCCFMKKAFEGTLPDYIMQHLQRGRQERTAGFIIPRHTTSSGKSVLVHGASCWNSLPMAIKREARFNPFKRAVITHMQN

SEQ ID NO: 1738 - DNA, 208 bp, Danio rerio
  source 1..208: mol_type = unassigned DNA
attgtgctgaacttgaattagatattggatatgtacaagtgtttactcgttgtttttggaaccaaggtgtgcagtatgaaatgtaatcttattattgtttttatatgtatgtaacttatttatctatttttagtatggagagctctgctgtgacatgtgaatttccctccggggattaataaagtcaaactaaactaaactaaactaa

SEQ ID NO: 1739 - protein, 980 aa, synthetic construct
  source 1..980: note = Description of Artificial Sequence: Synthetic polypeptide
MMAPYLWQPVAAALDVFNFVYLLYFLNIFLQWLRTLYLHTFQFESIRKHWIIFIFILAFLIGKSDAVNSPAIADAVIYSREQLLALRHTSTFSVPTMEVPTELKRRRRGCRAGVKRRLKKKRYKPSLPVIIMGNVRSLGNKTEELTALVRTQREYRECSFMCFTETWLNDKTPDSVVALDRFHLVRADRCAKQTGKNKGGGLALFVNERWCRPAHITTKEVVCNKDIELLAVGMRPYYLPREFSYVIAITVYIPPSANASNACEHINTVTASIQLKYPHSLIVISGDFNHVSLQSSLHTFTQYVDCGTRDCKTLDMLYANVKDAYASTPLPPLGRSDHNLIYIRSVYVPAVRKQPPTIRTVQVWSDSVYEALMDCFDSTDWEVLCKSHDEDIDSLTDCITDYITFVLRTQYPQKRLNATQTISHGLYNFCVENTVPTKKVKCYSNNKPWVTPELKALLNEKKRAFLAGDREEIKRVQKELKIKIKEGKVIINLKWNINYNKIMLEMYGVIVCTKLEVTIEQVRNGLRRIKKKKSAGPDGISAGVLKACADQICWVVHYIFNLSLRLERVPILWKTSCVVPVPKKPNPTEFSHYRPIALTAQLMKVFERLVLNYIKKLLIASEDRLQFAYKTGVGVDDAIIYLLHKSLSHLETSGNTVRITFFDFSSAFNTIQPALLKVKLENAGLQKGMVSWLTDYITNRPQYVRMHNCVSQVIMSSTGVPQGTVLAPYLFTFYTSDFQYSSKNCHLQKFSDDSAIVGYIRNHDESEYRLLLKSFADWCDMNCLNLNTSKTKEIIVDFSRHPSQAVPVIIQESEIEIVSSYRYLGVYLNNKLDWSENTIQVYKKGQSRIHLLRRLRSFGVCQTLLKTFYDSVVSSVILYAVTCWGGGLLEKEKNKLNKLIKRAGSVVGGALPTIEEIAQDRMLDKFVSIMNHDSHPLYDTVQACASSFSTRLIQPRCYRERYRKSFLPTVIRLYNQSHTR

SEQ ID NO: 1740 - DNA, 535 bp, Danio rerio
  source 1..535: mol_type = unassigned DNA
gaaaagagatcatatctcccctgtccttgcctcattgcactggctacctataaaatacagggttgattttaaaattcttcttttcacttataaagctttgcacaattctgccccggcctatgtcagcgagcttattaggccatatacagcttgcagattcttaagatcacatgatcagtttcttttgtctgtccctcggtctcgctgcaagtcaaagggtgatcgagctttcagtgttgcggccccaaggctctggaatagtctccctctgaatatcagaatctctccttctttggatgcttttaaatctaacttaaagacacatttttactctcttgcctttgactgatgcatgcatgttatttttgtattatttatattttagtattacttttaaatatattttattgtatttttaataccagttatttttagttttattgtctagtttattttattgtaaagcactttggatcaactacggttgtgttaaattgtgctctataaataaagtttgccttgccttgccttgcct

SEQ ID NO: 1741 - protein, 602 aa, synthetic construct
  source 1..602: note = Description of Artificial Sequence: Synthetic polypeptide
MLTQPVSFSRVFHENSALEFSNSYTNFLSNANASLPSCSDTEQLAETFNSACDFALNEVAPLKSKRSRVSSIPQPWLNSSTRTLRQECRRAERRWKKDGLQVSYQILKDCLNSYQDSVSEAKSKYFSNLIAKSASKPKVLFKTINSVLNPTMCSVPVVNLETCIKFSDFFAQKIQDIKSHLFPTDIDHSDSVPPSNSFTNFQPVSSSQLLNTISQMKLTFCPSDVLPCRLFKEVLDTICPSLLALINSSLINGVFPDVFKHAVVQPLLKRPNLDPAVPDHYRPISKLSFISKVLEKIVLSQLTSYLDIFYILDPFQSGFRAKHSTESALLKVTNDILLSMDSGSSAILILLDLSAAFDTVDHNILLRRLECVVGVQGLALQWFSSYLKGRSFSVNIGSFTSPPKPIHCGVPQGSILGPLLFSLYMLPLSSILLKHKISYHCYADDLQLYFPIKLGKDLSLENLFLCLTDIKTWMTNNSLQLNENKTEVLILGPAATNNSIKTQLGALNDNLHNHAKNLGVIFDPLLQFDKHVNAVVKSSFFQLRLVAKVKRFLSKKRFRNRNPCFNLLSSRLLQFFVYWPTSVNTLSATVGPKCSRQINNRN

SEQ ID NO: 1742 - DNA, 140 bp, Danio rerio
  source 1..140: mol_type = unassigned DNA
tgtatggatgttgtatagtagtatttttttatttttattttttaatgtgtacatggaacttcgcctgtgtatggtaccttgttgcaatttagtttccctaacgggataataaagctgagtctgagtctgagtctgagtct

SEQ ID NO: 1743 - protein, 702 aa, synthetic construct
  source 1..702: note = Description of Artificial Sequence: Synthetic polypeptide
MLDLCYGSIKGAMKAVAGPPVGFSDHNVVHLLPVYKSVLRREKVRKREIKVWSEDNSLALQGCFDCTDWSVFKETSESIDELTEVVCDYISFCTDMIIPHKTVIDFPNNKPWLSNDTKSLLQSKHKYFKQGDMSSVKQLKKAVRVQINKDKIRYKDKIENQLSSNNLRSAWQGVKAMAGCKEDRGGSEINLNGFSSAREFAEELNTFYLRFDEDDFKSENDNLKQHLSCSNSVNISRIQVKGLLQRTNTKKSPGPDNIGGRVLHTCAEQLSEIFHYIFSQSLMLQRVPEIWKKSVIVPIAKTKFPRELNDFRPVALTSLVMKCFERFIKGEILLQSKDKFDPLQFAFRQSRGVEDANLTILNYLFNHLENPKTHARLLFIDFSSAFNTMKPHLLVEKLISLFNLDLNICGWILDFLVGRQQCVRVNGALSDFQFCSTGSPQGCCLSPLLFIMYTNDCRSIHRDCHIIKYADDSVIVSLLHDQDLGHGPAVQEFTSWCDRFSLQLNASKTKDMVIDYRKASPTPNITNIKGLDIEIVDTHKYLGVVIDNMLTFQPNTQAVYKKVQQRLFFLRKLRSFQVSTSMMTLFYKQFIESVLSFCIVAWYGNLSVSSKNRLSSLVKVAGKIIGFNQTGLMVIYQNHVIRRAQGILCTPDHPLYSVFQLLPSGRRFRVPICRTNRTRNSFIMVAIRSLNESRGEGDVSIY

SEQ ID NO: 1744 - DNA, 545 bp, Danio rerio
  source 1..545: mol_type = unassigned DNA
tgcgcaggcgcgagcttgctgcagcatgttttgactgctctgtcttgtcttagtgttttagagtttaatttgttgtctttatttttatttttttgttttagtttattagtgttagtaagcgtgccctccttaaacatgagggtagagagagccatctctgtgtttttttggttactgctctttgtttgagcttgccgcacgctgctaatgctaacacagctagcggttggtccggtttttgtttataccccggaccagctgatctcgttgaggcaggatgcttcgagcacagtgcggtctctcgggtatccccgcgggttacggagggggaagactaagagaggctgccgtggaggacaaggtgcgagggaaaagaacgaggaatgggaaattgtctgatgagcagctgagaagacggtataaacctaacctgccgtctgttgttatgggcaacgtgaggtcactggaaaataagatggacgagcttacggcacgggtcagatgcacagagaatttcgtgagtgtagtttgatgtgttttactga

SEQ ID NO: 1745 - DNA, 523 bp, Danio rerio
  source 1..523: mol_type = unassigned DNA
taatttatgcaatatcttgctgctcgtgccatatattaattaattattacgggttttaatgcgtggaagtctgtgcattatgttctatgatgtgcaatagtctattaggtgcaatatttgtacgtttttttactgggtcttaaatatttttagtgcaatatctttgttttttaaatgagtgctgaatgactttactacttgaattattgtatgtgtaattgttttatgtgtaatattattggttttggttaatattattttcattacttgatatatgacttattagtattagttaccactgattcttttaagtgtaatatcttatataatagtttgtatacttatgtattgtggctgttttcttttatagattggttggatttatgtgacttatttcacttacttaatttatttattttgtcttgtggttttgtgtttctgtgttctgtgtgttatggcagtcattacataagcaatttcctgcgggataaataaagttttctaagtctaagtctaagtctaa

SEQ ID NO: 1746 - protein, 899 aa, synthetic construct
  source 1..899: note = Description of Artificial Sequence: Synthetic polypeptide
MTWLHECISDSVVDVAGFSSVRADRTRRESGKSKGGGLAVFVNERWCHPNHIVIKERICSPDIELLAVGLRPYYLPREFSHVIAIVVYIPPSANATTACDVIHSATARLQTMHQDAFVLISGDFNHVSLNRTLSTFSQYVECPTRENKTLDLLYANVEEAYSCIAIPPLGRSDHNLVYLQSTYLPLVKGSQLLLGQGSGQKRPVQPCKTAWRLRTGMLCACHMVWTLITSQTVSLSISTSVWIVLYHEIHTLLSYCTMKSIRCFPNNKPWVTKDIKALLNEKKVAFRSGDKEAAKEVQRRLSVRLKEGKERYKKKLEQELKQNNSRYVWRGMKNITGFKTSSPRTDGDVDRANQFNMFFNRFDSRPLSSSDTALTAPSASAPPNSVTSNCSILPYFTPSPSSSFTIVPTEASIASPPFIGVSDSYKPPMIITEDQVRRELCRLHPAKAPGPDGLTTQVLKLCASQLSGVLLRIFNLSLSIKKVPVMWKTSCLVPVPKKARPSVPSDYRPVALTSHSMKVFERLVLGTLRPLVRSAQDSLQFAYQAKIGVEDAIIYLLHRAYSHLDKPSASLRITFFDFTSAFNTIQPARLGSKLSAMQVHAPLVAWIMDYLTDRPQYVRLQGNKSDTVLCSTGAPQGTVLSPFLFTLYTSDFQYNTEGCHLQKFSDDSAIVGCIKGGDDLEYRMAVDSFVDWCELNQLQLNIQKTKELVVDLRRSRRSPVTPLSIRGVDVEIVQDYKYLGVYIDNKLDWSKNSLVTYKKGQSRLYFLRKLRSFRVCNTMLRMFYESVVASAIFYAVVCWGGSVKVADMKRFNKLIRKAGSVVGEELDNMETVAEKRTLCRLRSIMHNVDHPLHNVVDELRSTFSHRLTSLKCSTERHRKSFLPTAIRLHNVSLSHLPLQ

SEQ ID NO: 1747 - DNA, 147 bp, Danio rerio
  source 1..147: mol_type = unassigned DNA
taaaaggcttttgtaagacctatagcactcaactaattaacaaaattttaattatttattgagacatattcgcatattaatataaatgagtaaataaataaaatgaatagtataaatgaataaaatgggtattaaacaagatataat

SEQ ID NO: 1748 - protein, 500 aa, synthetic construct
  source 1..500: note = Description of Artificial Sequence: Synthetic polypeptide
MYYMQEKEKGGVLIGLDLEKAFDRVEHDFLFAVLKEFGFGENFRKWIQIFLYRYFNLYLVLNVFFFLTECLQPTRSIRQGCPLTALLYTLEAEPLGLAIKSDRSIKGIQIENNDNREAVYQYADDTTSLGILERYCKASGAKVNVGKSLCMRVGRVKEITQHIPFKEEKEHTKMLGIWVGMDSNKADILNWERVLNGIEKRLRFWKARNLTLKGKYSSKFDVKRKVFILNALMLSKVWYVLSVTALPEVYYEKINDVVLKFLWGNGRAKIAYYTLIGEVKEGGLGLLDSFLKMKTLTIKIIQRFLEGKMGVIWKSVLDYYLKKCGHFNMGCNVLLMKMKKRMIAGLPKFYVEVLESGLRIMRGIFRKCVDYTKSKGADSRTTTFTELNNFKTILSEGNVLYFKEWWDGGLRQVKDVLYEVIKGFVPLKVIVEDGYKRVVKAKLQRQCHELKKAIPKDCIVIIEKKKSWAMKMNYQRPILRRKMERSMSLCTVKSFYAIFR

SEQ ID NO: 1749 - DNA, 14 bp, Danio rerio
  source 1..14: mol_type = unassigned DNA
gacgtgtgcaaaag

SEQ ID NO: 1750 - DNA, 165 bp, Danio rerio
  source 1..165: mol_type = unassigned DNA
taatctttattgtggttgttgctgtaatacttttattcctattattacttttattgttatcttttactcttttagagtgtgtgctatggttttgttcagcactttggtcagtgccaaactgaagtaaatgtgctttataaataaactttacttacttacttactt

SEQ ID NO: 1751 - protein, 1130 aa, synthetic construct
  source 1..1130: note = Description of Artificial Sequence: Synthetic polypeptide
MAPVCLSACRLPRQFLNVCSATILSVLFLLLFMSCVDALISYDRQALLNIRGLLENQPRDCSITHDYCYSSFPFPTAAFVRRLPCCLIYQRKRRRRRGNRGGVRVRMRKEISISLALHTACSFVPTYGHRGLHPARRSWDVRYTCHLPIFPDKRQLAEFGAPPRVRIRRRGVNLQHIKSLDYVHQSDLQVISHINMALLNARSVSNKTFILNDFFTSHNLDFLFLTETWIGAGESSVFGELCPLNCSFISTPRCIGKGGGVAMVFRNWFRCRTISVGDFTTFESQCALIESDTTPFLCVLVYRPPKPDRGFIKEFSEFVSHIITSYDRLLILGDFNIHVCCPGKPLVTEFMHVLDSFGFTQHIVGATHALGHTLDLIMSYGFSIENIVIEDASFSDHKPIVFNTTLSYFSGTTKSEGFHSRCINSLTANQFSTMFNSNKVSTAILAAAEHSSSPDDLISLFNSSCSDILDCVAPLKYKYPKMKSQPWLDDLSRSLRQICRKAERRWRKDHLVVSLEIFRDAQVNFQKAAKKARATYFSDIINKHSHTPKILFDTINAIISPRTSCKIEQSSEICERFKRFFTEKVADIRSSFAPLCPSSCVDSTVSSATFCNFEPVSLSELRGLVFQTKTSTSPCDPISSNLLKETFNTIGSSIQAIINSCLVSGTVPAFLKHAVVQPLLKKPNADINCLNNFRPISKLPFMSKVLERAVLSQLQPFLKSSHKLEPLQSGFTMHHSTETALLKVWNDLLLSVDSGSNAVLVLLDLSSAFDTVDHTILLSRLEHWVGIKGSALQWFQSYLKSRSFSVSVGQFMSTSAPLLCGVPQGSILGPMLFNLYMLPLGNIIRKHNISFHFYADDSQLYVPLKSQNSLQSLINCLEDIKCWMAKNFLQLNNDKTEVILFGPSKTRMSYIGGLGSLAPYVKSQVKNLGVIFDSELCLEKQISSVVKNSYYQLRIISRLKSILSFQDLEKVIHAFITSRLDYCNSLYVGLPQSSLARLQLVQNAAARLLTGTKKHAHISPVLASLHWLPVNFRIQFKILLIVFKALNGQAPSYISELINLQSTPRSLRSSNKILLQVPRSRLKLKGDRAFAVAAPRLWNQLPPDITSASSLSIFKSRLKTHFYSIAFPGF

SEQ ID NO: 1752 - DNA, 890 bp, Danio rerio
  source 1..890: mol_type = unassigned DNA
ggttccaaggttgtcatagccgggggcggtaatggggataagctcccactatctataaagtacccctatacggcgtgcgtctcaaatagcctctgacaaccaagtccagctcctggccttcaagtgtggtttagctaccaaacccggcggaactgttttcactgacaggagaaggggcgcaggcgggtcactggcgccttacaaccagttgcttcggggagatgatattcgttagcctgggaaggcagatcatctaggggaaggcaaccctgttttcaaacctccgctgccttgcggctatatccattcatggaaaaggcttcaggagtaaacctcgaggaaaaatccggagtcggagtccctaaggcagtttaacgctgtttgcagcctcactctggcaactcctgcgacggcgccgataccaaactgtagcagccctgctgttcctttggatttgtcgacaacgtggagaggggggacccgctacatgggcaacagcctgtcctccataatacattgccctggctagtatccgatctcgcacaccctggagaggacactccagcctcgctagcactctggcgtggatacaacacggggagcagtagtttaccggttataagccacagctcggttggcgtagagcaaggcgccagggactgctcccgacggtgggagggatcttcgggtcccactggacagtcaccgcccgcctcaagctgggcagcccccagtcaattaggtactgccccgccacagtctgctttcctcattgggtgcatggggaataggagcatttcgaacagcagactgcaaccatcgcaccagacaataaaataacacagagaaagagaccagctctaaaactgggatgctggaatgtccgtaca

SEQ ID NO: 1753 - DNA, 46 bp, Danio rerio
  source 1..46: mol_type = unassigned DNA
taggatacgtcatccatggtcaacactgaccgacggaggcctacta

SEQ ID NO: 1754 - protein, 1049 aa, synthetic construct
  source 1..1049: note = Description of Artificial Sequence: Synthetic polypeptide
MLTGLSEDLRGIDDSRKTAVINNELLRLNVDIAALQETRLADSGTLKEKDYTFYWQGRAPDEPRQHGVAFAVKNNLLSMVEPGRNGTERLLTLRLNTTTGPLTLVSVYAPTLNATLETKDKFYGNLTSVINNIPDKEQLVLLGDFNARVGANHESWPSCLGKFGIGKMNENGQRLLELCAFHNLCIANSYFQTKPQHKVSWRHPRSKHWHQLDLILVRRSAINCVLHVRSYHSADCDTDHSLVCCKIRLNPKRFHRLRKQGNPRINVSRMSQPDLTQKFAETLVKELDTAQTGDSALEMWESLRNTMQRTALATFGKRTTKTHDWFEAKASTMIPCIEAKRAALTEYKRSPTQKNLQILRSTRSKAQHIARYCANEYWQELSNDIQKAAIAGNIRGMYDGIKKALGPTQCKTAPLKSSTGEIISDKQQQMERWVEHYSDLYSRQNTVSSAALDVIKCLPTMEELDEEPTAEELRKAIDKLASGKAPGSDGIPPDLLKQCKDSLLHPLHKALCQCWKEGAVPQDMRDAKIITLYKNKGERSDCNNYRGISLLSIVGKVFAKVILARLQKLAERVYPESQCGFRAERSTVDMIFSLRQLQEKCREQQMPLYISFIDLTKAFDLVSRDGLFKILPKIGCPPKLQSLIESFHTDMKGTIQFNGSCSEPFSISSGVKQGCVLAPTLFGIFFALLLRHAFGSATEGIYLRTRSDGKLFNLSRLKAKTKVRETLIRDMLFADDAAVTTHTQEELQSLMTRFSMACKDFGLTISLKKTNVLSQDTATPPTITVDDYQLDVVHQFTYLGSTITDNLSLDAELDRRIGKAASTLARLTTRVWTNHRLTTATKMAVYNACVISTLLYGSETWTTYARQERRLNTFHLRGLRRILGITWQDKVSNVKVLTRAGLPSMYTMLRQRRLRWLGHVCRMEDGRIPKDILYGELSSGKRTTGRPFLRFKDVVKRDMKALDINTKSWEDLAADRLKWRCTLTKQLKSGEKNMMRASEDKRVHRKVQSVSQGATYQCDCCGKKCLSRIGLFSHQRRCLRQSVMPQYKS

SEQ ID NO: 1755 - DNA, 492 bp, Danio rerio
  source 1..492: mol_type = unassigned DNA
gatgcaggactgccagactcaagaactctttcttcccatcagccatcagacttctaaacagataaccaacgcacataacagtctatttttctgctcagtacaacactacatactccatcccattttgcactattttattttttattctttttttttgcacataatccaattgcactaggcacttttttgcataataagcacaataaaaaacaacaaaaacaaaaaacactgtacactgtttacatctgtttcattactcaaatcaggtttacatattgtttactttcatagatatttatatacttatattttacattcaatcttcggtcacttctgtgtatatatgtgtatttatgtgtatgttgtgtatgatgtgtatgttgtgtgtttgacttcactgtggacggcaaagtaagaatctcattgtacagggagacgtgtttccttactgtgcacatgacaataaacagttgaattgaattgaattgaatt

SEQ ID NO: 1756 - protein, 959 aa, synthetic construct
  source 1..959: note = Description of Artificial Sequence: Synthetic polypeptide
MSWRPSWQTCMLAPHINVVFLLFFVCFLSFPRCIHAMHYQHIADKLAGSCNLRQTFRIYQFYSTGLTTHCPLPQPLQRRRRKRHKRGKRGGLHARLKSRANRPPLPSILLANVRSLDNKLDELRARITSQREVRECCALIFTETWLSEKVPGTAVQLQTHSLHRGDRTTASGKAKGGGVCVFINNSWCGDVQTVHKHCSPDVEFLLLKCRPYYLPREFTAVFIAAVYIPPRANATAALGKLFNVFNAQEMAHPDAVIIAAGDFNQCNLRTVLPKYHQHVSIPTRENNTLDNVYSNIRGAYRAAPRPHFGQSDHISLFLYPAYRQRLKQTNPITKLVKIWNPQTESTLQDCFALTDWDVFKTAATKEDLSVNVQDYAEYVTGYISTCVENIIPTIQVKKFPNQKPWINSKVRHMLNARSLAFTSGNENEYKSAKYGLRSAIKEAKRQYKEKLDNTYSTASAGQMWRGLQHITDYKSTTNVTISASESLPDDLNTFYARFESSSINTEQRHTQTQTSQPALPPPVVTPAAVHKALRKINPRKAAGPDNIPGQALKACASELVDVFTSIFNLSLSQSSVPTCFKTTTIVPLPKKSPLTCLNDYRPIALTPIIAKCFERVVLPLIQSSIPDTLDPLQYAYRTNRSTSDAIAAALHTSLSHLEDKDTYIRMLFIDYSSAFNTVIPHNLTHKLSELGLHPTLCDWLLDFLTGRLQSVRIGNKSSSTILTNIDTPQRCVLSPILYTLFTHDCVASHKNNTIIKFADDTAVIGCITGGDEAAYRKEGASLVTWCDNNNLTLNTDKTKEMIVDMRKERKTHQPLFIRKLEVERVSSFKYLGVHISEDLTWTLNTTQLVKKAQQRLYFLRKLRKLGLSSKILSNFYSCVVESILTNCITVWYGNATVKDRKRLPRVVRTAEKIIRSPLPSLQTIYHHRVHKRTASILKDPTHPQHGYSHSYPQGGGIGV

SEQ ID NO: 1757 - DNA, 424 bp, Drosophila ananassae
  source 1..424: mol_type = unassigned DNA
ggggagaatgggggaggttatataaggtaaagtgtctgattgcactcaacttggtgaatgccagcatgatccttatcactgctctccccaagccgacgcactacctccacgtggttctccctggattgtcactcaacacccgttgtttgacaaactaaagcgcgcgacgagagtcctagctcttcaaactaggttgtggcgtaggacttgaaatccacccacggaaaacaaatcttcagtgaatgtagcagatgaagcctcggaacggaaccaatctaaagttgacgaccatggcacacgtaaaaaggacaatgatttgagagtatgcacttggaatgtacgcacattgtacagaccaggtgctgctcaacagctagcagataccctcaataaatgtagggctgacatcactgctatccaggaa

SEQ ID NO: 1758 - DNA, 31 bp, Drosophila ananassae
  source 1..31: mol_type = unassigned DNA
tagggttgtgatggccatttatatattatat

SEQ ID NO: 1759 - protein, 932 aa, synthetic construct
  source 1..932: note = Description of Artificial Sequence: Synthetic polypeptide
MRWIGQGCLRKKNCDIYYSCHPERHEFGCGFVVGARLRRRVSHFLPINERLATIRITAKFFNISLICAHAPTEEKDDVTKDAFYAELDRAYGRCPSHDIKILLGDFNAKVGREDIFGATVGQFSLHETTSSNGLRLIGFAAAHNMVVRSTGFRHLDIHKASWLSPDRLTRNQIDHVVIDARHASNVLDVRSCRGPNIDSDHYLVAAKIRTRLCVAKVARRGLLRKLDIGKLQSQRTRDAFSTQVTGLLSRATPTPEDISNMWALISHSLRTSAEEVIGFQRTPKRNPWYDQECRDATAAKDAAYGRTLQAGATRAVVEVYRSRRRDEKRLFRRKKREQERRECESIESSRDRNEARNFYQRVKRLTQGFKTGGVACKDDDGNLITDAEIVLRLWRDHFSSLLAGSGHDDYGEYDPQTPIYGTDVDVPTPSHAEVKDAIQRLKNNKTAGADGLPAELFKAAGDMLVGSMHKLISKIWLTESMPDDWNHSMICPILKKGDATLRTNYRGISLLPVAYKVLTSVLCENLKPHAEALIGPYQCGFRPGKSTIDQIFTLRQILEKSYENQIDTYHLFVDYKAAFDSPRRDRLYAAMSELGIPAKLIRLCMMTLSNTISSVRVGNDQSETFYTKCGLRQGDSLSCMLFNILMESIIRKAGVHRTGTILTNRCVQLLGYADDIDIIGRTKRDVTAAFGAIEKESAKVGLAVNMDKTKFMVCSSRESRRLDSQLSAGSHSFESVKEFIYLGSAISSTNDVSLEIKRRITLANRCYFGLSRHFNSRALSRPTKITLYRTLILPVLLYGAECWTVVQSDAAALGVFERKILRKIFGPICVGDAYRTRWNHELYELYGDVDIVSRVKIQRLRWLGHIARMEEDAPARKVFDAVIVGKRRRGRPRIRWQDQVMEALSTSGVTNWRARAQDRKAWRQIVQQAVTR

SEQ ID NO: 1760 - DNA, 817 bp, Drosophila ananassae
  source 1..817: mol_type = unassigned DNA
tgataccacacctgacctagtctccattactacctcacagatggccataactacagaacccgacgccatgacacagcaacgccccgccaatagccgtgcagcaacagcccactaatacgacgcacagacgcccgatccagccgccactgctccgattacaaaaacaagcgactgcgtccaggcagaaaccccgctacgcagcaacggcacatcaacacgacgctcagccacccggaccagccgtcaccactctggccaccagaccaaacccccgacgacgcccagcagaaactccgccgcgcagcatcgcctcatcagtatgacgcacaaccacctgcatcagccgtcactactctggcctccagaccaagctacagcaaccaggcagcaaacccgccacgcagcaacggcttgccaacacgcacacatgatcctggaacagccgctgccgacttggcctccaaaaccaacaacggcgtccaggcagctacatcgcagcgctgcagcaacggccagccaacacgtcgcacaagaacctagaaaagcagccaccattctgaccaccagaaccaacaatggcatccaggcaaccaccccgcacaaagcacaggcccaccaaccactgaagaaaacacctgaaagcgccgccaatggattgaccaccaaactcccgacgacgcccagcagtaaccccgccgcgcagcaacggctcaccaatacgacacactgatacctggaccaaccgccactgccctggccaacagaccaaacgacggcatccaggcagcaactccgccacgcagcaaaggcttgtcaa

SEQ ID NO: 1761 - protein, 883 aa, synthetic construct
  source 1..883: note = Description of Artificial Sequence: Synthetic polypeptide
MQDIDDAIEIFNRNIYHAAKIATRHIKTSNRNPTGQFLLDRKLLNLQAIKKYTKQIKMARQTPEAAKNYKAANERFLRAIKEAKTKRTNNILNKIDPLDRYRMQKLWKITNHFKRQPEPNWPLKLYTGDGTSAKDWYSWTKSSEEKTEAFTRHLEERFSPKLTNSESFRAHVISKKEEICTQKLLMTTPCWMHRENYGHNSDKTNLPFLPITPNEVLAEVKLLQNKKAPGPDQIDNKLIKLLPHKATLHLTHIYNCMLRYSYFPKQWKRAAITMIKKPGKTPHEVSSYRPISLLPGFSKIFETLLMHRMFKIQDFERAIPSHQFGFRKQHSTEQQLLRVTQHILSAYEQKMYCSAVFIDVSEAFDRVWHDGLLLKLAKLLPHSLYKILQSYLTDRSFTMNSTNGIPSRTGKISAGVPQGSVLGPILYTVFTSDMPLPEVISSQHTYNPSYFENMMLSTYADDTIILCTKREPQLAIQTTESFLKYITDWATSWCITLNPNKTIHVLFTKRSVANLTGNKSPKMKGILIKNEPKHRYLGLILDRKLLLHHHINQLQNRIRNVAAGLNWIIGTKSKLSPQSKILLYKQIIAPIWQYALPLWGALTSNTQFQRIEAAQSKLIRKILKAGRYTRNQVLRDAYNIKSINEIYSEASNRLATSLASHPNTEARKILMDPVTPNRLEMPRYLDQLNRFFLPLRQQLQQQNQLNTHQPALPTLISYEQQLLSQQASIKARQQDEEREQNKRLKIEQDPHYRPSIGWVNAMSYKLRHGITTRWEMADKIKYEPEYIQRLIMSPLLPSEIPPPTPDQELDARLSTLKTQIINDLDLNLNYETNLAEGDSRTRFLPNSSSPILQAPQIPCINLVEDHPLGNPAIADIWKSTPEI

SEQ ID NO: 1762 - DNA, 120 bp, Drosophila persimilis
  source 1..120: mol_type = unassigned DNA
aagatatgggtctgaataatagcgtagaaggggagtcattccgtaattcgtaaatcgtaaaaatcagatcaagttgattcaagacctcctcgtggtatcttctggatgctattagactga

SEQ ID NO: 1763 - protein, 1071 aa, synthetic construct
  source 1..1071: note = Description of Artificial Sequence: Synthetic polypeptide
MSSFGLIVTNLNSETVLWGCQPLGQFSLIGTNMQNTTPRIINTNSLTNQIPTVSSLGAQSEHSAQVNPNSGYQCTICESSFRSKSGLGVHMSRRHKDEFDQLRLRTDRKAQWSEEELSMMARKEIELAANGERYLNKKLAEVFTNRSVDAIKKCRQRERYKTKIEQLKGQAVPLPEALESETIQRRPSIRERDLLVTPPNTLGTTPTELSNSEILAVLQGYPPVVCNDQWRVEVLQSIVDGAQASGKEITLQRLSTYLMEVFPSQNDRPIQTRPPRRPRNRRQGRRQQYALTQRNWDKHKGRCIKAILDGTEGTATMPSQGIMGSYWRQVMTQTSPTYSGTNTTFRTEHPLEGVWSPITLGDLRVHRVSLTKSPGPDGITPRTVRSIPSGVMLRIMNLILWCGKLPVSIRQARTIFIPKVGNASRPQDFRPITVQSVMVRILNAILASRLTSSVDWDPRQRGFLPTDGCADNTTIVDLILRDHHKRCKSLYIATLDISKAFDSVSHAAVSATLTAYGAPKEFVDYVQNSYEVCGTTLNGDGWRSEEFIPARGVRQGDPLSPIIFNLIIDQLLRSYPNEIGATIGDHTTNAAAFADDIVLFAETRLGLQTMLDTTVDFLSSVGLTLNSDKCFTVGIKGQPKQKCTVVIPETFRIGSRSCPALKRTDEWKYLGITFTAQGRTRYSPADDLGPKLLRLTRSPLKPQQKLFALRTVLIPQLYHKLTLGSVMIGVLRKCDILVRSTVRKWLGLPLDVSTAFFHAPHTYGGLGIPSVRWVAPMLRMKRLSNIKWAHLAQSEAASSFLTDELNKARGRTLAGLNELTSRTEIETYWANRLYMSVDGRGLREAGLFRPQHGWVCQPTRLLTGQDYRNSIKLRINALPSRSRTTRGRNELERQCRAGCDAPETTNHILQNCYRTHGRRVARHNCVVNNLKRILEEKGHTVHVEPSLQLETSVSKPDLVCIRDNHACVIDAQIITDGLFLDDVHHRKVEKYKRPEVISALRREFGVSGNVEVLSATLNWRGIWSNQSVRRLIAKGLISSGDSNVISARVVTGGLYCFRQFMYLAGYTRDWT

SEQ ID NO: 1764 - DNA, 1196 bp, Drosophila willistoni
  source 1..1196: mol_type = unassigned DNA
aatattggcttattttacttaaatatttggtctctttatgtttttccccactaaaagctaattgctctaaaacttctagcctataaagctaactcaactaaaagctgactgctctaaaacttttagcctttaaagccaagccttgctcgcaattgatgcgccaacagccaagctaaaaaactagtgttactcagacccaaaatatgggtctccctacttttttctccagtgtggaggaaaaccagttttttccccgacattaatcgccacgtttttgtagccgccttagcaccaaattcttattcgccaagtttattattaaaaaattgctacctacttgactacttatgctaaaagtaacataatcttaaatctatcatactacaaactatcttacctaaatcgctaaaaactaaatgttaatctaatgtcttattgtatattttttatttagtattaatctagttttaagataattttaatccccccgccactgctgctgtaacggccttttaaatttaaatttttgctatatacccttgtaggtgaaagggcaaaaaataaaaagcggcctcaatcgaaagactgaggccaggcggatcaaacgccttaccttaaaaagtggggtaattcaaggtcatgtaaacgcggcagaactctccttgaagtgatcggctgacaagaaactggacatcctggcgacgggtggtcctactcatttcccacacgaccggcgaaaaaatccctcagccattgactttggagtttattctggaataatcgaggacagattaacttcacaaactatatgcgaactatcctctgaccacttacctgtttatgtacacatcacgatggaccagcacccaaacttacttcctgacaatcgaagacttttgcctgtaggatctaacattaaactgttccaaaacaccctcagcgactccctccacctaaatatggaaatcgaatctggattagacattgaggacgcgattaatatcttcacaaacaatagtcaccatgctgcagccctggccactaaacctctacgaagggacctgccaaatacgaatcgtaccgaatcggaggagccatacctataaataaaaaattgcacaaattattaaaacaaaaaaattaaataaaattgatataatgcctctcacgaaactttgaacgtaaaaaaacattaa

SEQ ID NO: 1765 - DNA, 1597 bp, Drosophila willistoni
  source 1..1597: mol_type = unassigned DNA
tgaggaaaaaatcagggacaaccacttgtcattcaaaggctatcctgccccccttgggccaaacgaacaaattcaatacacggaaaatgtactactcgctctaaacatggctagtctggaatctgagttgctcaaattaattgataacagcacgaatagcactgatgctctaaaaaaaaaggaaaactgatactgcacccatgatggccctaactaacaatcactctaacaccaatactaatacttctgcaaacattcacttacctaaccataaagaaatatgattttaggcggcccctgcaaagccagaatcctgcccactattcagctgccgtcctggcctggccagagggccagtcctcgacagctgtgcctccagtagacgcgcctcctgcactctctgcctcgttctcagcgtctgcaccatctcgtccatcgtcctgtccagatttccgctcgcctgatgcaccaatacctgaaaataaaacaaatctaaaaataaaaccaactaaaaagtacaaatactcacctgaaaatacacaacagcaaacagtagctccttgtccagcgtcgtatgcatcgtctcatctgcgtcgtccagaatctcgtcaagctagtccgtctgcagctcctgtatctgaaaatatattaaaattattttctaaatcagcaataaaacacaaaaactcaccttaaaatctacgtcagagagcagcagcatcgtctgcgaatcctcgtccagcatctggccaatcatctggtccatctcgtccttcactagcgcctgcacctgaaaaaaaacacaaatcgtcagaaaaatctctcaataatcacgtaaacatacctgcaaattctcttcagtcacctgcagcaataccagctggtccttctggccctctacctaaggctgcatctgaaaaaaaacaaaatatcaacaaagaatcaagctaatttacctaaatacatatctaaaatccagccgcagccgctagcagtttcaactggagctcctcctgcatcttctgctgcaccacgtggcccgtcatctggtcctaaacgccataaagctgctcctacacctggaaaaaatataaaaatgctaaactatgctactaaatcaacaaattactcacctgccatgcaaatgccgccagtagcatcgcgtgcaaatcttcgtgctgaatctggccaatctcctggtccagctcgtccttcactagcgcctgcacctggaaaagaacacaaatcgtcagaaaaatcaatcaataatcaggtgagcttacctgcaaatcctcttcagtcacctgcagcaacaccagctggtccttctggccctctacctaaggctgcacctgaaaaaaaacaaaaaatcaacaaagaatcaagttaaattaactaaatacatatctaaaatcgagccgcagccgctagcagttccaactggagctcctcctgcatcttctgctgcaccacgtggcccgtcatctggtcctaaacgccataaagctgctcctgcacctggaaaaaatataaaaatgctaaactatgctactaaatcaacaaattactcacctgccatgcaaatgccgccagccgc

SEQ ID NO: 1766 - protein, 705 aa, synthetic construct
  source 1..705: note = Description of Artificial Sequence: Synthetic polypeptide
MNILNKEISLSKNKHLNKKLCKIDSSDRYRPHKLWQLTNKLKRQPLPNWPLRIPSGVDKKHAWTRSPEGKMELFTDQLEKRFSPNLTNSSLDRAKINEETNAILAQKMLMEYACKTHHSIASSSANFDSSNSPFVKPITLSELKKEIDSLINKKAPGYDRINNALIKVLPLKAIIFLLKIYNSILRFGHFPLVWKKAIVVMVKKPKKTISDASSYRPISLLPAFSKILESLIAKRLLKFNRLSQSIPNHQFGFRKFHGAEHQLARVTQFLQRAFEDKLYGSPIFIDITEAFGKVWHCGLRNKLIKLLPINLYKVLDSYLKDRTFSVRGNHGIMSRDGKILAGIPQGSVLGPLLYNIYSSDMPIPKFIIEHETLIEYYPTYKHGDTLLSTYADDTIFISTDKNALVAMNKTENYLHKFSTWSNKWCFTVNVSKTVHVLFSRRSTSPAVKAATVKFNNKPIKNTSSCRYLGVLVDSKLLFKTHIAKLCAQAKSTYTRYKWLGGAKSHLSTRCKVTIYKQILVPIWTYAIPIWGSLISNTLFKKLTGTHNKLLRKLTNANIYCPNSEIQEKHNAKPLETIYNDACLRFFNSMSDHETKEIEKLYLKPFIPKRLPWPRYSKQIDKLVASRTIKKAQTPPLMPPLNPSVTVTNIKLRIESKLMEFFSKAPALIADNCHQTYNRITEKQDVLRAKEASIARKNRQKIQSGH

SEQ ID NO: 1767 - DNA, 137 bp, Folsomia candida
  source 1..137: mol_type = unassigned DNA
ggtaacttacaccggagatactacttatctatcgttggaagtccctctactttcactcttgaattccgcccccgtctatatattttaagcgtggaaggaaattgccagtattgttggatacaagtcgtcagaccacg

SEQ ID NO: 1768 - DNA, 49 bp, Folsomia candida
  source 1..49: mol_type = unassigned DNA
taagtgtatttcatagtttatcaatgtttatgttaataataaataatac

SEQ ID NO: 1769 - protein, 1321 aa, synthetic construct
  source 1..1321: note = Description of Artificial Sequence: Synthetic polypeptide
MPLFKSLDIWKYVNLTLLPPLPPSSSSPPLPPSSSPLPPSSSPLPPSSSPLPPSSSPLPPSSSPLPPSSSPLPPSSSPLPPSSSPLPPSSSPLPPSSSPLPPSSSPLPPSSSPLPPSSSPLPPPSSSSSRPHPGPRKKRNKQKKRTGPRKCPPPTSSRPLPHTTEGLNPVSDDLFCPVSGCPGPSSSATDEWIECSACLLWYHTSCLLLQAIPEDDWFCANCPQIHTQIGPQVNSNTPSPANQSTLGTHSQIIQSSPCTNPRASQPISTLSTPLSNFISSKATCTSLTLEWLNNNIVPGGIIEKNLLHEAYRQDSLGIFKPLNDAEIGKLIKNSFSNIRTKRLRTEFHGASKYHYVGIQLKSEQVPETVFDFKSIISSLRQNCPTLKQCPKACRIPVAQSIKSAIDKCITENTPEAWHLLLTFPYVTLQCDSRANIKNGQSLNNKIRNNLSIFESLDKNTYQDYLISLSSKNSVFDKSGSKINDIGPKVISKVSEGNIRGAIRLLTSDDVVAPNSSATLDTLVEKHPQQSLDNFTVLDEPNIPPFTTTTEQVISAIFSFPSGSAGGLDALRPQILKDLVSQHTGDVGTQLLESLTKFCNFMLAGKVPLDICPFIYGASLTALKKKSGGIRPIAVGCTYRRIVSKICVKVMNHVFQDYFSPVQVGFNVKNGAEAGAHAARRFFSFPHQSPTAFLKIDFKNAFNMVDRGKLLSSVHELVPTLYPYINQCYRFSSSLVWNSSLIDSCRGVQQGDPLGPPLFCLTLHPVISNLGSEFNMWYLDDGTLGGNPTTVLDDFQHIISCANEVGLELNFDKCEVSVLGPQTNTQCILESFQSVAPGISCMTQENAELLGAPLTLESIEHVFRKKIHAFTNMAGRLHSIPSHIAYYLLKHSLAIPRLVYLLRAAPIFKSPHLLEEFDSLLHNALEQITNCQINPLSLEEIALPIKLGGLGIRQSKTLATPCFLASSFATTDLVSLILPSYVTALSDSLVTEAQDLWKSISCEELPRSTITSFQSSWESPIFNYVSSRILESSTTPINTARILASRSKESGAWLQALPSRNLGTLLDDNSFRIAIGLRLGLNLCFPHKCVCGAQVDELGLHGLSCKKSAGRHSRHTQANDIIKRALISADIPSIREPLGCCRTDGKRPDGLTLIPYKQGRSLIWDFTCTDTFAPSYLSHTLRHAGTAAKLAETKKHKLYSELKTNYIFVPVAIETSGVWGTEGLKFIQDVGRRMKDVTGPMSTTFLIQRISLAVQRGNAASIMGAVPSQRGLEELFYILNDRSFYLQKSCKGPNGDLGRLSGSSKGFPNPPTSGFSSTPQAN

SEQ ID NO: 1770 - DNA, 290 bp, Glycine max
  source 1..290: mol_type = unassigned DNA
gttttgggaagtaatcccaaggcccagcagagtgacaaatcaaaggagatgatgagaagtaataccaaggcccagcagactgaggaacctttcgtggactccaacccagcttctaaaggtcaccctctgtcttctttatacgaggaccctatacagctgcaatgtgacatcttgaaggaaatgggcttgtcttatgaggaagaagatagcaaggttaaggggctgctgctggatatggagaataaagatgatttgatggcagcagagaagggaattaaatctcagcaatt

SEQ ID NO: 1771 - protein, 1004 aa, synthetic construct
  source 1..1004: note = Description of Artificial Sequence: Synthetic polypeptide
MIILSYNSRGLGRGVKWAAVRRLIVKHKVDLVCLQETKRENFNKSICQAIWGDSTGHWDFVPSVQAAGGLLCMWNNSTFVVERKEKGRSFLMLEGTCCSNNQKLIFVNVYAPCDLVGKKALWDELRQLKASNPSGMWCFLGDFNSIRSSQERISLSQRRADPYDIAAFNQWIDDMELQEIKCYGNSFTWIRPNGCVKSRLDRFLVSQNWLSLWPESCQTVLQRNLSDHCPSILQTNMVDWGPKPFRVFDWWLQQKGYQKMVREAWKKDQQGGWGGIALKNKLKNLKSVIKCWSKAEGNINPKKVLNIQQKLNEVEDLAAHRNLTDQEIKDRTLLQQELWNASNAFESLLRQKSRARWLKEGDYNTAYFHKYMNFRRAYNNIPGIFIYGEWIQQPDAVKNEAANFFHNRFTEQMHSRPTLDGVHFKSISQRQREQLTVPFSDQEIKQAVWSCGGDKCPGPDGLNFNFIKEFWDVLNPEFRRFVDEFYAHESFPRGSNASFVALIPKKSHPQSLNDYRPISLIGCMYKVIAKLLSNRLRSVMDELIDERQSAFIKERHILHGILILNEVVEEAMRSKKPAMIFKVDFEKAYDSVSWSFLDYMLLRLGFCQKWRRWISACLHSATISVLINGSPSKEFNPSRGLRQGDPLAPLLFNIIGEGLTGMMREAVHKNLYRSYLVGKKREPVNILQYADDTVFVGEVDWQNVHAIKALLRGFELASGLKINFAKSQFGIIGGGVNWGLAAANILNCSQMNYPFHYLGIPIGANPSSLMVWEPLITKFKAKLSKWAQKDISMGGKVTLINSVLNALPIYLLSFFRIPQRIVQKLISLQRKFLWGGDNTHNKIPWVKWADICLPKNEGGLGIKDISKFNVALMGRWIWAFASGQQQLWVRVLISKYGGWPEFQHDTDKRGFSHWWRDLRKIFHQSDHNIFKHQLTWKVGCGETIKFWTDKWLGEDYTLEQKYNQLFLISRQQNSLISNMGEFNHDSWEWNLRWRRNLFDHESDL

SEQ ID NO: 1772 - DNA, 46 bp, Lottia gigantea
  source 1..46: mol_type = unassigned DNA
gcctcgaacggaacaggattagactcgtatctttagtactgtcgca

SEQ ID NO: 1773 - DNA, 221 bp, Lottia gigantea
  source 1..221: mol_type = unassigned DNA
taaagtagcacatcagaagagcgccccgctcctctgtaggtgtggcgatcattggggacttagttctcgatagatcgccaagaagaaacacagaagaagaacgcagtatcaagactacagaagaagatcaagaagaaaccatgggagcaacccgttccctactcaacgtctgcgatatggaatttctccgaagcggacaccatccaccaacaagaagaaga

SEQ ID NO: 1774 - protein, 1252 aa, synthetic construct
  source 1..1252: note = Description of Artificial Sequence: Synthetic polypeptide
MDRSLKILQHNLNGLRARLTELIKFLSTARYDVLCFQETKLYPGVKDTILPGYRLSRLDRPGAHSKCFGGGLAIYVRTELSYQTLVLHSTEFEVNGVSLSLADGSKIAIVNVYLPPGKNVIEPSSYRNLCEQISHRNVLFCGDFNSKHNAWGSYKQDERGEGLLQFIEDNDMCILNDGRPTLIHNSSGVMSHLDLTIATSNIASNCEWQVSSTETLGSDHLLIDITYRGQIKREGTVGKPKWRIAKADWIKFTENCSQWDVKDIQDADVDVYANNVTMVLMEAAKDAIPRTSGKNRACPKPWWSDACQNAVKLRKKALRRVQRNLNTETKRTYLEATENARKVISEARTSHWHDFCQTLNQHTQIRDVWAKIKSMNGTKSTREIPVVTYGDRVGESDRQKADLMAESFADASSDKHHSPEFMNRKTNFAVDHSNVLTHIDENDPLNLPFTSDELQKALSSKKDSAAGEDEVKYSMLKKLPPEASKILLDFFNESWTNGHVPTKWKTASIIPILKAGKDPNKTESYRPVSLTSTLCKILETMVTHRLRYYLESNNLLDKNQSGFRKLRSTADHIVRLQHAMSKTLNSSGFLCAVFVDLTKAFDLVWTDGLMHKLRQLGIGGRMHNWIASFLADRKIRVTIGKSLSEEFSLENGTPQGSVISPTLFSVMVNDIRNPKYLSNKCQIAMFADDSTFWGNGTLYTNLQMRIQTCLDRFAKWANDWGFRISKAKTVGMLVCKDPQLTDMRLVLDGERIQFVSETKLLGVTFDRKLSWEPHIKNITNRCQIVLNLMRNISGNEWGANVVTLMMIYRALIRPILDYGSQAFMTARPMLLHKLDVIQHKALRLATGAGIGIKTESLLQDVGEVPLQIRREELALRYWSKLKHLGESSPTYLETARFRHAKKTISFGQSVRDSVRKYGLDRLPIKPLVFSQVAPWTVSPPIVDTSLASRLDKKRDDPCIARMIALTHMDARWSESIRIYTDGSHNPDDGTTGLGIYVPSSSTRISKRLPNNCSVYTSEMLAILYAVKYSAGHYHSNYVVLSDSLSSLTSILNDSSNSQAELVDEIRQACSLVHSQGKSIELAWIPSHVGIQGNEIADELARIGLGLSEIDRIDYSLSEIRSMITKSIKSTWEATLIDANAFRFRLNDSISSKVFLHHPNRQICRTVARLRMMGEVRNHKYELKLCPCGEAGTAEHLLIHCEQLRELRKSLVEIMKRYRLEYTLKNILSHTGEGMSTICETVYNFLSESRMIT

SEQ ID NO: 1775 - DNA, 160 bp, unidentified
  source 1..160: mol_type = unassigned DNA; note = Description of Unknown:Nasonia vitripennis sequence
tcagatatatgtatctccgtattattattatttttgtacattcgaatctaatgaactatctgtcacttgttgtatatttttcaaaacttgtatttattatagtatctttctaaaggacgcgtcagccgttaaattattaaatcaataaatatataaatat

SEQ ID NO: 1776 - protein, 1164 aa, synthetic construct
  source 1..1164: note = Description of Artificial Sequence: Synthetic polypeptide
MTYPREGCTGPRDGLSKQEELTAGYSGFSNAWTLTRIIMSHRAWTVELFLLNCTIGPIDPSTSLCTTFLSKATTSRCHYWSVPLLVLMLMKSLDAVFPGPQETALFLVRFGSSDDASRVLKNRKLLPSSVEATADHTAYQRDLYRKLKLKASLHNTSHPDSLKKVVYVKGTPTLVDLRRTSTAPLSEKPSKNLQASETFKKLAGILKPVNKLSLYYQNAYSMYGKLHLFKAKLFQLSILPDIVVITETWLQDCVLSSELGMQQFDVFRCDRDLSSHGVQRGGGVLIGVKKFLQAELVHVDNVIEQLIIRISLPSHKLIVAASYLRPDSSVQVFSSHVSNLEDANIKFPDHRMVLLGDFNLHHITWSSDTSAYSPMAYLSPALRSAADIISGYSTSMDLVQHFKHHPKKGYSLDLLFAQKDFISPMDFNEDILPCDDHHVPGMFSCNISVASSASCNLKFCKRKFYSADFEAIRARLSEEDWATVLYSFSDDPDSGIARFYEILNGVIDQHVPITKQSLSSYPKWYDSELINAICKKKIAHSTWKSSNSKRDEIEFKRLRAVCVRLSRSKYRAYISSVELGLKRNMRTFWSFIKNLRNDSSIPSKMYHGPTRAASDVEVSNLFSGYFSSVYRTDSLREFESNDEPLVSLSNIVLSIETLRSIVANLDDNINGGPDGIPPYFIKRCWSLLERPIVHIFESMLRSGYFPTFWKYSFVVPIYKNGDRHSVANYRPISTLSCIPKILDAYLASELSNSLLSKVAQQQHGFISGRSTLTNLLVFNDFLSESLCNHEQTDAVYTDMSKAFDSVNHSRLISKLFNFGIRGKLLDLLRSYLTNRSQAVRVNGAVSSPVDVPSGVLQGSHLGPLLFCLYVNDLVPKLSAAQVLLYADDIKLFMRVRSADDSVKLQRDLDTLVAWSVENGLSLNANKCSVISFSRSKSLLLFNYCINGSRLQRVDVVKDLGVIFDSSLTFITANQQTDVVVSRSLRMLGFIKRSTVDFSDPSAIIYLYKTLVLPHFLYCPQIWRPHSQYLINKLESVRHSFLRYIAFKMGKPLHRFCHDYSEIAEGCDILTVDSTFYLHDCVMTFKILRGLTNCERLSDLFVSRTVAYPLRNLRDLREGTFSSNLGFYSSINRMKRQWNSIPNNVQSKESVGQFKSSIRSLSLAY

SEQ ID NO: 1777 - DNA, 23 bp, Nematostella vectensis
  source 1..23: mol_type = unassigned DNA
acataaactctgaaactacatct

SEQ ID NO: 1778 - DNA, 234 bp, Nematostella vectensis
  source 1..234: mol_type = unassigned DNA
tagatatgattctactttatttcatcaaatcagccacatgtaaatttaataataaggattccttagtcaaatcaagaacattcatatatattttagtagagacgctacttagtctgcgacaggggtctacacctcataagcattgtgcttttagtagactcctcatcatcactattttttgcattattatcattatactattatttggtgaaataaacttgattgattgattga

SEQ ID NO: 1779 - protein, 866 aa, synthetic construct
  source 1..866: note = Description of Artificial Sequence: Synthetic polypeptide
MESLFIEIINEKSKNTLIGVIYRPPHSNVNDFLNEMELLTTKLNTENKKCYILRDFNLNLINIEYHELTRQFLDIMYSSSMIPTISKPTRITSHSATLIDNIFTNNINMQDSFSGLLCADISDHIPIFHITKIGKTKQNKEKRNMYTYKRIMNDSCIDNFLGEIDQINWDNVVLKENVNDSYNSFLQNITYIYETCFPLKKFRNKKINSKPWITNGLLKSIHKKHKLYKKSQELPSESNFNKFKQYRNKLNSLLRIAKRDHFTDSLEKSKMDAKNTWKILNSLLKKNIKKPNYPDIFKNNNQEISNPKDIADKFADYFTNIGPNLSKNIENTNIDIKSYLKGNYSNSLLFRLTTPDEIKEITLSLKNKNSCGFDEINIRVIKAAISILSNPLSTLINQSIMAGIVPDKLKIAKVIPLFKSGEKELFSNYRPISILPCFSKIYERAIYNQLISFINKYNILNNNQYGFRDKHSTVMAVCDFIEKISSSIDKGYNTIGIFLDLSKAFDTINHNILLQKLQFYGIRGIPLLWFQNYLSNRKQFVNYKDTKSEEYDITCGVPQGSILGPLLFLIYINDVPNATELFSFTLFADDTNLIFKSKSAEDMDEILNSELFKLTEWFKTNKLSLNTKKTNYIIFRNSKRKTKHTTKIEINNEPIQMVNETKFLGLIIDSQLNWKSHINHVRTKITKNVGIMNKLRFYLPKFSLKTLYFTLVHPYIHYGNINWASNYDTSLKRIFLLQKRCVRIITNSHYLSHTEPLFKEERLLTVYDINTLETALFMYKFDNNQLPGTFDNFFKRNNTIHSYNMRNSCDYRTTLRKTRRGQFSISYRGPKIWSNLTCQAKQCRSLNMFKKIVKDNILSQKAAIDL

SEQ ID NO: 1780 - DNA, 195 bp, Oryzias latipes
  source 1..195: mol_type = unassigned DNA
tagtgggacttgttcattttattaatttaattcttttattgttttttgcttttattgttcaattgattttattgttttattgtgattgtttctttattgcatcatattgtttgtgattttattggattttatgttaagcactttggttgccttggcttttataagtgctatacaaataataaattgattgattga

SEQ ID NO: 1781 - protein, 292 aa, synthetic construct
  source 1..292: note = Description of Artificial Sequence: Synthetic polypeptide
MRKYNVSFHCYADDIQIYLPLKSGGAEGLDRLQNCLADIKSWMELNFLCLNKNKTEMFVFGKSDLLTGCCSAVGPLDPSDAPFIRNLGVNLDRHFKFDKQVSLVVQSSFYHLRLISKVKPYLPPHALQQVIHALIFSRLDYCNSLYSGMDQSLLRRLQLVQNSAARLLTGTRRCEHITPILRSLHWLPVSFRISFKILLLVFKCLNGLAPQYLSELLHVYRPCRVLRSEDQMLLVVPRTRLVTRGDRAFSVAGPKLWNALPYSVRSARTVSNFKTLLKTHLFTQAFNSSERI

SEQ ID NO: 1782 - DNA, 266 bp, Oryzias latipes
  source 1..266: mol_type = unassigned DNA
taacctttgcacattttttttattatctctttatttagttttttctattttgcacatttcttttgcacatctctttacctgcactgttctgtaaatagctctttaaattataataccttgatgtctgcatttatcctacattttcttgttcttatttttatttatattattcttactctttttttccctctgctgtcagttgttatggtaacgaacaaatttcccacgtgtgggatcaataaagtatttctgattctgattctgat

SEQ ID NO: 1783 - protein, 455 aa, synthetic construct
  source 1..455: note = Description of Artificial Sequence: Synthetic polypeptide
MKLNQHKAAGPDGVSPRTLRTCAHQLSAVLQHLFNLSLRLERVPLLWKTSCLVPVPKKTSPSHPGDFRPVALTSHVMKVLERLVLAQVRPVVSSSLDPLQFAYRPRLGVDDAVIHLLQRTHSHLDGGGGMVRITFFDFSSAFNTIRPSLLGDKLRLMGAGASTVSWITDYLTDRPQFVRLGGVLSDVVLSGVGAPQGTVLSPFLFTLYTSDFQHNSESCHLQKFSDDSVVVGCISGGREEEYRRLVDGFVEWAGENHLLLNVDKTREMVIDFRRKRTVLQPLCILGRDVEAVEEYKYLGVTIDSRLSWRSHSTAVYKKACSRLYFLRKLRSFNVCSKMLGIFYQSVVASTLFSSVVCWGSSIAVSDTNRLNKLIRKAGSVIGCKQETFEAVMERRSLNKLLSIMDNPEHPLHPVLDKQRSSFSRRLRQLRSKTARYQKSFIPNTITLFNNSQCRR

SEQ ID NO: 1784 - DNA, 96 bp, Pelodiscus sinensis
  source 1..96: mol_type = unassigned DNA
cactacacctttttttgtcaaggaaaacatagtgatgagaaacgcctgcatggagttggttttgccattcgcaactcgctgctcaagtcaatagac

SEQ ID NO: 1785 - DNA, 44 bp, Pelodiscus sinensis
  source 1..44: mol_type = unassigned DNA
taatgctgcatcccaccgtcttttgagacatatggaggccatga

SEQ ID NO: 1786 - protein, 965 aa, synthetic construct
  source 1..965: note = Description of Artificial Sequence: Synthetic polypeptide
MTPSAESKRIMTLRLFTESGYINIISAYAPTLTTNSADKNHFYESLQKVVDSISSDEQLFILGDFNARVGIDTSSWPICLGHHGIGKMNENGQRLLEFCSINELCITNTFFPGKECHKVSWHHPRSGHWHQLDFVLVQRKDLNCVKSTRTYHSADCDTDHSLIVSKTKLKAKKFHRTTLNKKPKINCMNTRNSAKCEDFAKAFAKKWEENAHVESVEETWQTLCSAIYEAAREAFGEKKSSNKDWLEENADRLMPLIKQKNEAYLEYIKNPSDSAKAKLQHAKGLLQREIKHCINQYWIDICSNIQVASDTGNARAMYEGLRKALGPNITKIAPLKTKEGISITDKSKQMARWIEHYSELYSEERNIMSETRDFIPTMELMQELDAVPSKQELIDAIDALSSGKAPGTDCIPAEVLKHNKDCLIPPLYDLLLKCWTKGEIPQDMKDANIVTLYKNKGDKGDCNNYRGISLLSITGKAFAKVILRRLQLLANSIYPESQCGFCTGRSTIDMIFSLCQLQEKCREQNMPLYISFVDLTKTFDTVSRQGLYLLLERIGCPPKLLQLIIAFHEGMRATIQFDGYTLDSFQVNTGVKQGCVLAPTLFGIFFSVLLSCAFKNSHGSIYLHTRSDGSLFNLARLRAKSKIKKVLIRELLFAADAAIVAHNETQLQDLMAQLSRTCQQFALTISIKKTVVLAQGNTTSPCIMLNNNPLEVVLKFCYLGSTITSNLSLDAEINIHIGKAATTFSRLTKHAWANSKLTIRTKILIYQACVLSILLYGSETWTTYASQEKQLSSFHLHCLHKILNIKWQDKVPNEKVLERAGMSSMGAILHNRRLRWLGHMKRMDNNCIPKNILYGELAEGTRPKGRPKLCFKDYCKATLVKFQIDIDSWENLAVDRNTWHQHLRQGQKHYDKTLAENQNKKRMKRKEQMITTNTTTAWSCIYCSRTCLSHIGLLSHTKHCKKRPV

SEQ ID NO: 1787 - DNA, 291 bp, Phytophthora sojae
  source 1..291: mol_type = unassigned DNA
agacgagcaacgcgctggggcccaagacctggcatgaacgacactgcccaggctgtgaacgacgagcacgctgctaacccggcagcgcaccggcctctgggctccgctgcaccggtcaccggtgcaacacggtggggtccacgtcacggcgcgatcggggcagcggctgtagctcgcctgctcacaggcctacccacggcaccagcaccagcgacgcgccggcctgcttcggctcggcgctgcccagacccgcccgcttcccccgcggccacgacgacagcccccgatgcg

SEQ ID NO: 1788 - DNA, 346 bp, Phytophthora sojae
  source 1..346: mol_type = unassigned DNA
tgaagctacacaagcgcgaggctcgacagctggaccttcagctgtcgagccactgcatccgcgccagccaccgcatctggggctggcactgccggcgccaccgcgaaggacaacggagcggcaacgcctcgcgaacgccgcgtgggtctgggggggccccgcggcgcacatcgcaggctcgggcacagcggtaagctggtcatttgaccaacagggcactacccaggtagggaaccgcccttcaaaaacccaggaagacacaaacaccctccctttagtgacatgcatattttagcctacatttcagttacggagaggttactaactggtaaacacgaacacacat

SEQ ID NO: 1789 - protein, 1216 aa, synthetic construct
  source 1..1216: note = Description of Artificial Sequence: Synthetic polypeptide
MDVDGGPAMPEPWVLRFDGACRRNPGPGGAGAALFKPCGTVAWTCSHYMPNSSETNNTAEYTALLLGVQSAVHHGASHLEIEGDSHLVVAQVKGTFACRNPRLRQLRNRVRHALRAVTSLTLKHIDRKANAHADRLANRALDLKRSLAECGEHQGAMESCLHMNPAAQRQREQPAPPARPACAPTRAEPASDHDEDIDAEIAARDGGEAFPTLPIGPGTAPARQPRLRLRQLTEDEQEAAASALQAMAEELACKIEDADSWTSGDGYISAIPGRIRQVLQPFTAAQPHPRPTLQQQRQRPPRVTRTQREHRLDEALDEMAAVQQERPTSRSAVRRARRRVGRIRASMRQQQLRHDFARNESKCVEDILRAASAETAAEEHPETCPIDSGTLHEHFTAVNSPRINFLPDEACGALFREAMADVGTPQERRSALTDELTVDEVEDQLMQAATNSSPGHDGVGYDIYKKFAAQLVPLLHAAFQFCWRHHRVPALWKVGFVRLIHKKGDPTDPANWRPICLQTAIYKLYSGLLARRLSTYLEANGLLPMAQKGFRAYNGCHEHNFVATTLLDQTRRMRRRLYQVWYDLRNAFGSVHQDMLWYVLRLLGVERAFVERCDDIYEDSYFVVGNAADGATEPVRQEVGVYQGCPLSPLLFIAALVPLLRALEKLDGVGVALADGVRPCTTAYADDLKVFSDSAAGIARCHAVVEQFLEWTGLQANPGKCAFLAVTRNARGNPAHDKDMKLSLHDEEVSSIKLHDSYRYLGVGDGFDHVRHRLQLEPKLQQIKREAVALMQSGLATWQVVKALKTYVYPKVEYALRHLRPLQSQLQSFDRVVAKGLRHLLRLPRSATNEVLYAPTSSGGLGLQPLVEMHRALQIAHAWQMLHSKDPAIREVARAQVCQVARKRHRLREEHWRGRDDELVRCFLNSELAASPHAEALRRHGDIGSLWSDVQRWLRIYHLSLVVQDDRNGLDPLGLRVPHHAKWLDHKSVLRHVKLHLKIRHQTRWKGLADQGKTVRAHGGVGAKFVSTGAGLSDDDYRFGVKARLNQIDTNAVLKRKRLRSHKTCRDPTCSSAETLAHVLNHCEPNMDAIRQRHDDALEQIGSKIRNALKRGESTAELRLNQTVPEYTGAALRPDIVLRNVAAKKMVIADLAVTFEEHAAGARHSSLQLSHDHKTLKYQPIVAELQLKGWQVQTAAIVYGSLGSVQPSNSTPTRRS

SEQ ID NO: 1790 - DNA, 320 bp, Phytophthora sojae
  source 1..320: mol_type = unassigned DNA
taggaacctagccgattgcagcagcacctgcgccccgccagcacgcacaagcgccccagccaagacaccaggggcagtcgggtgacggagaccggggggactccgtcgcgctccggccgccgctagacggcaaccaggcccattgcggccgacagggccacacccatgtagggaaccgccctcggaaaccctgcaccggctcacatggtccgaccccccgattggttcaacccgtacaccaactacacaccaattagggactcccaggtagtcactaccaggacgcaacggactaaccggcaggtaatacattaaccctt

SEQ ID NO: 1791 - protein, 1677 aa, synthetic construct
  source 1..1677: note = Description of Artificial Sequence: Synthetic polypeptide
MDVDQGRVRPRQRRPSPRRPSERRPDGKRRRLNSEDDADAQKPAEHLQLADEDGAENHTPVHTPSAASAHQAPVLAVYVHNAERFTCTLCTFTAASFSSLQRHRTTRHRRAVLQDKFLAGCACGTPIASRPAAAKHAQACAGRSTALPATAPPVAGTSSPTDAAATATVAAATVTPDSPQPATPELAAPPPLASPTHPEVVEVQEQPSQGRWGPALPRALVAERVAARLGAIPAPRWEPPLPRELVSTRIAARLGEVPAPRWGPPLPRRMVASRIAARLLPPEPTADGETKEDTPADGADLTARDANQENNPAAAPDRTATAAAMDMDSGADGEWLLRFDGACRANPGPGGAGAALFKPDGSVVWTCSHYMPSSSETNNTAEYSALLLGSRAAADHGATSLRVEGDSTLVIQQVRGIFAARNAILRRLRDQVKVELARVGSFSLHHIDRQANAHADRLANRALDLRRTMMECGAHTAGDGCTNTTLDPMPVLPPQPTPRAPPPTPAADTNIEMQEPEDEDLADIDDGEVYAAMRIGPDAVPQRRPRLRLRQLTEAEDDAAREMVERLGATLAAKITDASDWESAEGYITALPHLLYDKLQPYSQAQRRPEPRPQRQRQQHQGSQCPRQQRQQGEQRRQRPLHDQGQDRRSLEGDAHGDNERDGDASQQDSARRRQCRRRGRSGAAKRRRRRRPPRVTRHHREHRLDEALDDLHAVEQASPGDRTAVRRARRRVGRVNSAIDQQHLRHRFDTDEKACVEDILAKARAQQETPRTAASSAGTASDPAAPAAGATDDGTCPIPGDELWRYFDGVNTPSQEFAPDAPAGAAFRSAMTHLPAASRFRELLTEAPTQDDIESQLQHAHGTSSPGLDGVGYDVYQHFAAQLLPVLATAFQKCWEAKRVPQSWKLGVVRLLHKKGAREDPANWRPICLQQAIYKLYAGVLARRLVRWLDANDRHAPGQKGFRAVNGCGEHNFLAATLVDQARRKRRQLYEVWYDFRNAFGSVPFALLWDALARLGVPEDYVTMCKGLYESAAFVVGNAADGTTAPISLRVGVFQGCPLSPQLFNAAISPLLFALKRLPATGVPLSGDDCPGASAYADDLKIFSGTEDGIKRQHALVADFLRWTGMAANPSKCSAMSIQRDRRGVLKADDLKLELDGSPIPALSMSASYTYLGVGDGFDHTRRRVELAPTLKQLKDDATALLQSGLAPWQVVKAVKTYLYPRVEYALRHLRPFQQQLAGFDRHLARGLRHLLRLPASATAQCFYAPVSRGGLGLLPLTELHAALQVAHGWQMLNSKDPAIQRIARVQLRQIADARHRLDTQAWAGREEELCELLLNSQLGTSPDAPPKRRNGDIGSLWVDVQRHLRTLGLQFATAPACADTGTAAATLQLRVPHHDKWLDHRTVLRHVKLHIKHRHWTKWAAMRDQGRTARAHGGVGSSFLTRPRGMCEADYRFAVAARLNQLDTHSVLKRRRLRAHDRCRQPGCSRVETLAHVLNHCPGTMDAVRGRHDDALKTIERALIASSSGDRQDRVELRVNQTVPSLAGPALRPDLQLYNHTKKTVAVVDLAVAFEEQVGEDPDSSALARIAAHKRAKYDRIKRHLERQGWKVHLSALVYGSLGAVAGGNRSVYTEHLGLLKRDAKRLDWQKKEEDREDKCSSWPHEGWVKAPGDRTAIG

SEQ ID NO: 1792 - DNA, 150 bp, Strongylocentrotus purpuratus
  source 1..150: mol_type = unassigned DNA
ttatagtaagttgtatactaaagaagatattgatgttaaaatgcagaagattatattttttctcaaaatatttcatctctctctgacgatgaaaataaaatatgtgaaggtttattaacacacagagaatgtaaacaagctgtattcgca

SEQ ID NO: 1793 - DNA, 106 bp, Strongylocentrotus purpuratus
  source 1..106: mol_type = unassigned DNA
ataaataactgtgtattattgatgttccattgatttgctaaattgtaagcaaaattatgttactgttgaatattgaataaacacctctaagaggcaaagagaaaaa

SEQ ID NO: 1794 - protein, 771 aa, synthetic construct
  source 1..771: note = Description of Artificial Sequence: Synthetic polypeptide
MKKNKTPGSDGITAEFYQVFWNEICDILVAALNECYANEKMSDTQRKGIITLIYKKGDHRELKNWRPITLLNSDYKIIATVLAKRFQKVIGKIIHENQSGYIRGRLAACNVRLTKDIIEYMTRNGKNGALMMVDFSKAFDVIDVTFIKKCLSKFNFGPVFQKWVTILYTNISSSVIVNGWLSETFSVLRGIRQGCPLSALLFVMAAELMANKVRENKEIKGLDIDDKGIDLKLLQYADDTLFYVSDINSFENILIELEVFGIVAGPKLNREKTVLIWIGTACQRWSLSCFGLHWTDEPVKYLGHHIAPDLQCALKIDWENKLEKMQKLLDNWRKRNLTLFGRLTIIKSLAISQVIHLMIVDTIPSTFLIKLNSLIFKFLWKSKIEKVKTFRLKWLGMFLDNTTGNWKDMCKHWFDCLGGLHLLLNCNYTDYTLNLLKLRNVPHFYIEILHAWYLINKYTSAECQTQKHVDENILWYNQDIVFEKKMLFYEDWYKSGIIYLNDIFKNGTFVSVNELFIRLKTRRSKQFLIFDYTKLQKSIPKIWINDKHRVPLVFKDHNFSIPHFVFGKSVKPVSLLSSKQWYNMISFEQIKINKCCLYWEDVLQKDVKWSSVFNRNLIGIKDFRLREFNFKLLYNMLPVRNNLFKWGLSYDDLCLKCKKTEDVLHAFISCKANETFFAYLKDLVLRAFNLRIEIDIVLLLKMNSQTEIDLIMTIAFWSIYKMIIFRNKYGYDNRDLSLIYLFKREMTNRIEINEHLKVQNMKFPANLLSYI

SEQ ID NO: 1795 - DNA, 112 bp, Strongylocentrotus purpuratus
  source 1..112: mol_type = unassigned DNA
gggacaacggcgtctctcagaactggtgttcacatggatatattcatggtcaccacactgcggtgaggaaggcaacgggaaaccaccttcactattcttcccaagatatacc

SEQ ID NO: 1796 - DNA, 10 bp, Strongylocentrotus purpuratus
  source 1..10: mol_type = unassigned DNA
aagaagaaga

SEQ ID NO: 1797 - protein, 1017 aa, synthetic construct
  source 1..1017: note = Description of Artificial Sequence: Synthetic polypeptide
MESHNSKSKRNGVKGTSRNRGASLGRPSHVRQVGPDRHSASVRNRNIMRIGTWNVRTLYQKGKLDNVVQEMNRMRINILGISETRWTGSGEFTVEKHRMIYSGGIRHERGVGVLLDPFTANCVLGFWAVSDRVLLVKLQGKPFNMAIIVVYAPTAESTDEDIDIFMNSQITMTAKSQCKSNEIVIAMGDMNAKVGRGRYGGTVGPYGIGDRNERGNRWVEWCEAKGMVIVNTWFKEHPRRIYTWKSPGDRARNQIDYITINERFKRGVKQAKTYPGADCRSDHIPVVATLQCKLKKMTKAKSIQKVDFEQLQNRDVRLRYTVKVQNRFDSLTDQGEEVTWESMRDILVETAEETLPKKEKKSKQRWMTEEILSKMSKRQKIKDRDGIEYRELDREIHDHCTKAKEEWLNKQCAEIERSFNANDPRVFKKVNDLSGKKLRSSKLGCIKAKDGSVLVEKEEILNRWTEYIGELFDDVRKEPPHCAGSIEGPRILLSEVRSAISMMKRNKAAGPDGVVMEMVEALENYGVMKLTEVINKIYDDGKFPDDLCKSIFITLPKKPGAVECGQHRIISLMSHITKIILRVLLQRARNHLTPEISNVQFGFVKDAGTRNAVFVLRSIAERAVEMQKDVFLCFIDYTKAFDKVRHDQLFEDLTKIGLDTKDVKLLQNLYWEQTACVRVETELSDYINIKEGGSARMCHVSRSLQLLQVTTSTLKRGVRQGCVMSPDLFNYYSELILRNLEQERGLKVGGHNITNIRYADDTILIAESEKDLQRLLDVVVRESDKRGLSLNYKKTECMVISKKGGIPCSLKINNNQIKQATSVNYLGTTITDDARGEQEIKRRIALAKSTFSKLENILKNKKLKMKTRLRVLNCYVYPVLMYGCEAWTLTSDLRKRLESCEVWFLRRMLRISWTERVSNDEVFAMAGTRRKLLNNIRGRQLSFLGHVIRKNGLENLALTGRIEGRRSRGRRRILWMSSLRSGISECGIDLGENELLHRIWDRELWHSMVANVSGYGT

SEQ ID NO: 1798 - DNA, 140 bp, Strongylocentrotus purpuratus
  source 1..140: mol_type = unassigned DNA
taggtgttgtctattgtctcatgttattacacaacctcctccctccacaaaatagcagtaatcacggaagaatcctggatcgatgaacaggcttagacctacaacatcgtgttttaaagtaaagtaagtaagtaaagtaa

SEQ ID NO: 1799 - protein, 725 aa, synthetic construct
  source 1..725: note = Description of Artificial Sequence: Synthetic polypeptide
MSGETRYIYDKADYDAMYDKIMEIDWNNEFWEMSMEKSWSFFKTTLLDIFNRYTPKKTLNVSQRKKHWMNRETLEVVREKHRHFRKWQEMKSEKNREKYSSAEIEQQRRCYSRSSNQARWQCRKAVSSYEKYIASGVKKNARAFWSYVNSKITTRESVCNLTKPDGSKTETDQEKAEVLQDFFSSVFTQEDLQDIPLPLDVEFDTPLDDIQITSGDVFELLRRLKPNKSPGPDKIHPRLLKELADVLALPISLLFQKSLESKQLPQDWKSANVTPIFKKGNKSDSKNYRPVSLTSIICKMMENLVRKQLLDHLMTNDLISVHQHGFVVGRSCITNLLEVLDQWTQILDDGGTVDAIYLDFMKAFDTVPHHRLLLKLESYGVRGNVLAWLESFLSGRQQRVVVRGKQSKWGKVLSGVPQGSVLGPCLFLLFVNDLPKVVNSNISMFADDTKLYVRADTADLRKQLQEDLSRMEEWAEKWQLCFHPDKCTVLRLGKLPAEASTDYCMKKGTDSVTLSVTKVEKDLGVLVDSQLSFKDHISQTVLKANRVLGVIRRTFMYLNTDTMPFLFKGLVRPILEYGQAAWSPYRLGEQRMLESVQRRATKIIPGLRNLTYQERLTKLKLPTLVHRRKRGDMIDVYKYVNGLYTVQEMPFKMSTEDRTRGHSRKLEKKYSRLDIRKYFFSNRVVELWNGLPENVVAAGSVNSFKNRLDSHWSKSVPVSLLYEPV

SEQ ID NO: 1800 - DNA, 425 bp, Strongylocentrotus purpuratus
  source 1..425: mol_type = unassigned DNA
taaatataacccaagtactcgcaaataagtagccactatcacaaacttcaatatttagtaaattaccaattgcagatcactgtatttctcataaatatcctacaaattacaaataattatgtttagacacactgtcacctcaatataatattttttcttcttcaaaatttgtttatgtatgatttcttgatgacttgatttttttggattttttttgtttacttgctgagtttaaatttacatttgagatttaatctgtaattctttctggtatgtttactactcaccatgtgatgatgttttcatgtatatgtatgtcttatatatctattttatgttatgtagggcccccaagaataacagtattttaactactggtggggctaccctgttgaaataaaacgaaataaataaataaataaata

SEQ ID NO: 1801 - protein, 476 aa, synthetic construct
  source 1..476: note = Description of Artificial Sequence: Synthetic polypeptide
MIISKPITRLFNLSLRLGVVPQEWKQARVTPIHKGGDKDNVNNYRPISILPTIMKVLEKAVHSQLHDHLLEFDLLNAQQSGFRKGYSTNTLLTYVSDNLHRNIDSGKLTGIVFLDIRKAFDSVDHSKLLEKLYTYGVRGNTLSWFESYLRGRYQCTLVQRARSDLQVLQSGVPQGSILGPLLFTLFMNDLPNSVEHSKVMLYADDTAIMFSALNPKEIESTMNSDLDRVKSWLCHNKLSLNTDKTNFLLVGTPQKLRHIEAPIDIKIDGLQIRQVEHVKYLGVWLDQHLNWNEHMKHTSSKIASRLALLRRVRKYLTIDSAKLLANALVLPYFDYCCTSWSNCNQGLRDTLIKLHKQMARIVLQMNVLTPSSEMFSKLKWMNMEKRWQFQKCKLMFDIVNGYSPSYLQDMFTQSAATHRYSTRIADTRGLVIPKVKTENGRRAFSFEGAMTWNNLPSELRNAQTKQSFCTSYFRNM

SEQ ID NO: 1802 - DNA, 294 bp, Strongylocentrotus purpuratus
  source 1..294: mol_type = unassigned DNA
accagaaggtgttagctgcatggactcgtgatggtatgattattgcctcaattcaagcctctggtggaaaatcgacctctaaagttatacgttcagatatcgacctcgaaaacctttgatagttatgtcacgttagcgatattatgaacgatcgagctgacattttaatgacttatatttctccctggagtgagaagttttttacattttatctttttggatttttctaatactcgaacttttaaatgtaaaataccttttgtatttctaatttgttttttgtatactgcttgt

SEQ ID NO: 1803 - DNA, 282 bp, Strongylocentrotus purpuratus
  source 1..282: mol_type = unassigned DNA
taactcaccaggctctttaccccccccccttgttttccctctttttgtcatgcttccaatcgtacaacaattaatttaccttttatttacattatactgagggatgggctctagcataaggaccacactcctttttagctcatcccttcactcccattatgttatgttattttgttgttgttgaatgtatgatattttatgtgtgattattcctcatttaattgtatatgttcttgtatttttaatgatgagtgtaaataaacgaacttgaacttgaacttg

SEQ ID NO: 1804 - protein, 998 aa, synthetic construct
  source 1..998: note = Description of Artificial Sequence: Synthetic polypeptide
MPGSTVNSIINDQSFVEFLSPRNGENDFYGPSHGSYTCNEFNDLVNDSNDGLFSILHINCRSLSKNYDNISTFLSSLTVQFTAIALTEIWIKEYNSYYDIHNYTLVLKGRQNKKGGGIGFYVRNDVKFNRRLDLDINTPYIESLFIEVVTANISAILGVVYRPPDQPIQSFLESVENVITTVNTENRIFYMIGDYNINLFKVNCQSHVKDFIEMFMAVGMYPLVHGPTRVVNNSISLIDNIFTNNLENCSSGTILTDISDHFPIFCIYSQSTQTVTETCITMKRQFSAKNINTFITNIGNTHWILKENDANSSYDCFLKQFQHVYEICFPMKCQSKKKKRFDKPWFNDELRQLNRKKSLYYKKYLNNRTAYRLDAYKKCRNKLTNRIKYVKYKYFKQSFVDAKGDTKQTWKIINGLLGTKSKKNEIPSTLQYNNETIDNDTDICESFNEYFINIGPKLTSTLDIPTGDFKQYLKKMNLLLFFYFFFTPVTPREIINIVDKLKSNKCSGFDSVDVKMVKRVIHLICYPLCAIFNSSLETGIVPDQLKIAQIIPIFKSGTKTEMSNYRPISLLPVFSKILERAVYNRLYSFLNLHNILNNSQFGFRTGHSTSSASVDFTCQVSQVFDKSEVMMGLFLDLSKAFDTLDHNIILAKLFNYGIRGVLLNWFKSYLSNRKQFVKIKGNTSSMQTVVCGVPQGSILGPLLFILSINDMCNISDKLKYILFADDTSVFMSHKNIQSLQQDFGNEINKLLHWLSLNKLILNVNKTNYMVFTKQQKIDFNEVDLQVNNHEFKRVSVNKFLGIEIDSKLTWNEHTGAVCNKISKNTGILNKLRFLPKCVLRMLYNTLILPHLYYCSEVWAMTSQTNLNRILKMQKKAIRIISNSHYRAHSKPIFYKLKLLNVFDICEYHIAVFMYLCRNESLPCALLKYFNLNSTFHDYETRNASNFHLPQIKTTLMKKSISFDGPKIWNSIPINIRNCRSLQTFKRKYKMYLIESYVL

SEQ ID NO: 1805 - DNA, 131 bp, Strongylocentrotus purpuratus
  source 1..131: mol_type = unassigned DNA
ccaaaccgttttcagtcataggagtcacagaaacgtggcttaatgatacatctccatctactttatgtaatattgacaattattcgattgtacgttctgatagaaaaaccggaaggggtggtggagctgct

SEQ ID NO: 1806 - DNA, 413 bp, Strongylocentrotus purpuratus
  source 1..413: mol_type = unassigned DNA
tgacaaatctcttaaattaacacatgatatcatatatgtttgtcagcatttccttgatatagcaggaaaatccccctcccatgcaccctctatcccattttttttttttttggttgcaagtcactgtttattttttgttattttcccccaattatgttctgtaatttactttactttacaatcgttatgattttaaatgtttctgggctgcaagcgtatcaagctgtcacgcttaggctgtagcccttctgtatcatcacctcttcgagcgtatgtatctatgatttactgaatgtggaaatgtaatttaacttatgttttatactcatgtaaagacattgtcacattattgttataacctatgatgattcagtaaccaataaatatttcaactatttcaactatttcaacta

SEQ ID NO: 1807 - protein, 873 aa, synthetic construct
  source 1..873: note = Description of Artificial Sequence: Synthetic polypeptide
MFISNLLTYKIRSDLSLKSDGTDSICIEINMAQRKNILICTIYRPPHTNVELFLDEFDRMLHKVNLENKDVYLMGDFNIDLLQEDNTFHNMLRSNSFNAMIDKPTRLANNSSTLIDNIFTNVTNNYIGSGLLYSEISDHLPIFLICNHVRNYPEDEKNQAMIRKITAEKIAMFNDELLKVTWNDVVACTDTNKAYALFWNLFSSLLNKHIPMTKKRSARNRIKQPWITKGIFCSIKKRNRLYKYSLRHPGEESLNNYKSYRNKLTTIIRQSRQMYFAKQFENANGNASSTWNVINQALKKQKSKSKCHITKDNNTMVDSKEIANCFNAYFVGVGPNQANTIASNGVDFSQFLQTPCNKSLFLKPTNLIEILNIARSLKISYANGHDGISTYLLKQVIGNIITPLVHIFNLSLTTGTFPEAFKIAKVVPIYKKDDSSQVSNYRPVSILSSLSKVLERLIYNRLYCFLTENDLLNQDQYGFRKYHSTDLALAQLYDKVSNALASRKHVIGVFMDLSKAFDTLDHKVLSSKLHYYGVRGVALDWFNDYLSGRKQYVSYESVDSSLLPMKCGVPQGSILGPLLFLLYVNDISNSTTSLQYIIFADDTNVFCSNSDFRSLQRILNTELPKLSLWFRSNKLSLNLKKTNYIHFQSRKNATDKPIPEIVLDGEYLEKKQNTKFLGTIINENLKWSDHVHYVSKRVSRTVGLLYKLKHYVPLNILYMLYNSLILPYMSYCNILWADSKVYTDKMLLLQKKAIRVCTNAGYRDHTDPLFARLKTLKVTDINFLQKALFMFRLHNDSLPSHFPPMFCLNRNIHTYPTRQSNKYHLCNPKTTMAMKSIRHSGPDIWNSLSVDIRNLKSVYTFKKSVKSILLSKY

SEQ ID NO: 1808 - DNA, 578 bp, Strongylocentrotus purpuratus
  source 1..578: mol_type = unassigned DNA
gtgaggtgatggctacagggagcagacatggtctggttttggtgatataaaatccacttaatcttgcacttttaactgcagatcgtgtattttatttacctgattttgcttcttgaacatatcttcaagcttttgatatgattattttgttctttgataccttctggaggtagaatattgtgatagttttacagccattttctgccaaggaatttgaacacacacctgtagtcccatatggaggatcctgagtttgcttattttgcccagccttcttcatacctacactacaggcaacaataactgtaatgtatattttctgactgaattatgcttatattattcttatgatatagaagcaattactcactgggatttaaatcatttaccagatgatttagctaaccgtctactactactaatagctaacctacataaaatgggtgtagctgagtgagtgagactgctgagcttttctgacttccctttgtttgttctgaatacgtattgaatattgaatactgtcctgccaaatttaatcaccggtattcatcaccgttcgacttgcaaacgccatc

SEQ ID NO: 1809 - DNA, 187 bp, Strongylocentrotus purpuratus
  source 1..187: mol_type = unassigned DNA
taagcttactagcttggtttttacttgcactggacttagcatattttactgtaaattgacaagtgctttgtccacacaccattccagcaattcatgacactccttgtagtcacttgcctcacctaccatcccagtatagcttcctgagtgagctgccaaagggattacccaaccaagtaccaagtaa

SEQ ID NO: 1810 - protein, 1198 aa, synthetic construct
  source 1..1198: note = Description of Artificial Sequence: Synthetic polypeptide
MKNYFLPPSSSRSHPLLLAILSIVCALKLLKSGNLYTQIADHRSASLPFFDLHATLCEPRSLHQPTRRRTYTADIDNCKLLLFISSCNKWNRNTKLCPLDFRSTSLSHLTILLLLSGQVETNPGPSTSAPETFPCAICGDEVRDNDPALLCDHCDCWCHISCVGISPDSYDILTKKSRSFAWVCCQCSSTNIGSSSSLQGLNLSQTNRFSPLHHDSSNEEILPSINPLTSTPTSSPGGRRQPRFHPPSRNRKKAFKVMVVNCNGLKGNAKKSSFHAAIAHHTPDFVFGCESKLDDSLSSYSIFPSNYSIYRKDRNIHGGGVFIAIIDTLIVTECPEFDSDCEIQWCNVQLANAKPLYIGSYYCPPNNRQQGLEGLHQSLSKIMTRHRRSHPNILIAGDFNHPDINWDDQSTTNPATSTCHQKLLDILLHNSLSQTVREVTRPSSNNILDLVVTSNPALVENVCVKSGISDHNIVTFTLAANPKISVKPLRKIYQFHKADEQQLRDAAAEFATEFLQSDPERRSVETNWSIIVNFLNRCLSELIPSKMSKGRKHLPWITPPLKRQMRKRDSLFKKAHSQSCSTAWTAYRQFRNQVAKNVHRARCEYVNNIIGASLKDNPKSFWSYIKTCRSENIGIPTLRTPSKLCASALDKAETLNDYFQSVFTPHQLQPLVQKGPSPFPTIGHLHVHRTGVEKRLQQLDPSKASGPDELPPKLLKLVAREIASPLSFLFQQSYNSGIVPAQWKQALVTPIHKSGEKCDPSNYRPISLTCVCCKVMEHIILSHVSKHVAVNNILTDAQHGFRRGLSTTTQLTTAVHDWSSILQQRSQADIIFLDFKKAFDRVPHLLLSTKLQYYGISGDSLQWIMSLLTDRQQAVVVDGSKSTWRDVTSGVPQGSVIGPTLFLLYINDIQDNIQSTMRLFADDSTLYREIRCPEDHQILKDDLQQLSRWSSNWMMDFNVKKCAILTITRKRTPSIREYHLSNGLIPRVKEYKYLGVTVAADLRWNKHCQTIRHKASRTLGLLRRTLSPCTRDVKSRAYTALVRPQLEYASEAWNPHSVTVTKMLEQVQRTAARFVYRDYRYTTSPSALVAALGWDTLHTRRILDQCTLLYKIHHRLVSIPAPTIVIPATYFGRHDHNLKYVIPVATIDSFKFSYYPRAIRIWNHLPGSAVNATGITNFKEAALPSIRMMQPPVGSHII

SEQ ID NO: 1811 - DNA, 303 bp, Strongylocentrotus purpuratus
  source 1..303: mol_type = unassigned DNA
tacctgttcataagagaataatctataaagtttcactatttgtttataaatccatgtataaccttatcccatcctatatttctagtctgttttgtcccatccagcaatcaagatatccattacgttcaaggtcagacccccttcttctgcaaatcccccgcatcaattcaaagaagggtcaacaaaatataattttttctggtcccactatttggaatagtctccctttaagcattcgttcttgcacctcagtcgcattatttaagaaacatttaaaaacccatttgttttctttgtaattgt

SEQ ID NO: 1812 - protein, 671 aa, synthetic construct
  source 1..671: note = Description of Artificial Sequence: Synthetic polypeptide
MHGHTLDLVITRCADNILHNCMVLDKGISDHYVISCDLNLQKSDAKRTLITSRNYRLINQESFGNELVAVLQSISQCGDVNEQVEFINKAICDVLDRHCPVSVRMKRDRPCGPWYDDNIHLLKRKKRKSERKWRKSNLRADRDIFVCHKDELNAAIVKSKSSYFTNLLLEANCKTMYATLHLLLGSSKKVLPYCDDQTDLANKFAGFFDDKISKIRTVLDEREQGLQTSGIVQSMDKHQCETGFSTFVDVSPSDIKMIISKSANKFCSLDPMPTWLVKDNIEVLVSPFVSLINSSLRSGVFPDKFKDAIISPCLKKSTLDSLVLANYRPVSNLAFLSKVLETIVSKQLVKHLDRCDLHEVLQSAYKANHSTESALLRVKHDLLLAIDKREGVIMVMLDLKSAFDTIDHSVLLRRLHSDFFLSGTVLDWFQSYLEGRSFAVSIGNHLSHKLSLKYGVPQGSVLGPLLFTMYLRPLGDILRNNGVEFHLYADDVQLYYSFNPKSSSSFQNAILLIEKCVSEVNVWMIKNKLLMNEQKTESLLIISSRLRHYLPDHVHLLLGDAFVEPSESVRTLGVVLDSSLTMSQQVTSLCKSLNFHLYNISRVRRMLTDEACHHAIRSLVLSRLDNANSLLININVSDIDRLQRIQNRAARIISNARKYDHVSPFLNNYTG

SEQ ID NO: 1813 - DNA, 551 bp, Strongylocentrotus purpuratus
  source 1..551: mol_type = unassigned DNA
tgtgtgtgtgtcgcgggagtcggatgtacactgcaaatgcttcctggaaactgcctacatcgacaccctgggatgtctttatctggaatttcttcatgaatttaggaatttcacccttccttctcatggcagattgaattttatgttcttttggaccaattctgtcaactgaaatctaagctagattttgccactcatttcattaagagtgccatcaaaatctgtagtcccacagcaagactctgatgtctacagctttcacatgggctacagtcatacatgtacagacatgtacagggaaccacctagcttctagttctacactgtacaactggcaaccatggtcaatactgtaatgtattattattattacattcctttctccactatgagttgattgaattaacatgcccaagaaacctaaatttccatgtggttcatgtgggaaaaatgtggcttggaagtcaagggcattcagtgtgaaggtgaatgtgaacagtggttccatgcagagtgtattaactttaactctacagactacagtgccctag

SEQ ID NO: 1814 - DNA, 313 bp, Strongylocentrotus purpuratus
  source 1..313: mol_type = unassigned DNA
caagaccctccaggacctgcccatgcacatagctaccaagtcctccgttcaagaactgagcagcataagcagtccttctttcccaggactgtgagagtggaacaacctccatcagaaacagtatggcctcatccgtcaatgccttccgtcaatgcctgacgggaggcagcaactaagtccgggaactttttacttgcaccatgtaaatagcattgcaccatgcaccttgctctcgtaagcacacacacactcatcagtctgcaagaatcttcaactgtgaaggaggtagacttaacccaaagaagaagaagaa

SEQ ID NO: 1815 - protein, 1015 aa, synthetic construct
  source 1..1015: note = Description of Artificial Sequence: Synthetic polypeptide
MAPAQLCGSATSVEYTISAGQIYSFPVPSVATSAAKICHLNHTDIEPCTTNPDSKDEGESDDSLCLGSPKFSSSPRTLKKKPINPTKPKAKVLTILNVNCQSIRAKKQSFAILIHQHNPDVVIETESWLTEDIRSSEVFPTDHYNIARRDRPNDLHGGVFLAIRKDLLASREIELETDCELIWCKISMPGAKTFHVAMKLRAHLVQDQHARSQDFPCCDEMSLTELERSLSRLSPTHSVVIGGDFNLPGWDWRNQQVGNCRYPNLHRRLGSLLDDHGLTQVVTEPTRYQNTLDLLLVSNPTVVNEVTVVPGVSDHDCPLVKLNVRPTRPDEEESFTLQQSSVGEVWDQPGQMRRKVLLYSKAQWEKFGESIEAVRDEIEAKVTYASVNELWLIFKTGIEKGINDFIPQKLTPHKANLPWVTNGIRRLIKKRDRLSNECRHLRKREGLIPYVLEERLRDLKRTLQFALRKAYWNYVESIFTVEDDDEGPGKYNCMKRFWQFIKNNRNDSAGIAELKSDGVLFSEPAEKADALNRQFKKVFTQEIPIPPHLLPDTSEHESMPDIVITLKGIEMMLKKLKPHKAPGPDGITPRILKQLSRVIAPILRIIYRLSYDTGEIPDDWHKANVVPVYKKGDRTDPSNYRPISLTCICCKMMEHIFASSIMRHGDEKDILCPLQHGFQAKKSCELQLTRLCHLGFVTDLLNNMELSQQTDVLITDFSKAFDKVGHQRLLKKMEYYGVRGKSIDWISSFLPNRKQQVVLDGHTSPTVEVQSGVPQGSVLGPCLFLFYINDLPNQLSTKVRLFADDTVLYHTIQETHEDAELLQQDLDQLCGWSSKWMMALNPKKCQVITVSRKKSQVCPSVFPQWRNHWSLCQLPNTLALLSLLTSTGTQHVSATCKKANNTLAFLRRNLRVNSTQLKTTAYQALVRPLLEYGSAVWDPHTIRCVNQLEMVQRRAARYVLNRYHHTSSVSDMLSQLGWTSLQKRREHQRLTLLYKMHYSLVDFDIHHPTSNRQQS

SEQ ID NO: 1816 - DNA, 421 bp, Strongylocentrotus purpuratus
  source 1..421: mol_type = unassigned DNA
tgatgttacttttaataattactgtcgatgttcaaactgaatgtttcttttagtttgctgttgttaccctgtgaattgccattgcgtacgggtagtgaaaatgttatacaaatattgctaagtgtatgaatattgtttatttttcttcataataagtttcaacttaattaaattacgtttttttaatatacacaagactatgtcattgttgtaactttcggagcctatgacctacaagcattgctttctctttaggctccatcatatttcttcccttattcaacttagtcttatgtatcattctttttttttttttgtataaacgcatcctaaaatgagttcaaaatgtaacatgctatatgtaatgatgtactatacaacatgtgagaaatatgaaaataaactgaaactgaaactgaaa

SEQ ID NO: 1817 - protein, 811 aa, synthetic construct
  source 1..811: note = Description of Artificial Sequence: Synthetic polypeptide
MDFNLNLLQCDENTSCQDFLDLMLSKSFAPTITKPTRITEYSATLIDNIFVSGTPIVKSGVIVTDISDHFPIYTVISNVISHSNPNTNKCSGIRYLSDPDLRRLKEALTITDWYAVYNCDDVDTSFDNFMEILMLTLNSFPTRQQNCSNYKKHPRLAWISKSLLKSINRKNTLYYKYKKNHTVKSKLKYSRYRNILTTSLRLAKKNYFTKQFNVNKGDIKNTWRVINNVLKSRRVSTHISNIMINENRIQDPLVIAEEFNNYFANIGPNLAQNIPVSDLHFQYFLETKNTNSMFCTPILEHEVIDIVKNMKTKKSAGNDGITNFILKEIIGEIVSPLTHLLNLSIMNGIVPKKMKIAKVIPIFKKGNAQDIGNYRPISLLTSFSKILEKLMYSRTMQFLIDFDILSDTQFGFRQKHSTTHALLMFLDKVAHAIDDMAHTVGIFLDFSKAFDTINHDILLYKLSHYGIRGKALEWFRNYLTDRKQYVSINGHDSYQRSVSCGVPQGSLLGPLLFVIYINDFRNSSEIMSFILFADDTNIFYSHRDPQYLLRTVNSELKRIQAWINANKLSLNVSKTHFMLFSNCIKSLPGNILIDNTNLNQAESTKFLGIYIDSDLSWKIHVNYLCKLISRNTGILNKLKHEFPTHILLSLYNTLILPYLNYGILAWGNGTKAQLEKLLIIQKRAIRNINHAGFLSHTSQLFFNNKVLRIGDVYVYSVGVFMYQLTINELPAVICALFVRNNTIHSYSTRQRNLFHLPLTRTLFAQKNITFTGPKLWNDLPIEFTESTSLYSFKRKLKCHLLSNYALMVEEA

SEQ ID NO: 1818 - DNA, 82 bp, Strongylocentrotus purpuratus
  source 1..82: mol_type = unassigned DNA
atatatcttcactctcgatatatcggaactctcgatttttcctaccctacaactaccggcgacgaatcacctaacaaccgca

SEQ ID NO: 1819 - DNA, 289 bp, Strongylocentrotus purpuratus
  source 1..289: mol_type = unassigned DNA
tttatatatacattaatttttcatatttgttttgaacttgtaaccattctgtaccaaaatgacaatatttaacgtaatacgcaatttatctcgattcaattatacactattcatttatgtatcatgtatggggatcttctagcttcctcaccataatgttacaatcttcttcttttaccctgttctgtactataccacttctgttttcctctccttttctccttttctccttttcacatccttttccctctctctttatcccggtgctccttgttatcacatatattat

SEQ ID NO: 1820 - protein, 977 aa, synthetic construct
  source 1..977: note = Description of Artificial Sequence: Synthetic polypeptide
MPPYVLIGSLLLFFTFQANCLRFNVPNLRATEWQPHNAAIKDRLTLLHHDLGAGIVTPKSAADDLTSILTEYFSGQDDFVDKKLSDTYIEHEPKSLIQARKCKNVLRKRAFGKNGTAEDRKAFRAAVKTVSYLRKQDKQKKCDKSRSHMEKRYRNNFYEFSKAACSGSLNESPTKPLFSEDVANNYFGDKYSTPNVINIGSLNWFPYVNINTPDRFEFDMTPIKPKDVKNVLRRKKAMSAPGNDGLMYGMIKHLDSVHHFLATLYNKILDSGDPPESWSESKVTLIYKSGDTDKPENFRMISLTSCISKVFHQIIAERSMSYLTENNFIDKTVQKAFIDGVNGCIEHNIVLHEILSDAKCKKRSLHTTFFDLADAFGSVSHQLITSSMERYAIPTPVARYVATLYSRLNGRVRGPGWITKPFEFKRGVFQGDPLSPTIFLMCFNPVLEYLKEQQDQFGYKWGDRKIITTPYADDFNLITGNKLQHQKLMNGINDRLKSMGLTLKPRKCSSLSLTSGKPNIVDFTIGSDVISSVHGHPVKFLGSLITFSMKTSEIFEYLKGKIESTLENINKCNIRNEYKLCILTRYALPSLRYMLTVHDVHASHLKSLDIILDRYIKMWLGIPSRGANLAVVHDPDGLNIPSISDLYRTCHCLAYSRSRVKGDDVVNHALDRRLERERGWSRQTSFSLEAHEIHSKIPDSVSWNQTKTVIKKAVQDVCRENWKRVIEPLLVQGEFMKVVHMENTDVTWKSIIYNLPQSVMKFSVNAAIDSLPTNKNLYRWGKRISDKCNLCNCTGTLHHVLNNCERMLDRYTWRHNNILRIMLKHIKNTSNNSTKVYADIEGESINGGTIPPNIIRTQHKPDICHIDNKNKDIIIIELTVPFETNIDKAHQRKQDKYASLTHDITSTGWKSKLICIEIGSRGLITPQNKYRLKEILKITNSTRYPESRDEILKAVLFSSYVIFQGRREPAWQFDQYL

SEQ ID NO: 1821 - DNA, 93 bp, Strongylocentrotus purpuratus
  source 1..93: mol_type = unassigned DNA
ggtctgttgtattacgatatttctgaccatttaccgatatttattatttctaaagttcaccttgttaaaaaaattactaaaaataattgtgca

SEQ ID NO: 1822 - DNA, 650 bp, Strongylocentrotus purpuratus
  source 1..650: mol_type = unassigned DNA
tttcaacatgcagtaggcaattgtcaaatttcggtcacattgcaactcagttttgcaaattttgttttctatttcgtatttcttaatttcctttattgtaaaggctgtatttgtttctactcgactataccacacagagctacgtacacttccactatttgttacaaacacatacaaacacgcacgctcgcgtgcacgtgcacacacacacacacacacccacacacgcacacacgcacacacacaatatatatatatatatatacacttgcacaacacactcaccaactcatacacaaagatcgcttgaacactttttcattttaagttttaccttaagatttttttttgttttgttcttgtttttttttaggccgccatccttgtcaagctttgcttatgattgcggtctcctgcacttttccaccagaatagttaggataatactttaaatttatgataatatgttatggaaataataagtttcgttattataattatgtacatatattatgtaaaaaaacattttgacatgaagaaattattgtttgtttatgttgtattataccttacatgtatattatgttatttgttattcagttatattttatttggaaaaaatgcagaaataaaatcaaatcaaaatcaaa

SEQ ID NO: 1823 - protein, 715 aa, synthetic construct
  source 1..715: note = Description of Artificial Sequence: Synthetic polypeptide
MHRKQTKHNIESLNFDLAKEDWVEVLCVSDVNVAYEKFLEIVLHYYHKNIPLVKIKKGKKAKQPWITKGILRSIVARNKLYKEALTSQCNDKLKKYKTYRNHLTSLIRLSKKLYYSNNIESNKSNNNLLWKTVKELLGKKKTESNKCFLIDEQQITDPIKISKAFNEYYIDVGPNLAANIDSGDMDYNKSLNFPRENSLFLTPTNDYEIINVVQHLNSTKSSGHDSISVHLLKQIIFNMVTPLTYIFNLSISTGVFPHLLKIAKVIPIYKKDDSSVISNYRPISLLPSISKILEKIIYKRLNTFLQKNNSLIPNQFGFRIGHSTDYAILHMYDKIIEAFANSEHIVGVFMDLSKAFDTIDHKILIHKLQYYGVRGQALSWFTNYLQDRQQYVSFQNHESTKLTIKCGVPQGSILGPLLFIIYINDIIETSSLLNFIIFADDTSISYSHKNFDTLITRLNCELMKISRWFKSNKLSLNLSKTNFIHFKQTNVHDMRNCNIEIDGLPLIEKQSVKFLGVSIDSHLNFNEHIRNIHTSISRNIGILYKLKQILSERSMIILYNSLILSHVIYCNIVWGNCSLTRINSLFLLQKRAIRMITNSHYISHTEPLFQRLKTLKIQDIHIFQTCIFMYKYSHNQLPSLFHNIYSLNSNIHTYPTRCSTNYHLENPKILLAQKSVRHHGPDVWNSLPNSIRHCSSLYSFKASLKKTLISKYLHN

SEQ ID NO: 1824 - DNA, 482 bp, Strongylocentrotus purpuratus
  source 1..482: mol_type = unassigned DNA
acaaatggatacaagatgcaaaaaagtggaaacctcacgtcaggctaccaaatccaaggcagtctacacaacaatcaaacaaatcactaagaaatctagcatcagaatgcaggcagtgaaaagcaaagatggagaaatccttaccgagatgaaagatgttaaagagagatggaaagaaagctttgaggaactgtacaatcaccagaaccaaacaaatggagaagcactactcagatggccagcctcgaaccggttccagacattctgcgagatgaagtagaatttgctgtacgaaaactcgcagaagagaaaggatttgacagcatcacaggagaggaactcaaagctactgggccaacaggaatcaccatacttcacaaaatatggcgggaagaaagttttccggctgactggggaaaagccataataacaccaatctacaagaaaaaacaaatcaactgtggaaactacaggggtattag

SEQ ID NO: 1825 - DNA, 17 bp, Strongylocentrotus purpuratus
  source 1..17: mol_type = unassigned DNA
gtcaagtaagtcaatta

SEQ ID NO: 1826 - protein, 430 aa, synthetic construct
  source 1..430: note = Description of Artificial Sequence: Synthetic polypeptide
MPAKPCRESIRIILQRRIMKKTEEVLSEAQAGFRPGRSTMDQLFTLRQIMEKRLERNQSLLCCFIDYEKAFDSVWQEGLWKAMNFFGYSSKYIHLLQALYQQSSSAVRVNGELTDWFKTTVGVRQGCALSPQLFNILLEAVMLYAIHDTKIGVRVQGQLINNLRFADDIVLIADNDRDLQTIVDLVHQSSSNFGLKINITKTEVQAISKQPQLLNINVGGEQLKQVDKFTYLGGTISQTGSCSEEVKHRIGKAIGAFQALKKIWASQDIRCSTKVELYKVLVLSILLYGAETWTLKKVDENRLHTFEMACLRRIMGVTRFDRLRNTHIRTQLNMEETIIDRVATKRLRYFGHINRMNSKRYPHILLNGNIHGKRPRGRPAKRWTDCIKADCKNRQVDSLTKATRLTEDRKVWQAIVKQKPSYIPVMVWTA

SEQ ID NO: 1827 - DNA, 108 bp, Drosophila serrata
  source 1..108: mol_type = unassigned DNA
taagattctccaggaccatgtgaaaaacaacatccggataaataagggccatactggcctatgattggccccctcaggagggccgtccggtttaacctaacctaacct

SEQ ID NO: 1828 - DNA, 305 bp, Xenopus tropicalis
  source 1..305: mol_type = unassigned DNA
tgacattctgcccaaaccaacacacactccccataactactggactcttcgcagtgtcactttaagcaaagccactttaaatcctcactgcacaatttcaaatattgcattgcattttattattgtaaatacttgtacctttattgcacacttttattatatttaatatttgtattttttttttttttgttttttgttttgtttgtctatgtaaagttgggaggaacacgggtcaaaaaaatgtcattacagtaatgatgcttcattgttatttgtatatgacaataaacttgaaacttgaaact

SEQ ID NO: 1829 - protein, 964 aa, synthetic construct
  source 1..964: note = Description of Artificial Sequence: Synthetic polypeptide
MAPVRMAAVAQCPPQLCFFLMFVVLFFSFFATCNALISYDRQTLLDIRQNSQSGPSQTEFFMNRGDLPWLPWQKKHRRKRGKRAGILVRLRNRQHRAPLPSILLANVQSLENKLDELRARITFHRDIKNCNIFVFTETWLVPSIPDSAIVPEGLSIHRRDRTIDSGKCRGGGVCVLTNKRWCTDVQTVSSGCSPDLEYLMIRCRPFYLPREFTAIFCTAVYIPPHADTTRALDELFDAIDRQETLHPEAAFIVAGDFNKANMKKVLPKFYQHVNFPTRGENILDHVYTPYAHAYKARPRPAFGKSDHSSVLLLPAYRQKLKREQPMMRSVQRWTDQSDSTLRHCFNITDWEVFRTAADNNINNYAEYVMDFIHKCINDVVPRVNVRTYPNQKPWVNGEVRAALRARTAAFKSGDPSEYKSSRYALRKAIKTAKGQYREKVESCYSNSNIRNMWSGLKTITDYKGKSCRVGEVTASLPDELNTFYARFDKHLSQELLLEEDGRPYQISQADVCKHFRKVNTRKAPGPDNIPGRVFKACAHELADVFTDIFNLSLLQSAVPTCFKRTTIIPVPKKMNVSCLNDYRPVALTSIAMKCFERIVKAHITSLLPASLDPLQFAYRSNRSTDDAIAIALHTALSHLDQRNTYVRMLFIDYSSAFNTIVPSRLVMKLRDLNIGSSLCSWILDFLTNRPQVVRIGNITSSTLTLSTGAPQGCVLSPLLYTLFTHDCTATHSSNTIIKFADDTTIIGCISDGDESAYRAEVRALTSWCRDNNLLLNVSKTKELIVDYRRLQGGGHTPIHIEGAEVERVSCFRFLGINISEDLSWSHHVGVITKAARQRLFFLRRLRRFGMDSRILTNFYRCTIESILSGCITTWYGSCNALDRKALQRVVRSAERITRTELPAMQDLYRQRCRRKMQRILSDPSHPSHRLFTLLPSGRRYRSIQTRTSRYRDSFYPQAIRLLNC

SEQ ID NO: 1830 - DNA, 861 bp, Zea mays
  source 1..861: mol_type = unassigned DNA
gatggccctcgtctctcccgcccccgccctctcggctcccgacgcccctccccctccccagcaccagcacgcgccggttcccattccggggccggcggccaactcccttgctgccgtcgccgcagcaccctctagccctggcgcgtcggcttctatcccctccttgtctcctcccgtgtcccatgtagccagggggcgctccaagtctctaaggtggggtgacctcagtccggcctcttcggatggcgtgacgtcgctcgactcccggccttccttcaaggacgtgctggtgagaccagcgaatcctttgccgcccagccgtgtggtagtccaagagtcagccctggcagctggaacgtcctcggcgctggggaaggtgaaccatcggccgccttgctctcaccccctgtctacaaagcggcggagtcccaggcaggctccccactctacaccggctttccgcccagctccaagttttgatgatcaaggatggacaacggtggaatccaaacaaggtagaagacgccggttgagggcttcacgacgcccgagtcgagtccctgctgagcttgttggaaggtgcttcaactgcttgggctgcgatcacagggctgcggggtgtgacagtgagcctcggtgcttcctctgctcggagcttggccacaagtcttcctcctcctgccccaagaccccggtgtggaagcggctcgggcgccccaggcctgtgaagtcccggtctgggagcggctttcaccggcagttgaggggagagtccaacgagcggcaggccaccgttcggtttggcagcgtatcgctacgcccgaagctgttccgatcgccccttctgtcctggtgggaagc

SEQ ID NO: 1831 - DNA, 277 bp, Zea mays
  source 1..277: mol_type = unassigned DNA
tgagctcaggatgtggtgtagtgccggggcaaaagggttgaacctgctttcaactcttatgtttatgcttgacccagggggatagtctagtggcttgttcagagtggttgtgtgtggttgctgtgttgcgtcttttggtatgttgtgtcttgtgatgtgtgtgtcgtgtcaggtggtatgttgtgtgcggcgtgtgtgtgtgtgtgtgttgtaccttcttctatctatctattaatggaatgatacgcagatctcctgcgtgttcgagaaaaaaaaa

SEQ ID NO: 1832 - protein, 1783 aa, synthetic construct
  source 1..1783: note = Description of Artificial Sequence: Synthetic polypeptide
MLGVSAAQGNGGPASSRRKRWRKKKRLEREDEPTLEIVAPPPPVQMLPASDATACVIDWSVQMSIAEDNLKTAAVITVVCSRDISANEIVSVLAPRLEMEEGGLVLRQLSQSSFLAVLPSRVQLDTLVDSFPIIREENFMLSSRRWTRFGGAGGNSLKHLVELELRGLPVHAWETSVVQQLINPHACISQVLPDTLEVRSLEAFRCLAWCSDPERIPATKDLWITEPDQASAAEGKKALVYPVQIRWVPADLSLLTGDPPLLIGGDDQDKSDTPPSRRRCSDNPPRTQHDAINDVPGNKTHTQRRPVHDRLGPLRRSDSPRELSHPRVQIDFEARSSQPCVLSDAVADSCVGNPPTPVPDGVQCLAAGDVLLRSEEGCEDAEVIPMTPMAVSSPCPSSGGRRRLLLKTATKQAKFRNPPIAFFRRRRRAPRTPEGATLPPCSSGDRGAGSSLGALPPAPAAGVAASLLPHGSPPLVESHGSPGQQDFLRRVSKAVGAVLPLPKAVGGGRRRRQPTSLPDAIRRSRRVAGLGVEQVQHIPKARRTIMKSILAEPDSEHFSQQNLDAYAKLFQAPLSRAQVEALAALFGWVMPDDEGEVVPPGTATLVCLQPTVAYYSNCCPMDPSLILFWNVRGLNSAARQDVVRSLVDSLRVDVVCLQETKLVNCDRRTVLSMLGADFDNNFICLPSVGASGGVLITWRAKLGRIVASRVDSFSVSVKFNPADGVAWWLTCVYGPQGHDRKIAFINELRAIRAACTGPWLLGGDFNLIFRDEDKNNININRPMMGRFRRCINDLSIKDIDLLGRKYTWSGANNVQVKLDRVFCSSDWEEKFPNYLLQSSASEDSDHCPLLLGLKDNHTGKRRFHFESFWPRFDGFLEAVSNTWGSVQQSSCPLKTLSLKFKATTKGLQSWSDRKVGNFKLQLELAREILLQLEVAKESRILNVLETWLFGRLKKCSLSLASLIRSMARTRSRIAWLKDGDANTRLFHSWSRYRKRKNFIAKIQDGEQLVTSHSDKAEVLRSFYSDLIGTGQQRSRTVNLDTLEMQHTDLQGLEQPISEEEVWNTIKQLPPDKAPGPDGFTGRFYKVCWSIIKKDIMAAIMAIWNKDFRNFRYLNTAFITLLPKKEDAILAKDFRPISLIHSFAKLITKIMASRLSGYMDKLVSRNQSAFIKGRFIQDNFMLVQQTARLLHAQKQPRILLKLDISKAFDSVSWSFLLEVLEKVGFGPIWRDVISGLLMTSSTQILLNGVPGEFIQHLRGLRQGDSLSPLLFIIVMDVLNGLIVKAADEGLLQPLSTRSIQHRISLYADDVVIFLRPAASDLHLVTRILELFGDASGLKTNVQKSSVAPIHCSPVDMEMVTQIFPCKVETLPLKYLGLPLSLRKLSKEQLQPLIDRLADLLPNWKADLMTRAGRAIQVQHVLTATVIYHAMALDLPKWAIKAIDKIRRGFLWKGRKDVLGGHCLVAWGKVTRPKELGGLGISDLQKLNWALRVRWLWLEKTDPSKSWADLPLQSSSILKSILSTALITEIGDGRNTLFWRDRWLMGLRIEDLTPHIFAIVPTRITNRRTVAEGIVEMAWIRDLRGTITWDVLSDFLTLSEVIADYSINVGVPDKHIWKFSPTGQYSSKSAYDMLFLGSTSLGAYERIWESWAPSKCSFFLWLVMHNRCWTADRLARRGLPHPSVCPLCDQEEETIQHLLISCVFARQFWYSLLSRSGLPNLSPDNASCSLDDWWSRAVEKIPRDLQSGFNSLVILGAWSLWRHRNDCVFNGEIAKPGECSHPRWR

SEQ ID NO: 1833 - DNA, 1716 bp, Zea mays
  source 1..1716: mol_type = unassigned DNA
cctgcatgcttgagttctccactgctatggctcgggaggaggcggctcttcgccgggctttgttcgtctctattgttggcagcagaccggagatcagggagctgaagtgcgggatgaagtggctcgggcttttggaattgacgttaattcaatatcgattcatcagtccttgccagaagatttcctattgttgttaccggatgaaagtgctgatagagtcttcagcggaggaaaattgtttaggggccctcttttcaatcttcaattcagacggtggtcgcggttggctcatgctgaggcggctaggttgccagcactggtggaagtcgaggttcatggcatcccagcccacgcatgggatcgttctacggtggagtatctgctccgtgactcttgcattatcacagacattcatccgagcacgtcattgaagaatgatctgtcttccttcaggcttcgtgcatggtgtttgacacagatttgttccctcggccgatgaagctcctcattgttgagccggggacggatgtgcaggagaaaagatgtctttcctatgatattgaggtggctgttactgctgtgatggttccgacgaatttgactccagctcattcccctggcatggacgggaggcatgaggatggcggcgggaggcattcggaatccacgtcgggcatcgcgcccaattttccagcgtctgggcccaacgttcgtggtgcccagcgctgcggcagcgggcccggctgcaggacgaggcgcgcggtcctttggacgaggaggtggctgcagcccccctgttgctgcgggcctgtgcggcggctggcggttatggcgggagtcgaggaggtggccgcacaggaaccgagggcctcgccgtccagcgcactgctggggtgctggcggaggaggttgggccactggaatgggccagggaggtgttggcccagatgtcacggcagcagatgggtcccgggacagtttcgccccgctcactcctgtgcaacaagatgatgggcagggctgtgttggctgggtcgctgaaatcgcttgggtcgggctctccccgacagaggtttgtcgggttgcagaggctgaccaaatttcgcccccttcaatgtcggcttggtcccccggctgacctcaactcaaaatctttggttgactggcggacagaacctccctgaatgtttatgctaggaggccagctgattacagattgaaaaagcagacttcagataccgcaccggttcaatcccttcggccagatgaggtgtcggcacctctggtacctgctggtattggagaggcgacccccgttattggtggctaatatccaagaacattgactgcttgcttccgcaacctccaattcaaaaaagaagaactaaacagcttccgccagattttgtcccacgtcgcagtagtcgcttgtcaaagaaaagggaaggcttaaattcaacagtcagacaagtccaggcggagctcatttgaagttgaacgtcacaaaccaaggtggctgtgactgatgaaatgctggaggaatttggcagctgtttgacaaacccctttccaactctcacatcaaggccctggcagctttgtttggatggtcggtcccagataatgtgcaagaatgcttggtgttcctttgctagggagaagcattgagtgtgcttgctgctgtagcctcacttagtggttgtatttctgttatca

SEQ ID NO: 1834 - DNA, 2231 bp, Zea mays
  source 1..2231: mol_type = unassigned DNA
taattctccagggggactcttccaagctttatctccttaactcggcgtatgtgactctcttaccaaaaaagctgaggctgtggaggtaaaagacttcagaccgattagtttaattcacagttttgccaagattctcaccaagattctggccaataggcttgctgcaatcctccctactttggtctcccccaatcagagtgcattcatcaagggaagaagtattcatgacaattttatgatggttagagaaactgcaaaagcgattcacaggcagaaaattcctagaatcttgctgaagttagacattggcaaggccttcgactcagtttcgtggcctttcctccttgaagttctggaacatgtgggatttggtctattctggcgtaatttaattgctaagctattgtgttcctcctctactcgagtgctagttaatggggaaccaggagatctcatttgtcaccagcaaggcctgcggcagggagatcctctctccccaatgctctttatattagtaatggatgtgctgaactctctttttcagaaagcaaatgagttgggctcttgggacctttattaagaaggggagggggccagcgggtctctctttacgccgatgatgttgtattatttgttcagcctaacagaaatgagctgagtgtggtcaaggagctgttgagggtgtttggcaaggcatcagggctgattacaaacataaataagtgcagtatgacacctattcagtgcaacgagcatatcattgctgctgctcgacagatgttactctgcaatgttgttccttttccatgtaaatatctaggtcttcctctctctgttaaaaagctccctagaagatcctttctggagcttattgataaggtggcagcaaagcttcctggctggaaagctgctaatcttaacctggccggaagggcaactttggttaaagctgtgctcactgctattcccatttatcatctaattgcttcaatgtccaaggtgggtaatcaaggcaatagacaagattcgcaggggttttctttggaaaggaagaactgacattagaggaggacattgtgtcgttgggtggtccaaggtctgtcgtcccctctctcttggtgggttgggaattcacaatttggaagttatgggatggtctttaaatttgagatggctttggctccagaaaactgaaccagctaggccttgggcagattttaaaataaaggtgcacagatgcttcagctctcttcgcagcctctgtgtgttcggtggttggtaatggggcaaacactctcttctggacagataaatggcttcagggccaatctttctcagattgcccccgctctaataaatcgggtgcccgcgaatataagaggcgcagatctgtccaagccgccttaacagccaatggttgggtgcatgatatctctggaagccttacggcgcaggtgctgtttgaatttttattggtttgggatttactccaagaggtgcaactgtaccctaatgtggaggatcaacatcggtggttgccatcctcctcggggctgtattccgccagctctgcttatttgcgcttccatggtggtgcaacaacctttgagcctgctacaagaatctggaagacttgggcccccccgcgctgcaagtatttcatttggcttgcatctctcaaccgatgttggacggctgatcgactggcacgtcatggaatggatcatccagatagttgtcccttgtgtgatcagcaggatgagtcagtgcatcacttgctggtggattgtgtttttacgagggaagtttggtttacaacactaagcaggctaggtttgcaacatcttgctcccacgtctgatgctacagggtttcaagattggtggagtgaggcagaaagacaagtgtctaagcataagaaaaaaggtttcaactctattgtaattttagtagcttggcagatttggaagcatagaaatgcgtgtgtgtttgacaatgcttccccaaacattcacgcaattttgctgtccatccatgatgaggctttattatggggtcttggaggggctgctgctcttaggcaggtttggttgtagtttttttatttttggtttttttaattttttggggtgcttcctgggcacctttgtactgggtcttttctagaccctttttcttatcttcttaatatatttgatgcgtggttctcccacgtgttcgagaaaaaaaaa

SEQ ID NO: 1835 - protein, 481 aa, synthetic construct
  source 1..481: note = Description of Artificial Sequence: Synthetic polypeptide
MNLSKILIWNVRGLNRKARRDAVRMMVESTRPDIVCLQETKKESISRFMVFSLLGNVFDQFTFLPAIGTRGGILLAWKGSVCSALQTRVDEFSISVQFNQNDSLPWWFTGVYGPQSDEKKLQFLQELRMVRSVCVGPWAVGGDFNLIYRAEDKNNNNLDRAMMGRFQRIINDLQLVELPLLGRKFTWSNERSSPTLVRLDRFFYSRDWEDLFPDCLMQSSSSSISDHCPLVVGLHEFTQGKRRFHFESFWTKLEGFMTEVENSWCQPIAVGCPLQRMADKLKRLSKHLQSWSQKRVGHVKRQLVMTNEILHRLEVARDSRDLSYHEEWLRRKLKHHSLGLASLERTMARHRSGLNWLKEGDANTAYFHHHSRYRKRKNFIGKLKVEDRIVVDQQEKKHAVWNFYNNLLGVAASREFTLNLGVFHRPASNLEVLDQIFSEEEVWNTIKSIPSDKAPGPDGFTGRFYKMCLDGCQRGFLGSCQ

SEQ ID NO: 1836 - DNA, 112 bp, Zea mays
  source 1..112: mol_type = unassigned DNA
taattacgtaacctctatgtacccttcctgcggtgtctcttgggcactgcttcactctcttctttattaatagaaacgtgcacaatctcgtgccgttcgttcaaaaaaaaaa

SEQ ID NO: 1837 - protein, 711 aa, synthetic construct
  source 1..711: note = Description of Artificial Sequence: Synthetic polypeptide
MADVMAVMNSLHDQRFLNFDLLNRANIVLLPKHDGAENLSSFRPISLIHSVAKLFMKLLSMRLAPTMRDIISKCQTAFIKGRSIHDNFLFVRNMARRYHRNGTPMLLVKLDISKAFDSVRWDYLLALLAHLGFPPKWRDWVASLLATCSSQVLLNGIPGQSITHGRGLRQGDPLSPFLFVLAIDPLQRLLHLATEAGILSRVAKARTRLRIAMYADDAIIFVKPEKRELDSFATLLHQFGEATGLRTNIQKSSVVPIKCAGLNLDEILAGFPASRSQFPIKYLGIPLSVERLKKVDFQYLLDKVSSKLTCWQGRNFTFAGRLVLVKSVLSAQPVHTLTTINVPKVVLEKIDKFRKRFLWAGNENLTGGKCKVNWPTVARPLDLGGLGVLDIHRFARALRLRWLWREWEVPEAPWAGLQTPCNDTDKLLFAAATRIAIGDGAKTSFWHCAWVNGRRPKDIAPDIFAASSDCRLSVREALTDSTWVNRIDLHAIHTADHLKQFVELWSFAHSVSLVQNTEDRIDWIYNASGEYSAASAYRIQFMGHTCSNLKALIWKPWGPSKCKLFAWLIIRNRVWTSDRLAARGWPHSPSCPLCKRHPETAHHIIAGCRYSRRIWDALASWLSIGPLAPATWPDSTSIKQWWFMVGSVAVPKKGTRSLLLLVVWHIWLERNNRTFQRQERSVADLLAAIKAEARLWGVAGAKHLLALLPML

SEQ ID NO: 1838 - DNA, 294 bp, Zea mays
  source 1..294: mol_type = unassigned DNA
acaaaacatggtactgcgctacgacggagccgacgggttgcaggggcaggggtggaatttaacatgcaggatctggagaacagagccacaaaacaagtaatgcggactctgagagtcatcacagagaatgcaagcatcaaccagcaagctgttaaggattatgagaatctttttcagcatcctttaactcaaagtcatgttgaagcgttagcggctctctttggatgggagactccggggaatctcttcccgtagtgtgtttttctttctgggttgtaatttataattgttgta

SEQ ID NO: 1839 - DNA, 181 bp, Zea mays
  source 1..181: mol_type = unassigned DNA
tagctctggttttgttttcaggatctgtttgctcttgtttttgtttttttcctcttcttttttctttggtttttttatcccctccggggaggtcttttgtactatggtctattttggaccctctttttcctctacttaatataatgatgcgcagttctcctgcgctttcgagaaaaaaaaa

SEQ ID NO: 1840 - protein, 1188 aa, synthetic construct
  source 1..1188: note = Description of Artificial Sequence: Synthetic polypeptide
MDPSKIICWNVRGLNSADRQNSVRNLVLSSKADVVCLQETKMTVISTRTILAALGSDFCQFSFLPSCGASGGVLVAWKRHLGVTGLSRIDRYSISIQFCNAHNRCAWWLTCVYGPQSNSDKMLFLQELRDVRAACTGPWLIAGDFNLIYKASDKNNSNINRAMMGRFRKLVEDLSLNEVPLFGRKYTWSNQQDSPVLVKLDRVLCSVEWEDNFPNVLLQSAASEGSDHCPLLLGIRDNKLGKRRFCFEAFWPKLEGFQDVIQEVWDSVAAVNCPFMTLNLKLKATARKLQSWSGKHVGHVRTQLALAKEILHRLEIAQDCRALSLAEIWLSNLLKKHSLFLSSLQRTIARSRSRISWLKEGDANTKLFHMHSRHRKRRNFVAQLVNGDQILTNHDDKAVLVDNFYARLIGECGDREQTINLEALHLPTFNLAHLDEPVTELELWNTIKGLPNDKAPGPDGFTGRFYKSCWNIIKMDLMAVVAAVWNRKFDNFCLLNSAFITLIPKHDGAVHVKDFRPISLVHSAAKLITKLLANRLSQKLNDMVSPIQSAFIKGRFIQDNFMLVQQTARLFHQQKRPRLLLKLDITKAFDSVSWPFLIEVMKYLGFGQIWRDIICGLLSSSSTQVLLNGIPGGHIEYRRGLRQGDPLSPMLFILVMDVLGLLFSKAEHAGLLLDLSPRRPLHRVSMYADDVALFLHPSAADIAITLDILHLFGEASGLRNNEQKSNVYPIQCGGVELEMVQDLLPCGISTFPCKYLGLPLSLKNLTKVQVQPIVDRIADQLPGWKADLMTRAGRKVQVQHVLTGMLIYLAMAVNIPSWAIKAIDKIRRSFLWRGRKEARGGHCLVAWGRVCRPLQLGGLGISSLKELIWALRMRWLWLQKTEPNRPWCSLPIKVPDKARAFFSMVLTSKVGNGANTLFWTDKWIHGQKIADLVPRLFDIIPKKITNRRTVQEALTDRRWIADITGSLSVGVLLDYLHLWNLISDFELLPDIEDKHTFSIAANGTYSAKAAYDGLFIGAVQFGHYERVWKTWAPSKCHFFLWLSVLNKCWTADRLAKRGLDHPERCPLCDQESESLDHILVSCVFAREFWFRLMCIFRLQNLAPTPSTVSFTGWWEMIDNGSGDMIMKGVNSLIALGAWIIWNHRNRIVFDGISPSVSAALCQAREEQQLWEMAGAKGLSFLAATIRGT

SEQ ID NO: 1841 - DNA, 699 bp, Zea mays
  source 1..699: mol_type = unassigned DNA
ggaccctgttgatgagccagggaccgtggagcagctggcgcccagtactgaggattctatagctgtcacctctattccttccgcgaatttacctctgcttacttgggaagaggatagacttggtgctgctgtggttccagacattgtgtctaaccagggtattcctcaccctgttgagaggcataggtctgttgagccgcaggatgctgccattaatcgcagaggtggcctcccttccaaccttcaggtatattttaggcgaaagcgtcactctaagaaatgttctgcgccggatgcgcctgctgtttctttcaatgacctggagaaaatcatcaagccagtggtacagctgctgcccatgccggttgccaagattagaagcagtaagactgttgttgctgtgcctcgtcggagtaggagggtggctggtgtcaagccttgttctccaggtccgatcatcactgaagcccaaaagaaagtcatcaggagtttgggtctcgcagccacggaagaagccattgatcaaaaagctcaagacaactattttaagctgttcgaggggcgcctgacggactctcatcttgctgcacttgctgctatttttggctggcaggctgagcgatttgatgattccagcagcccagttctcctggcaggctgttaattcctgctgtccttggtcgtgtttatttgttttca

SEQ ID NO: 1842 - DNA, 199 bp, Zea mays
  source 1..199: mol_type = unassigned DNA
tagcagttttcctgctggtagtcgtttttggtcgggttgttaccttgtgtgtgtgtgtggtgcgttgtgttattgccggaggggtctcggcctaggggcctttgtaattaggggttgacaagtcttgtctctcctatgttctttttttcttcttaatataatgacacgcagctctcctgcgtttgttcaaaaaaaaaaa

SEQ ID NO: 1843 - protein, 1189 aa, synthetic construct
  source 1..1189: note = Description of Artificial Sequence: Synthetic polypeptide
MNLSNILVWNARGLNNKARRDYVRDTILSSKADIICLQETKVASFSSHLLLSVCGSDFDKFLTLPAVGTRGGILIAWKGAVCQVISSRIDNFSVSVQFAGMDGMNWWFTGVYGPQEDDRKIQFLQELLDFRTLCSGPWLLSGDFNMIYQAADKNNANLNRALMGRFRRFLDDCLLKEIPLHGRKFTWSNERSSPTLVRLDRVFCCNDWEDFFPNSLLQSASSGVSDHCPLILSLNVQTHKKRRFHFESYWPKLPGFLEAVSHSWNAPVSTACPVEGIFLKLQRLSKGLQKWSHHKVGNVKLQLATAKEILHRLEIARDNRVLSPGEEWLRKKLKLHCLGLASLERTIARLRSRILYLQEGDANTSFFHQQARYRKKKNFIAKFQVEERIVTSQEEKQQAALDFYDNLLGTAEHRDYTLDLHSLGIQQHDLGDLELVFSMEEVWSVVKDLPLDKAPGPDGFTGRFYKVCWDIIKEDMMGALLAVQCGHVSKLKLLNTAFITLLPKKVDALLVKDYRPISLVHSFAKLVTKVLAARLAPHLPSMVSINQSAFIKGRSIQDNFLLVQQLTRSLHHSKEPHILLKLDISKAFDSISWPFLLDMLQHLGFGRSWCNLISLLLCTSSTRILVNGEPGEYILHHRGLRQGDPLSPMLFILVMEALNAMVSYAFREHMLQPIANQHAKHCISFYADDVVLFMRPSHQDISAIISILDIFGHATGLKTNISKSSVTPIQCGANELTTISALLPCATKNFPCTYLGIPLSIRRLANSDLLPLVDKVADKLPGWKANLLSRAGRLVMVKTVLSSVPIYLMLALELPKWVFKAIDKRRRGFLWKGQGDANGGNCLVSWEAVQRPLKYGGLGILNLEMFGWALRARWLWLQKTDASRPWAGLPIRVHRNAKALVDVAITSVVGSGESVKFWSDRWLLGKTVAEHCPTLIQVISRRALKRRTVAEGLTNRQWVSDIRGGLSVTVLVEYLQLWNLVDGVVLQPDIADQHIWRLSAHGTYCSKSAYDALFVGSIPFGPWRRVWKTWAPLRCKFFVWLAIKNRVWTADRLAKRGLPHPVACPLCDQAEETIQHILVSCVFARQIWTSMLHNLGLLAIVPQHGCTRFSNWWCQSIKKVEKSLRKGLNSLIILVAWEIWKHRNACVFEGVVPCTQRVQSAVIEEGNVWCLAGASALQDLLLRQLPRGP

SEQ ID NO: 1844 - DNA, 272 bp, Zea mays
  source 1..272: mol_type = unassigned DNA
ccaaaaaggaacttattgattcagtttatctaaaaaacttctgtcctaatcagtttgattcttttgcttttgttccttcggtggggaactcgggggttcaattatcatctggaaaagttcaaaataacaggaaatgtcatctttcaaaatgactatgctcagtcagtggaattcatatccaatttatcgcgtgctcttggattattacaaacatttatgcaccttgtactccagggaaaatagattttctcaactggttctataacatttct

SEQ ID NO: 1845 - DNA, 354 bp, Zea mays
  source 1..354: mol_type = unassigned DNA
taacgttcctttttctatggaggtcattattctcatgacatggagcatttggaaaagtcgaaatgaatggttgtttgaaaacaaagacccttcagtgcatcactgtacgaatgaattcagtaaggaactacggttggttattcacagagcgcgagggaaatacgacatctccattccaagctggttggatcagtggcagtcataagatttgttttgctctgaccaatctttgtaacttttcaattagatcttaccagctaacctctaactcttgtaatcaagtcgagttgtaccttttcatatttaataaaattttacagtaggggtttcccctcctgatctttcaaaaaaaaa

SEQ ID NO: 1846 - protein, 997 aa, synthetic construct
  source 1..997: note = Description of Artificial Sequence: Synthetic polypeptide
MPSDKLWLLVGDFNLIRRPEDRNKAGGDINLMLKFNEAISNLDLVEIPLHGLSYTWSNRQREPLLQRLDWFFISQEWSIVYPDTCAKTMPRDISDHVPCLVSFKSKIPKPKIFRFENFWLEFEGFMNIFQTTWLGLPCLPDKAKNLTAKFKIVRKVLKDWQRSLPKIDKTVRDIKLLIEFIDNIEEHRDLSIEEWNFRDIMQQKVAELLNIQKIYWKQRASIKWITEGDICSRFFHAHATVKHRRNTIASLTDENGIIHFEHDHKSNLLWEAFKSRLGSSDFLGIDFDLSELLIRNEDLQGLDSPFTKQEIDNIIKSLPSDKSPGPDGFNTNFIKKCWHIIAQDFYDLCEKFYQEEVCLRSINGSFIVLIPKKENPQKVGDYRPISLLNNNMKILTKLLANRLQSFMTRLVHRNQYGFIKGRTIQDCLAWAYEYIHLCHSSKKEIIVLKLDFEKAFDTLEHELIMQVMTHKGFGSKWINWVRNILHSGTSSVLLNGVPGKSFHCKRGVRQGDPLSPLLFVLAADLLQSIINKARHLNLLQLPLPDICEQDFPIVQYADDTLLIMEACPKQLFFLKAILNSFASSTGLRVNYNKSNMYPINVNPEKMEILSRTLNCQIGAMSFTYLGLPLGLAKPRIQQFLPLIQRIEKRLSCSSNFLSQAGRLELVNSVFSALPTFFMCTLKIPKSIIKQIDIYRKHCLWRGNDTSSKKPPLVAWSTVTQRKVNGGLGVLRLETQNDALLLKFFHKFFNSYDLPWVNIIWNKYYTPNRLPGHRRIGSFWWKSMLKLLHNFKGLAHPIIGNGRSILFWEDQWNKSIPRQQYPELFSFTKSTKLSIAEVKEQDHLFRIFQLPISEQAYEQYLELQVVWEQIVLSNVKDRWRYIWDSDSYSTQKAYRHLMGQTQVHSIYKCLWKSKCQPKHKVFYWLWLKNRLNTRNMLRRKNMTLESYSCENCLWQREETLYHLFLRCNFAKACWNSIGIPPTQNCSSRGGLGKPQTTT

SEQ ID NO: 1847 - DNA, 2585 bp, Zea mays
  source 1..2585: mol_type = unassigned DNA
ggcggtcatttcggcggaccgttcggctccccgccctcccgccttccctgcatgcccttccgcctcccccgcccatcgctccgttaacggcgcccgccccaccctccccgcaccacctagcccctcgccggcgctcaccccgactccggcgaccacttcctcctccccctcccgtgtggcgactttgtctcccgcggcttgtccgttctcccccgctgggcgttccaaggcgcagcggtgggcgtcttcctgcctcaccagcccgtcctcatcggccttgggcgttggtgccgttggaagcggtgcctcgcagaggactttcaaggacgtgctgctgctccctccgcccctgccgtctgcccggcagtccctcctcgacctccgcacagaccgaagtttgcggtggtgcaacgtccctggaacggtgcgcaggcctgttcctgaccgggagggctgggttagggtcgaacctcgtcgacgtcaactccccccttcgccacctccccgtcgatcgatccctgaggatctccgggtaggtgttttaactgtctggcctcctctcatcgggcggcggattgccgacgttcggtgcgctgcttcaagtgttgggggttcggacatcgtgcagttcagtgcaaggttcgtgctgcgcaggtgatcaaagcttcagttcggtgtgggatcgtcttggccctaagctggttcacaagcctttggactctcctagacgcgccatggagtggcgcagggtctcttcgccgatcccggccatccagaggtccggtgtggctgatcctaccttgggtggcacgaagaaacgccgccatcgtacgcggggtcgaaggcctaagaccgcccccgttgcacctttggaggaatccagtgaagttgcacctccacccggttcctcttccctagagccggtcagggtgcatgcccctcaaccggttgttcctgatatggtggaagccacacatctctgcattttggaccgtgcggatgcgcttgctagagaagaactgcggttgcgacggtgtgctctgttcgttgttgtcactggttcaagaccgagggtggctgctgagactcttgctgatgaggtggctgctggtttcgggctggatgcgtcgtccttctccgttcatcgttcgtgcccagaagattttgtcttaatcctgaattcggaagagttggccaatcaggtgtacaacaatggtgctgttttcaattctctttctgggtctttcaagttcctgagatggtctagacttgcccatgccgaggtggtggcctttccatctcctgttcttgtggagttcaaagggattccaattcatgcttgggatttggctactgctcagaatttgttgagggatcactgcactgatgtggagctccatcctgacacggtgaatcgacacgacttctcttccttcaaggtttttggatggtgccgacgtccacacctcattccaaatttggtggagctccttgttccggaaccgttgatgatgacgcctggctctacctctcttgagagaagattgctcgcttaccaagtgactgcccttgtgtctctgatctctccgccggtgcatagcgctgctgcacctccgtcgccggcgtttgatgatgatcaggacaacgggcctcgtcggcgcaggctcaacagttcagttcagatggggcatgctgagtccggggaagcacttgcagcgcgaaggcccgtccgtgaaaggctgggtgttgccccggtctctgttcgacatgtggaggctggattgtccgtgaaagactcggcgccttccgttgccttggttactggggacacgcatactgatgttgtggagccggtgattggctgcatggatgctgggttgagtctgcccctggagaatgttcatgggcctggcactgagactttggagattccaggtgcttgcgatggcccgggtggtgaagtcttcttgtccatgactgatgttgactcttctgttccggcggtggaaactttgagtgcattttcatccctcccgagtggccctgccatcgctacccgtgtggggactgtgttgaagccgtccatgaaggctgttggggcagggctcaggaggtggccgtgttccccaatcaaatatttcagaaggaagtgcagaggggctgctgcttcacaatcccctctctcggctgctcagtctgcgaccactgctgatttcatcgctagagtgtccaggccggccgctcgggtcctgtgtgggccgcagaagcggcagcgtcgccccagggcaccttgtgagggggctctacctcggcggagcaggcgcttggctggagcagatgttgaaaaggtaatggccccagcacaagtttcgaaaggaaaatggaggattgctaatgagctcggccttcttggtggggatccatctgaatcgctgtccctggaggttctcgataactatgccaaggttttcggtgagcggctgactgatctgcaagttaaagctcttgcggctctcttcaactggactgtcccagaagacttgcagggtgcagtggtgcaggcctgatcgcctctgtgtgtattg

SEQ ID NO: 1848 - DNA, 1528 bp, Zea mays
  source 1..1528: mol_type = unassigned DNA
taatgtttttcctatccgatgttctgaggcggatcttgcttgtgttcaggagctccttccatgttccatttcggaatttccctgtcagtaccttggcctcccgctttctcttggaaagcttaagagaagtcaaattcaagcaattgtcgataaaactgcagcacagttacctgggtggaaagctgatctgatgacaaaggctggtagagccatttatgttcaatttgtgatgacatcaagaatgatttatgctgctctggcgttggacatcccttcttgggcttttaaagcaattgataagcttagacgaggctttctgtggagagggaggaaggaggtgaatggtggccattgtctgctgacttggcccaaagtcactagacccaaggacctggggggtctgggtattagtgatcttcggatcatgagctgggcactgcgggctaggtggccttggctgcaaaaatctgataggactaagccatggtcggacttccagattcaaacttgcgacattgtgcaaagcttgttggctgcggctgttatcactcatttgggagatgggtctgatactctgttttggaaggatcgttggctgaatggcaaatgtattaaggaggtggcacctgctgtcttcggtatggtgcccaagcgtattgcttctagacgcctggtcaaggatgccttgcctgatctcaattggttggctgatctgagaggggctatttctgttacagcccttgctaatctcatggacctttgtgacttactcgaggggatggttctgcagccggatgttcctgatgtgcatacctggaggttcagtgaatcgggtgaatactcggctagttcagcttacagggctttgcttcttggctctgttagctttgagcctgctgaacgcatttggaaatcctgggctccaggaaagtgtaaattcttcctctggcttgtggagcacgatagatgttggacggctgacagacttgctaagcgtggcctggatcacccagagtcctgccctttatgcgaccagatggaagaaactatcaaccatttgctggttcagtgcagttttgcaaaacagttttggttcagccttctgcggtcgggtggtttccaggagctctgcccttcccatgatgacgtctgttttgaaacctggtggaggaatagtgctgccagggtgggcatgcctttatccaagggattcaattctcttgtcattttgggtgcatggactttgtggaagcatagaaataggtgtgtttttgataactgtaaccctagcgctgcggtggtgttggcagctgcaagggaggagttgatgggttggcgtatggctggagccaaagcgctctctttctttcatttagaagaggtgtcttaggtgtcttagttgtttggggagtgttttttggttttggtttgccaaatgtaacacctttgtactggggttttttctccccattttattcttcttcttaatacaaaaatacgcagctctcctgcgtattcaagaaaaaaa

SEQ ID NO: 1849 - protein, 733 aa, synthetic construct
  source 1..733: note = Description of Artificial Sequence: Synthetic polypeptide
MVVFSMFFQMDPSKIVCWNVRGLNGSARQDVVRCLVDSVKADVVCLQETKMSVFSRLFVFRLLGSEFQNFVFTPSVGASGGILVAWKNNISSCGSRIDDHCVSVNFSLETGSSWWLSCVYAPQGNHEKIQFLQDLRLIRTHCSGPWLVVGDFNMILCDEDKSNSNVDRAMMGRFRRWKDDLALLELPLIGRRFTWSNGHACPTLVRLDRMFCTADWEDLFPDCLLQSAATQDSDHCPLLLGLCDINKRKGRFHFQAFWVKLEDFQDVVANAWSSIPAGQCPLVSLSKKLQATAKALQRWSDNKVGDLKLQLEMARELLHRLEMAHDSRTLSPSEDWLRRTLKKHILVLSSLSRSIARLRSRINWLKEGDAHTSLFHAQARIRKKKNFIGSLSTSEGLILTSHEDKADELFHFYDALLGTALGRENSLNLDALEMPSFNLNELDVPFSEEEVWGTVKSMPSDKAPGPDGFTGRFYKVCWVTIKADVMAAISCVWARKFRNMGLLNSAFITLLPKVEGATQVKDFRPISLVHSFAKLVTKMMANRLARHLNDMVSPNQTAFIKKRFILDNFMLVQHTARFLHRQRQARILFKLDISKAFDSVSWAFLLEVLQKLGFGQIWRDIICGLLASSSTRILLNGVPGDYIAHQRGLRQGDPLSPMLFILVMDTLNLLIQRASDEGLLHSLSTNSLQHRFSLYADDAVVFLKPAAFRHKSDSGNPSDFWGCVRSKDQRSEE

SEQ ID NO: 1850 - DNA, 947 bp, Salmo salar
  source 1..947: mol_type = unassigned DNA
tacattacaacggcttgatttgtttgatctgagcaattcttcttagctagctacatagccgtctttgtatcaaagataattgtgtagtttagagtaattagagtaattatcgaggctagctatcttcgtcctcctaacgtagtcaacaccgctgctagctagctagtcatcactgctagctagccaacttctaccgactagcagcactgtagaaactattacattacaacgtaacgacttgattagtgtggtgttagtgttagttagccagctacatagttgtctttgctgtctctgtatctaagataattgtgtagtttagagtaattatcgaggtgagctagccagccgcgacgcggcgccagacttagtcaacacacctagtcatcattaacccactgctagctagccaaccgttaccgactagcagcgctgtagatactaatactttacaacggaacgatttgactagtgcagtgttagctagctagctactagttgtctttgtcatagcttgataattgtgtagtttagagtaattatcgaggttagctagccagctatttccgtcccccgcgacgccatttttcctaacccagccaactattaccgacgagcagcattgtagaaactaaatacattacaaaggaacgtcttgattagtgttatgttagctagctagctacaaagttgctttgtatcatgacaaggtgtagtactgaaactatcgaggttacctagccagctacacgttcaaacaaagtcaacaacgcagccactgctagctagcctactccaccagccagcagtactgtatcattttcgtcattttagtcaataagatttttgcaacgtaagcttaactttctgaacattcgagacgtgtagtccacttgtcattccaatctcctttgcattagcgtagcctcttctgtagcttgtctact

SEQ ID NO: 1851 - DNA, 154 bp, Salmo salar
  source 1..154: mol_type = unassigned DNA
taggataaagtaatccttctaaccccccccccccttaaaagatttagatgcactattgtaaagtggttgttccactggatattataaggtgaatgcaccaatttgtaagtcgctctggataagagcgtctgctaaatgacttaaatgtaaatgt

SEQ ID NO: 1852 - protein, 979 aa, synthetic construct
  source 1..979: note = Description of Artificial Sequence: Synthetic polypeptide
MCLSIPVLSPLHRPYKRSTPRGRCHSNLVVPARTTHVEFQVSGSLWNCRSAANKAEFISAYATLQSLDFLALTETWITTDNTATPTALSSSAYVFSHTPRASSQRGGGTGILISPKWTFSLSPLTHLSISSFEFHAVTVTSPFKLNILIIYRPPGSLGEFINELDALISSFPEDGSPLTVLGDFNLPTSTFDSFLSASFFPLLSSFDLTLSPSPPTHKAGNTLDLIFTRCCSSTNLIATPLQVSDHYLVSFSLSLSSNTSHSAPTRMVLRRPNLRSLSPATLSSSILSSLPSAQTFSNLSPDSASSTLLSSLSASFDFLCPLSSRPARSSPPAPWLDDSLRAHRTGLRAAERKWRKTRLPADLASFHSLLSTFSSSVSAAKATFYHSKLQASASNPRKLFATFSSLLNPPPPPPPSSLSADDFVNHFEKKVDDIRSSFAKSNDTAGPAHTALPCALTSFSPLSPDEISRLVTAGRPTTCPLDPIPSSLLQTISGDLLPYLTSLINSSLTAGYVPSVFKRARVAPLLKKPTLDPSDVNNYRPVSLLSFLSKTLERAVLGQLSCYLSQNDLLDPNQSGFKTGHSTETALLCVTEALRTAKANSLSSALILLDLSAAFDTVNHQILLSTLSELGISGAAHAWIASYLTGRSYQVAWRESVSAPRALTTGVPQGSVLGPLLFSLYTKSLGSVISSHGLSYHCYADDTQLIFSFPPSDNQVANRISACLADISVWMTDHHLKLNLGKTELLFLPGKDCPFHDLAITVDNSLVSSSQSAKSLGVTLDNTLSFSTNIKAVTRSCRFMLYNIRRVRPCLTQEAAQVLIQALVISRLDYCNSLLAGLPACAIKPLQLIQNAAARLVFNLPKFSHVTPLLRSLHWLPVEARIRYKTMVLAYGAVRGTAPPYLQALIRPYTQTRALRSSTSGLLASLPLRKHSSRSAQSKLFAALAPQWWNKLPHDARTAESITTFRRHLKPHLFKEYLG

SEQ ID NO: 1853 - DNA, 137 bp, unidentified
  source 1..137: mol_type = unassigned DNA; note = Description of Unknown:Mesobuthus martensii sequence
taacccctcctgaatcctgctaagctgcctcaaagtggcggaggggtgtacgtgggcggaataggcgatgcaagtcagaaattattttctagtagggtcaccctgggctagaaggctattccattatgctcaactaa

SEQ ID NO: 1854 - DNA, 121 bp, unidentified
  source 1..121: mol_type = unassigned DNA; note = Description of Unknown:Mesobuthus martensii sequence
taactcacaattaaacatcacaagtagctatgtcttgactcttgtccgacatagcactttgccccggagttattccgtgctcacattgatgtaccataatataataataataataaataca

SEQ ID NO: 1855 - protein, 1230 aa, synthetic construct
  source 1..1230: note = Description of Artificial Sequence: Synthetic polypeptide
MLAGVPTLVVFFQYAMAQSRKRKHTGSDVSRVNKVRVCELGRGSHSESLLQSPLATGGESSTNPSLATAIQIPRVGNGSPHQSPTSQSVSLETQPETTKAGKPRQRMKWTTDMNEFIMRTYYTITKLETDITGYRRELYDKFTSRYPNITVTEQRIADQRRTIIHRNLIPHSTLESIKTQVAQQISQHETDSHTQIEHDVEQTPEITYIDDNTQPINNTDTDLINKLTDTLQETLTKFTGTDPTQRPRIPKLHNSQQLNNTLHCMNTHILPKLINAETTLIEIHTLIYAAAVTVTTHLGLKTLPNKIGTNTKHHLKPAWQKRLEKQINEIRTELGRLTQYTKNNTSTKLMKSIRKIFRKLKTHTRHENHNTHIKEYIDTLKQKLAAKSQRLKRYKTSLARKLDNTLFTNNEKTFYRNINTKDPKQTQNREIPTQQSLTSFWSALWAVPVTHNQRASWIAEEETRTLDVPEMPYTTITTEELTNTIRYTHNWKAPGVDGIQNFWYKHFTCLHDLLAKHLTHLIHEPKDTPSFLTHGITFMKPKSTNTGNPSQYRPITCLPTLYKILTSCITNKIYAHIEENNILTEQQKGCRRSHMGCKEQLIIDTTILKQVHRQHRHLHAAYIDYKKAFDSIPHSWLIQTLQLYKINTKYITFLQNIMQHWRTTLHITINNNHVATEPIHIRRGIFQGDSLSPLWFCLALNPLSNKLNTSNCGYDIRQNQTTHYIHSHLFYMDDIKLYASTQTQLQQLLQITHTFSKDICMEFGLDKCKTLHIEKGVLKKGGFTLENGDTIESMEEGEVYKYLGFQQARLTEQKKTKQTLSKLYTNRLNNILKTHLNGKNTVKAINTFAIPILTYSFGVIQWTRTELESLQRKTRTTLTKYQYHHPKSAIERTTLPRKEGGRGLIDIPHLHDRQIYNLREFFHKKQHTSQLHKAIVLADRNITPLNLQNNTPCQIDNTAHIQEKKTSWCKKELHGRHPHDLQKHFIDAKASNSWLVRGDLFTETEGFIIAIQDQVINTKNYRKYILKDSTLTNDTCRKCHIAPETIQHITSGCKLLAQTDYLHRHNQVANIIHQKLATKHKLINTLTPYYKYIPDTILENSTHKMYYDRTILTDKTIHHNRPDITLIDKQNKVTYIIDISIPDTHNIQDAFTQKISKYTELSQEIKRLWGMQKVVTVPIILSSTGVIPHTLHKSLKTLDLHPKTYITLQKASLLNTCNIVRKFLSTDTDS

SEQ ID NO: 1856 - DNA, 147 bp, Schistosoma mansoni
  source 1..147: mol_type = unassigned DNA
tgatttaccaaattctttttttccctctattatcgttcatatacctaggttcttgcctggaggtattggtgatccactgctaccagacacggaagcccgttaagcgaaagcttcttctattccgtcctcaaccatttgaaccatttg

SEQ ID NO: 1857 - protein, 731 aa, synthetic construct
  source 1..731: note = Description of Artificial Sequence: Synthetic polypeptide
MEFLVDDLSILAPLGKSDHAVLSFSFVSKTELRYPTSNKRWNFKRLNVLALQDYLQQVDWDVHPQLEVDAHWDFLLHTILCATEHSVPKMVPKSYKQPPIIKNRTRRLLSRKRHCWAEYKRTDNNGAYRQYKHIRNICTKAIREDRLQFQTKLIDKFVSNPKSLFSYAASLRQGKTGVSQLLGPNGPTNNDSDAANLLAEQYSRTFQLTHINHTDESFTCTCTGLSEVDLSADLVLRKLQHLRKDTSPGPDMVHSAVLREAASILATPLSVMFAHSLSRGKLPEIWKLAHITPIFKGGRRSEPSSYRPVALLSIPSKIMESLVYDGILEYLSSSKFFSPQQHGFRKGHSCMTNLLTAVDRWTTILDRKGKVDVIYLDFSKAFDRVNHACLIKKLGRLGIKPPLIDWLSSYLENRHFKVRVNFTLSQAMECPSGVPQGSILGPLLFLIYINDLPQQVSSDLLLFADDVKLWREIRNHNDILVLQEDLTRLQSWADDNGLTFNTSKCKVVHLRHVADYSYNLGNSPLEVSQVEKDLGVLVPYDLKSYANCDKNASQANLALVTLKRIFGQFDGRTFHIIFNSFIRPHLEYGNIVFPPSLQKDKDTLERIQRRATKSVRGLKFKPYEERLKSLNLYPLEYRRLRGDLLMTYSILNTSGHPLKHLLKLSHNTNLRGNTQKLETLHSRTDCRHNFYSVRVVKCWNSLPTELVQATSQESFKRKLDLFLRTKDNILL

SEQ ID NO: 1858 - DNA, 997 bp, Anolis carolinensis
  source 1..997: mol_type = unassigned DNA
ttgatcccagaagggcagttggttctcgcagaagcagaggcagcaggaggacatttttgctccctggcttcaggtaggatttggctaagatttggctaagattttaaactgagtgtgggcttggctcctgtggtcaaagtctaactgttgtgtgactgttgtgttgaaagagagccaggtacttaagttgattgacagcaggcattgtcccctgttaattgagtttctgggaaagctttatttgccagtgtgagtttctgccagagcctgatcccagaagggcagttggttctcgcagaagcagaggcagcaggaggacatttttgctccctggcttcaggtaggatttggctaagatttggctaagattttaaactgagtgtgggcttggctcctgtggtcaaagtctaactgttgtgtgactgttgtgttgaaagagagccaggtacttaagttgattgacagcaggcattgtcccctgttaattgagtttctgggaaagctttatttgccagtgtgagtttctgccagagcctgatcccagaagggcagttggttctcgcagaagcagaggcagcaggaggacatttttgctccctggcttcaggtaggatttggctaagatttggctaagattttaaactgagtgtgggcttggctcctgtggtcaaagtctaactgttgtgtgactgttgtgttgaaagagagccaggtacttaagttgattgacagcaggcattgtcccctgttaattgagtttctgggaaagctttatttgccagtgtgagtttctgccagagcctgatcccagaagggcagttggttctcgcagaggcagcaggaggcacctttactaactatcctttgcagtacatacaggaaacaaagcaacataaacaaatacacaaagaggtggtttgttgcagtttgcacataaagtgcgtgcatattacttaactgtacaaagatcccacttggccaccacgctcaccaagag

SEQ ID NO: 1859 - DNA, 102 bp, Anolis carolinensis
  source 1..102: mol_type = unassigned DNA
tgaatgcgatttcctgcttcttagcagggggttggactagatggcccatgtggtctcttccaactctactattctatgattctatgattctatgattctatg

SEQ ID NO: 1860 - protein, 1449 aa, synthetic construct
  source 1..1449: note = Description of Artificial Sequence: Synthetic polypeptide
MQQKQNIPITCTSCGMFRFFTQKLDNYICSKCKQMTLMEQRIQQLEHRIKTLKDIQALELFLDTAQHAAVDQQPASHQHHQDHDQEPYGEINSKVDNPQAWKEVTHRRRRRTRQPPQNSSAQLHLHNRFEILTSLTYNQETHLVEDHSFLDTTQWTTLDQCAGDSPDGDSASPQSHLCNHANAPSPIIDQEQQEHPLGETRSNRNIPWESNGLSDVSQWIVIDECTGDVEEEDNTLHLHDSLQQEHSSGDIHTVLHKRDPVNPQRKQVLVVGDSLLRGTEAIISRPDGMARETCCLPGAKIHHITQRLSRLLKPHHPPHLMLIHVGTNDTARHTFQKITNDFRALGTKLKLYNVHVIFSSLLPVVGHGSTRAGKIVQVNNWLRKWCQEEHFGFLDHGLLFQEDGLLASDGVHLTQVGKHLFAHRLTNLIRRTLNPWSTLPRGWTTGKRWGASHTSRKTSFCTQTHKPHQAHFKLDPLGEGNNSLANTILPTTTGNRRKAKRRAAQTQQGPSTESTIIPNKQFEGRSQGLTCLYTNAQSMGNKQDELQLLAQHHTYDVIGITETWWDDSHHWNLTIEGYNLFHRNRTKGRGGGVALYVKNSYVAEEMQDCNPGNQLESIWIRIKGTGTQKDLVVGVYYRPPSQDEGLDEAFCQQLTKQAQRRDIVVMGDFNYPDICWKTNSAKSTKSNKFLTCLADNFMVQKVEEATRGSATLDLILTNVEDLINTVEVVGSLGASDHVLLQFAIQRNAETKTSQTRILDFKRADFQKMKELLSGIPWTPILKNKGVKDGWEFFKSEILKAQMQTVPTKKKNKTSAKKPEWMSKELLTELKLKSDMHKKWKRGEITKEEFKRIANTCREKVRKAKAQNELRLARDIKNNKKGFFAYVGRKRKKKEAIGPLQGEDGVMATGDREKAELLNAFFASVFSEKESHLQPQQHGMDEGLGEIQPQIGKQVVQEHLASLNEFKSPGPDQLHPRVLKELAEVISEPLAIIFESSWRTGEVPADWRRANVVPIFKKGKKNDPNNYRPVSLTSIPGKILEKIIKEVVCEHLETNAVIANSQHGFTKNKSCQTNLISFFDRVTSWVDTGNAVDVAYLDFSKAFDKVPHDLLANKLVKCGLDKTTVRWICNWLSERTQRVLTNASSSSWKEVTSGVPQGSVLGPVLFNIFINDLDEGLEGTIIKFADDTKLGGIANTPEDRSRIQNDLDRLERWAKTNKMKFNRDKCKILHFGRKNGNQRYRMGDAWLDSSVCEKDLGVLVDNKLNMSQQCDAAAKKANGILACINRGIASRSREVMLPLYSALVRPHLEYCVQFWAPQLKGDVDKLESVQRRATKMIKGLENKPYEERLKELGMFSLQKRRLRGDMIAMYKYVKGSHREEGASLFSAALQTRTRNNGFKLQERRFHLNIRKNFLTVRAVRQWNSLPGAVVEAPSLEAFKQRLDGHLSGVL

SEQ ID NO: 1861 - DNA, 53 bp, Pelodiscus sinensis
  source 1..53: mol_type = unassigned DNA
agaaactcgcacagatacagacagacatcatctttctatccaagtgcaagaaa

SEQ ID NO: 1862 - DNA, 388 bp, Pelodiscus sinensis
  source 1..388: mol_type = unassigned DNA
taacaagtctttgaactttctcacccattatcaagacagtttccccaattatcacctgtaataccattaactcacaaacatcccactctccctacctctaatatcatcaattcacagacacttaccttccttcctcccccttcccacccccccgcctcctccttctgttctgcaatgtgatttgtccttttcatatttgttcattttttttaattgtatcctttggtatatatggttgtgactactttcttccactatttgatctgaggaagtgggtctggcccacgaaagctcatcatctaataaaccatcttgttagtctttaaagtgctacattgtcctgcattttgcttcaactaccccagactaacacggctacatttctatc

SEQ ID NO: 1863 - protein, 832 aa, synthetic construct
  source 1..832: note = Description of Artificial Sequence: Synthetic polypeptide
MDIVPKGLKVNNPLRSTYFTDYSERLCLTLSKKLRNHLISILYKKQKTIKNDISNLDRLISRQTSTPTDTLQDFCSTRQEIYYTHFYSLQQRKDNKFSNLLHTTGYNSNCLNPPDNIVNLSSYKLNPAEESVLSRGLSFCPTSPTNWIQFCGDLEAFFRRLRLREYFQTTTEHQSDLPDPPYQHQRKNNSIWTPPDGRNYNLDFYIHSFRNNAQTDIIRKRQQATHNLSRAEHHAIQSLKNNLDIVIKPADKGGAVVIMNKADYNQEATRQLSNTTFYKPLPSDPTLDYQKKLHCLLKSLPTATREQILTESPSDPRPGLFYLLPKIHKPGHPGRPIISGIGTLTTGLSSYVDTLLKPFVTNTPSYLRDTTDFLRKLQNIDNLPNNTILATMDVEALYTNIPHEDGLQAIRNTIPEDTTANLIADLCNFVLTHNYFRFENNLYLQISGTAMGTRMAPQYANIFMADLEQRFLNSRPLSPLLYLRYIDDIFMIWTHGQETLEIFHRDFNNLHPTINLSLDHSTREIHFLDTTVQINNGKLDTTLYRKPTDSYSYLHASSSHPEHTTRSIVYSQALRYNRICSNPTDRDQKLQDLYQAFINLNYPPRETKKQIERARRIPRNHLLQDRPKKTNNRTPLVITYNPQLKPVQHIINKLQPILEQDTILKEALGDRPIVSYRQPPNLKMILTNHHRTYHTNTNPGTFPCNKPRCQLCPHIHSADTIIGPNQVSYKIKNTYSCASRNIIYAIMCRKCPSAMYIGQTSQTLRQRINAHKTDIRQDHKEKTVSCHFNQKGHSLNDLATCILLQRPFTSALERESSELSFMLKFDTYQPGT

SEQ ID NO: 1864 - DNA, 56 bp, Xiphophorus maculatus
  source 1..56: mol_type = unassigned DNA
taagcggaagaagatggatggatggatggatggatggatggatggatggatggatg

SEQ ID NO: 1865 - protein, 723 aa, synthetic construct
  source 1..723: note = Description of Artificial Sequence: Synthetic polypeptide
MTLGRSSMIDFVIVSSDLRPYVLDTRVKRGAELSTDHYLVVSWLRRWGTWSLSGPCSVPPLSRRPIGAVAARLSVPVAAATLEPAGGHLLVRDAVRLKKESYRAFLACGTPEAADGYRRAKRHAARAVAEAKTRAWEEFGEAMEKDFRTASRRFWSTIRRLRGGKRCSTNTVYSGDGVLLTSTRDVVGRWAEYFEDLLNPTNMPSTEEAEPGDSGLGSPISGDEVAEVVKKLLGGKAPGVDEIRPEFLKALDVVGLCWLTRLCNIAWTSGAVPLDWQTGVVVPLFKKGDRRVCSNYRGVTLLSLPGKVYSGVLERRVRRIVEPRIQEEQCGFRPGRGTLDQLYTLGRVLEGAWEFAQPVYMCFVDLEKAFDRVPRGALWGVLREYGVPGPLIRAVRSLYDRCQSLVRIAGSKSGSFPVRVGLRQGCPLSPILFITFMDRISRRSQGVEGIRFGGLRISSLLFADDVVLLASSDRDLQLSLERFAAECEAAGMGISASKSEAMVLSRKRVECLLRVRGGVLPQVEEFKYLGILFTNGGRREREIDRRIGAASAVKRALYRSVVVKRELSQKAKLSIYRSIYVPTLIYGHELWVMTERTRSRIQAAEMGFLRRVAGLSLRDRVRSSVIREGLRVEPLLLHIERSQLRWLGHLVRMPPGRLPGEVFRARPTGRRPRGRPRTRWRDYVSRLAWERLGIPPEELEEVAGEREVWASLLKLLPPRPDLG

SEQ ID NO: 1866 - DNA, 120 bp, Ixodes scapularis
  source 1..120: mol_type = unassigned DNA
tctattgattgcttagtcatatctgaaacgaacataaaggactgcgacgaagcattattccaaaataaaagttttgaaacgattacaaataacaggaagaacaagcgaggaggtggaatc

SEQ ID NO: 1867 - DNA, 142 bp, Ixodes scapularis
  source 1..142: mol_type = unassigned DNA
tgaacaagtgtaaaaaaagggtttgttataagtgactagagctctgtcgctgccctacgcacaagccgcttaggcttatgtggggtatgaatctctgtaaaattgtatgtggaaaagatgaaataaagattattattattat

SEQ ID NO: 1868 - protein, 908 aa, synthetic construct
  source 1..908: note = Description of Artificial Sequence: Synthetic polypeptide
MVMVNKKWNIKNSKKITFSRAEAVQIDIENEKEQIQILAVYRAPQGNIAEFIDDIDNWIKVENSKNLIITGDINIDITKQSNLVDKYLNCLAEHGLQSMIKDITREEILGLQLTRSCIDHICIRSKKYCKAHVIAEKLADHYFVGIAIPELGIPESERDQVTTYINNAKVDKYVREINWESIANEEDPEIIYNKIKNAFTDIYKKSSEQVTVKKRKTGNQWVTKEIDQLIRKKNKAWRLLKSSPESSQRKEEYRSIRNKVTSIIKKEKRNYFWKKFEDTKDPSQCWSVINQVLGRNTRLSIDQTIKKNFGTYCNDEKIANDFNNEFIQSIELLCNHGYQNETETRARIGNSMYLPEMTEEDLVEIVSNMKTNKAVGIDSIRPRDIKENVNIIKTVLLALYNKSLAIGKVPSGLKTAVVRPIYKKGDKKTLLNYRPVCILPVLNYIMEKYVHKALNGFINKYNLLTKTQYGFKTNSSTITLLEDFSDFVNKKLDEGNYVLALFIDFSRAFETVRHETLIDRLFSLGVRGKLLDWFKDYLSGRTQVVKIASSFSEKRLVKQGVPQGTVLGPILFNIYINDIVNVHLNSVLFQFADDTVILYADKDYTTAENKIQEDVYKLVKWYKENQIIINTKKTELMCFRSPQRRTQMEGNIKIHSDSCKNCNCEPLKLTTSVKYLGLYIDEHLKWNQHVEHICKRLRSVAAQLYHLRSCLPQPILKMIYHSLGKSVLVYGITIYGHCAKYLQDKINSILNKVVKNLYVDENRPLHYMYQHLDIQKLSDLLELNIIIQHQFSDKYKTKYIPIRNLRPKNLFQEPKVKTKYGKAVRASYVPRVFNKLPPRIIEITKISELKRELKQWFINRKELQLAEEKSTRGWNLNCVVLCVLFCRELWSKGVYMSCFHFFFLFARN

SEQ ID NO: 1869 - DNA, 281 bp, Petromyzon marinus
  source 1..281: mol_type = unassigned DNA
gcctgtgcgtgtgtgtgtgtgtgtggcaaaacaaccccctacctcctcgcggtgccggacgggcaactctgtcgtggacagtgctgtggggggaggtccaattttgattggctcctcccctcatggcatatgtgtccaccacaggggctaaacgggggctctggacgggtgcgaggggctggtaacccctccaccttcaattaattaccacgaaaccacgaattaaactgaaatatgtaactaataagcttgtgccggaggccccggggggccaggcgtct

SEQ ID NO: 1870 - protein, 1108 aa, synthetic construct
  source 1..1108: note = Description of Artificial Sequence: Synthetic polypeptide
MTSPGQTPIGGARRLNLYPRGSSRNNEKPLRVATWNVRTLTAEERLPLLCRELDRYRLDLCGIQEVRWTGSGSCHHEGWTVLYSGQQTAKQQGVALLLNKRMKGAWERGGEVWEAVSPRLLWARLPINRRRGMVVVVTYAPTEDEHPWRDAGKADESDAFYDLLSQVLAKVAPRDRVIMLGDFNARVGHDAGTWSGVIGGHGPDQLNNNGRRLLDFCAAHGLVITNTLFRHRRIHTTSWMHAGSKQEHLLDYIVTDQRMRAHVLDTRTYRGADLPSDHRLVICKMRLPFFHSGGGCTPRTPFQPKVAWSQLSDESCKREFHHRLRLGLASSPTPPDVEGKWARFRTVTHAAAMAALGTRSRPPQRPWLTEEVFRMVEKKRQAHCHRLQNPTSENEEAYRSLRSEVRRAVRRCKDGWWSRVAEEMESASVARDHKSLFNSIKKVTCSATPITIIRGKNGDPISDPQEQVCRFAEHFCEVLGEGKSLSQENIVAQSEDDPAEAAVPQILEEVTPCEWLAEVPSVEEVLKAIRSLRPGKAAGRDDLPSEMLREGGVCAQTALYDIITTVWTTGRVPQDWKDALVVPLFKKGDRTDCNNYRGISLLSVPGKVLARIIQHRLARHAEERLAEPQCGFRKGRSCTDAIFSVRLLQQRCREFQQDLHLCFIDLVKAYDTISRPGLWVVLRAFGVPDPLLTIIKDLHDGERARVKLRGRESEPFPVHLGVRQGCPLAPTLFNIYFDHVVREAFNSCTGGISIWYRYNGRLIDARVRSRDGSLLLNHVMYADDLVIAAHSEEELETLLLRLERATKRWGLTISPTKTKHLPGYFVPSDTPPPQLPIGDGAVVERVESFPYLGSVLMTGSSLTAEVSLRISRAAISFHRLRNAVWKLPGLSLRTKLQVFSATVIPSLLYACETWTPLMEHLRRLETFRLACLRSILGLTRLDCVRSSQILERSGQGPIGELLRQARLRWLGHVARMPSHRMPKQLLFGRIEGAKRARHGLEKRWSDVVQEDVELSGLADDWYQRCQDRPLWRRLVKDATGQLEAVALQQQRRAEERRSQQRAERRVAKAQQVGTVGGTGGASASHLSQSTRGTWVCPVTSCQRAFDTS

SEQ ID NO: 1871 - DNA, 241 bp, Schmidtea mediterranea
  source 1..241: mol_type = unassigned DNA
tttacgtatgttaaatcatgtttgtttttttaatattattaaaataattgaaaattttaaattgcattaatttttaaaaaattagaatataagtaaaaaatttaaaatttaaaattaatttaaagtgaattgaatatattttaaaaatatttatttattaaaaaattaaattaataaaaaataatttgtttaaattaaatgttaattcataatatttttagttggttttgagtacctgaag

SEQ ID NO: 1872 - protein, 840 aa, synthetic construct
  source 1..840: note = Description of Artificial Sequence: Synthetic polypeptide
MIAVLSKYIVRKVFYWRYRLIKSLPNLFNYLFINHAAAVPIFKRFMKVYNSLKRKELDISFLETCLEEKMIPSFIYKMKLSDCLSSKDVQLIHRRTLRRMLESEKIRRTSIDKKLTNIGLMLNNATNEFCLQVCVEWCIKNSIVQIKSKENAHIKKLINLRKIFGISKFSVENTVINLSKIVLNDDEERVLKFGPNHCIKNRLDETKLCAKIESLYFHIARSMKGINGNYVKSSLSASTMEYIDKNKKQNIRDFMTLKNLAKKNINICKFDKGNGIVILDHDVYVNKLNDLLNSPQFVKLPKGRKNGKLPPLKDEEFVQKMLNGFIEKKLIDEEVGKSIRPIGSQPAKLYGLPKIHKDGVPMRPVLSMVGTAQYKIAKFLDGLLKPLMRSEFECKDSFEFVSCIAKLQKRSMNDVMVSFDVCSLFTNVPLVETIDLCCALWNENDSEHHILDRRAFRKLLEFATSNVNFLFNDEWYQQIDGVAMGSPLAPTMASIFLASLEKKIASFQFEKPFVYKRYVDDIFLIFENQKHVEPFLQFMNSLHKNIVFTCETERKSSIAFLDLLIQRKDKQYETEIYRKPTDTGLYTSPESFCEFKYKRNMVKGLIYRSWALSSTFANSVKSVDKLVELLIKNGYSKSFLLLMIKETVDKLIKNPKDPCCGKSECNLSDGCELSVDLGDCKNGYKKIEPKYVLVLPYSEGFTNYKRKLGKLIGNLEYKIVSNSCKVRNMFINKSKTPVGLCSDLVYQFTCNGCNATYIGETSRHLCTRVLEHCRLKGLTNISEHNRGCKSDIGMSDFRILLRSFNSYWERVICEALLIRSLDPKINVQSAVTTNVLNVFK

SEQ ID NO: 1873 - DNA, 2763 bp, Monodelphis domestica
  source 1..2763: mol_type = unassigned DNA
gacagagtgaaacaactttcaagaaaagaaaaacccaaaaggtaggcagagaacatctggggcactggggtgagaggagagcagagccagcaagaggcatagcaagaagtgaagagcaagccacataccccaccacaccccacatctgctgtcccaggttcatgaacctaagcccaagccaaatcagaccctgagatcctgctgggcaaatagtggtacaagccaacccataccccttgaaatttcaaacctgtggagaagtccaaggcaatctgggctgaagtgggctgatccatgtgggcccagagcaaagccaggaatcccagtctgggcttgggataaggacataattcacagtttggggtgaggtgatagtactcaaggggagcctcactgggatctttttgcctaaagctcagggcagagctccaagacagggcaatcaagggtgtgcctgattggatcaagtacacagtgagaccaaaaaacttgagcctaagcctggggctagaatttgatcagcccctgacctgatcaagatcagagtgagatcaaaagcttacacccaagcctgaggcaagtctttaagctatcagcatctcaagggtcaattgaatcagcagggggagggggctctcagagctctcagccctcagaccatcaggtaaactggtaaaaacccagaaaataagctgagaataacatcaaggaaggactgaagtttaagagggtaccccaacttcccagaaaacagagcctacctataattagataggaaaaatgagcaaacaatcaaaaaagcacctaactctaaagaattttttatggagacaaagagcaaggtacagacacagaaggggacagtgaaagcaaaggaaacacatgcaaagtccaaaagaaaaatatggattggacacagattctggaagagctcaaaaaagacttcaaaaaccaattaagagaggcagaggaaaagtggggaagagaaatgaaagtgatgcaagaagaaaagaaagtgatgcaagaagaaatgaaaagtgatgcaagaagaaatgggccaattgaaaaaggagaaccaaaaactgacagaggaaaatcaggtcttaaaaatcagaattgaccatctagaaactaatgatttcatgagaaatcaagaaacaataaagcagaatcaaaggaatgaaaaaaacagaggaaaacatgaaatatcttattgaaaaaacaactgacctagaaaatagatctaggagagacaatttgagaattattggactacctgaaagccatgatcaagaaaaaaaccttggacatcatattacaagaaattatcaaagaaaactgcccagagatccttgaacaagaaaataaaattgaaattgaaagaattcacagatcacctccagaaagaaatcctcaaatgacaacttccaggaatgtaatagctaaattcaagagccaccaagccaaggagaaaatacttcaaacagccagaaagaaaccattcaaataccatggagctacaatcaggatcacacaggacctagtagcttctacattaaaggatcaaaaggcatggaatatgatattcaggaaggcaaaagatttgggtttacaacccagagtcacctatccagcaaaactgagtatattctttcaggggaaaaaatggacattcaataagatagaagatttccaagcattcctgaggaataagccagacctaaacaaaaaatttgaagtccaaacataagacacaagagaagcccaaaaaggtaaataagaaagagaaaatttaagggactcattaaggtcaaaatgtttatatgtctacatggaaagaggatttctgtaattctcaaaaattactcttagtagtagagaagatagaaggaatttactcagaaagagggtggagaagtaagctgattatgatgatatgatgtatatgatgatatatatgtaaatgtgatgatatggaatgatatgtatgtatgatatgatatgtatgcatatgaatgatatgtaaaaaatcaatcaagggctgaaagagagggttgcactgagagaaaagggaagggagagatagaatggggtaaattatataacataaagaggcatgaaaaatcattatagagaggggaggataagggtggtgatgggcaatgcttaaactttactctcattgtaactggctcagagagggaaaaacaagtatactcagtggggtatagaattctatcttaccctacagagaagtagaaggggaataagacaagggaagggggaggtaattggagggaggggaagtgggggggtgacaaaaagcaaaatactggtgaggaggaacagagtgaaagggaatagagcaggatctaaaggggataatatgatggagggcaatacacagttagtaatcataacactgaatgtgaatgggatgaactcacccataaaatggaagtggatagcagagtggattaaaaaccagaatcctactatatgttgtttacaagaaacacatttgaggcagggtgacacacacagattcaaggtaaaaggctggagcagaatttattatgcatcatctaaagtaaaaaaaagcaggagtagcaatcatgataccagacaaagctaaagtagaaattgatctgattaaaagagataaggaaggaaattacattttgctaaaaggtactataaacaatgaagtaatatcattactaaacatttatgcaccaaatggtatagcatctagatttctaa

SEQ ID NO: 1874 - DNA, 1348 bp, Monodelphis domestica
  source 1..1348: mol_type = unassigned DNA
taattattaagaactattttgcccaattatatggcaataaatatgacaatctaggtgaaatgggtgaatatttacaaaaatataaattgcctagattaacaaaagaggaaatagaatacttaaataatcccatctcagaaaaaagaaattgaacaagccatcaaggaacttcctaagaaaaaatccccagggccagatggattcacaagtgaattctatcaaacatttaaagaacaactaatcccaatactatacaaattatttgacaaaataagcaaagaaggagtcttaccaaattctttttatgacacaaatatggtactgattccaaagccaggcagaccaaaaacagagaaagaaaactacagaccaatctccttaatgaacatagatgcaaaaaatcttaaataaaatactagcaaaaagactacagcaagttatcacaaggattattcactatgaccaggtgggatttataccaggaatgcaaggatggtttaatattaggaaaaccatccacataattgaccatatcaataatcaaaccaacagaaatcacatgattatctcaatagatgcagaaaaagcctttgacaaaatacaacacccattcctattgaaaacactagaaagtataggaatagaagggccattcctcaaaataataaacagtatatatttaaaaccatcagcaagtatcatctgcaatggggacaagttagaagccttcccaataagatcaggagtgaagcaaggatgcccattatcacctctattatttaatattgtactagaaatgctagcagtagcaattagagaagaaaaagaaattgaagggattaaagtaggcaatgaggaaactaaactatcactctttgcagatgatatgatggtatacttaaagaatcctagaaaatcaactaaaaggctagtggaaataattaacaactttagcaaagttgcagggtacaagataaacccacataaatcatcagcatttctatatatttccaacaaaactcagcagcaggagttagaaagagaaactccatttaaaatcactctagacaatataaaatatttgaatctatctgccaagacaaacacaggaattatatgaacacaactacaaaacacttttcacacaattaaaactagatctaaataattggaaaaacattaattgctcatgggtaggatgagctaatataataaaaatgacaatcctacccaaattaatctacttattcagtgccatacctatcaaactaccaaaaaacttttttatagaattagaaaaaaatataacaaagttcatctggaagaacaaaagatcaagaatatcaag

SEQ ID NO: 1875 - protein, 284 aa, synthetic construct
  source 1..284: note = Description of Artificial Sequence: Synthetic polypeptide
MRKKLKELKEEIDSKTILVGDLNLPLSELDKSNQKINKKEVREVNEMLEKLELIDIWRKLNRDKKEYTFFSAVHGTYTKIDHVLGHRNIANKCRKAEIINATFSDHNVIKIIINKGPWKGKFKINWKLNNLILQNWWVKKEIIETIMDFIKENDNEETTYQNLWDTAKAVLRGKFISLSAYINKIEREEINELGLQLKKLEKEQIKNPQIKTKLEILKIKGEINKIESKRTIELINKTRSWYFEKTNKIDKVLVNLIKKRKKRIKLTVSKMKRVISPLMKRKLR

SEQ ID NO: 1876 - DNA, 348 bp, Petromyzon marinus
  source 1..348: mol_type = unassigned DNA
tgattgattgttcacgcttacagtggctttcagacagcatacataaaaaatttcgtctcccccctcctcttttcaaaaaatagatggactagtcctgctgggcaaactgccaaatcgttgcgcgtgacgcaaacgttttttttaaataaataaatatgccgttttcaaataaataaatttatgcaaaccgacacacctgatgatgaccgtttgagttatggtcgaaacgtcgtgagaatttttattgttttatatatattttgttattttgttgtttctcttcaacgtgactttaccgaaaaaactaagaatatgaattactgcagtcacgaaagctttaaatcaaaa

SEQ ID NO: 1877 - protein, 776 aa, synthetic construct
  source 1..776: note = Description of Artificial Sequence: Synthetic polypeptide
MNRLYGEGFHITLRSFNKLRDKKAQLIESLTFLKRCRDSGVIPIAFTLTSATVTSSNAKRILFKTSLALISEKIRLIRTELDQLDKTLYKSHLSLTAIMSTSDWEHVDNMTASSAATMSTKCKENLISKFNLLFNKRPDPHTKKLDVNKVVINRSNSSISDGLKSVLAKGLNFAVTPKHIPVNDIIAQVDVALRGLGHIAADVARSEIAATLKNAKMPASNLSKDERFELYKLKKRNDIVVLSADKGNATVIMDKIEYNNKIKELLDDGSYTKIKRDPTNSLVTQTNKIISDSTALIDQSKQFSLKPSAARPPRLYGLPKIHKVDTPLRPIVSTISSPTYKLARFLSEILRPFTGKTTSAVQNSTHLVSTIKGISLSPDDLLVSFDVVSLFTKVPVPDTIAIIEDLVHQGLNTEVPPLVRHCLTNTYFTWNGTFYKQTEGTPMGSPLSPVIANIFMEKFETDAIQTATLRPTLWKRYVDDTFVIWPHGRPALDQFFDHINSIHPAIRFTMEVEIDGKIPFLDVLIKKRPDGSMSHSVYRKATHTDAYLKPDSHHHPSQKNSLIKTLYHRAQCISDQEHISSELKHVHQALRANGYSDYTIRKAITQTMKKNPLEEPFKTITLPYIAGITKKISKILNKHKIQVRFNTLHKIRDLVPSVKDVIPDIQYPGVYKLSCLCGSSYIGETKRHISDRIREHKADLKHGRTNTSAVADHCSNSVGSHAIDFSKTEVLCKPSGFHERFVHEAIHIYKHRDNFNREDGFYLSNHWKDLINHFSS

SEQ ID NO: 1878 - DNA, 741 bp, Petromyzon marinus
  source 1..741: mol_type = unassigned DNA
agcttagctgattggagaatatagagtttattgataacatgaaggtaatttatattttagtttttattggttcactatatagtactgtgaatagctcagatgtgtaggccttgacttcaacatagtcatttctgtgaccagtcactagcaaatcacccagttatttcaatgctaaattcgcctagttatttcaatgctaaattctcctgtttgatttgtactaagtgcctcggtgaatgtgtatgctctgacttcaacgtaactatttctgtgagcagttacaagctaatcactcagctatttcaatgctaaattctatgctaattccattgtcaaggggtgcctctgcggatgtgtatgccttaacttagctatttcaatgctaaattctatgctaattcctttaacaatgggtgcctctgcggatgtgtatgctttaacttttaacatagctatttctgtgaccagtcacaagctaatcattcagccatttcaatgctaaattttatgctaattcctttgtcaaggctctttgttcctctcacacagcttaaaagccgtgatctgaacgtggctctctcactccagcgctgtcctaccagacagtctcgctcccttcacctgatgaaggccgcttgtgttgtggccgaaacgtcgtgagaatattattgtgttattttattttatcaatttattattttattctcattctacgtgactttaccgaaagaaccaaagaag

SEQ ID NO: 1879 - DNA, 1053 bp, Petromyzon marinus
  source 1..1053: mol_type = unassigned DNA
taattaattgtattttacgatgaccttcagaccgcagctctttcgccagcattgcctcttaatacctctcacaccacggttaatggtatggtttacaacatggagtatactagggcttcgcagctgtctctctccccctcctctgttccgaccatggacgaactcgtccgtctgaacggggcccgtagctatccgtggtacgaaatttgagggtaagaatccacccatttttttcgccatatagcattgtgatatataacgacttatggttggtagcttagctgattggagaatatagagtttattgataacatgaaggtaatttatattttagttttttattggttcactatatagtactgtgaatagctcagatgtgtaggccttgacttcaacatagtcatttctgtgaccagtcactagcaaatcacccagttatttcaatgctaaattcgcctagttatttcaatgctaaattctcctgtttgatttgtactaagtgcctcggtgaatgtgtatgctctgacttcaacgtaactatttctgtgagcagttacaagctaatcactcagctatttcaatgctaaattctatgctaattccattgtcaaggggtgcctctgcggatgtgtatgccttaacttagctatttcaatgctaaattctatgctaattcctttaacaatgggtgcctctgcggatgtgtatgctttaacttttaacatagctatttctgtgaccagtcacaagctaatcattcagccatttcaatgctaaattttatgctaattcctttgtcaaggctctttgtttcctctcacacagcttaaaagccgtgatctgaacgtggctctctcactccagcgctgtcctaccagacagtctcgctcccttcacctgatgaaggccgcttgtgttgtggccgaaacgtcgtgagaatattattgtgttattttattttatcaatttattattttattctcattctacgtgactttaccgaaagaaccaaagaagatgaatcattgcagtcacgaaagctttaaatcgaaa

SEQ ID NO: 1880 - protein, 788 aa, synthetic construct
  source 1..788: note = Description of Artificial Sequence: Synthetic polypeptide
MNHCSHESFKSKFNRLYGEGFHTSLRSFNRLRDKKAQLIESLTFLKRCRDSKVIPTAFTLTSAVATSLNAKRILARTSFALISEKIRLTRTELDQLDKTLYKSHLKLTATMSTSDWEHVDNMTTSSAATMSNKCRDNLISKFNHLSSKKSDPHTEKIDVNKVVINRSNSSISDGLKSVLAKGLNFAVTPRHLPVNDIIAHVDVALKGLSHISADVARSEIAATLKNAKLPPSNISKDERFELSQLKKRDDIVVLSADKGNATVIMDKTEYNNKIQELLNDGSYTKIKRDPTNSLVTKTNKIISDSTALIDENKQFSLKPSAARPPRLYGLPKIHKEDTPLRPIVSTISSPTYKLARFLADILRPFTGKTTSAVLNSTHLVSTIKDISLSPNDLLVSFDVVSLFTKVPVPDTIAIIEDLVHQGLHTDVPPLVRHCLTNTYFTWNGTFYKQTEGTPMGSPLSPVVANVFMEKFETDAIQTATLRPTLWKRYVDDTFVIWPHGQPALDQFRDHINSIHPAIRFTMEVEKDGKLPFLDVLIKRRHDGSMSHSVYRKATHTDAYLKPDSHHHPSQKNCLIKTLYHRAQCISDQEHITSELKHVHQALRANGYSDYTIRKAITPVMKKDPLVEPLKTITLPYIAGVTKKISKILNKHKIQVRFNTVHKIRDLVPSVKDALPDIQYPGVYKLKCLCGSSYIGETKRHISDRIREHKADLKHGKTNSSAVADHCYNSVGSHDIDFSKTEVLCKPTGYHERFVHEAIHIYKHRDNFNREDGFRLSNHWKDVLNHFCS

SEQ ID NO: 1881 - DNA, 776 bp, Petromyzon marinus
  source 1..776: mol_type = unassigned DNA
taaactaattttcaatggtacagtaaattatttttcaagtagtggtaccccaaactttcgcagctgcttataaatctcccctctttcacaccactcaataggtaaactcactcccctccctccccccccccgcgccacacgccaactccacgcacgtactccacgcactcactctctcactcagtcaatcaatccaatcaatctgctaatttatttatgccactttctttttcactccacccattcgttgctctcactcagtccatttactaggtgcgctcggtgactggatttactgctctgactgtcttaactagctgatttcactgagtgcactcagtgaatgtaatcactcactaacttcactaattctactaattcctgtcagtccactcagtctactaactcactcaattcaatctaaattcaattctaattcctcaaggggtacctctgcggatgtgtcatgctacatacccgcttatggtccatcatggcccattcacctcccagtttcatcatgctaaattatatgctaattcctttgtcaaggcgctttgtttcttctcacacagcttaaaggtcgtgatctgagcgtggcttttttcactccagcgctgtcctccagacagctcggtcccttcacctgatgaaggccgcttgtgttgtggccgaaacgtcgtgatttttgttattttattttttacctacgtgactttacccaatagaaccaaagagtatggatccttgcagtcacgaaagctttaaatctagaa

SEQ ID NO: 1882 - protein, 697 aa, synthetic construct
  source 1..697: note = Description of Artificial Sequence: Synthetic polypeptide
MELDTLDRTLLQAHLMLTQKMSPDWNHVDNMTASSAESLSVKCKANLISKFNHLSKKNPVPHITKLDVNKIVINQSSTPISDNLKTVLARGLNFAVTPKHIPVDDIISQVDVALKGVGHIQADVARAEIATILKNAKKPISNISKNERSELANLKNRSDIVILSADKGNATVIMDKDSYNNKIQNLLNDGSYSKIKNDPTNSLAIKTNKIITSSTSLIDPTKRPSLKPSAARPPRFYGLPKIHKEGTPLRPIVSTINSPTYRLARFLSDTLLPFTGKTASAVLNSAQLVSMVKDVVLSPDDILVSFDVVSLFTKVPVPDTIEIIENLVQHGLDPDTPALVRHCLNNTYFTWNGSFYKQNEGTPMGSPLSPVIANIFMEKFESDAIQTSTLRPSLWKRYVDDTFVIWPHGLPALNLFLHHINSRHPAIKFTMEVEKDGKLPFLDVLFERRPDGSLGHSVYRKPTHTDSYLKPDSHHHPAQKNSLIKTLYHRAHCISDQHHLTSELKHVHLALKRNGYSDRTIRQAVSPSIQKQPLDTPVKTITLPYIAGVTKKISKILNKHKIQVRFNTVHKIRDLIPSVKDVIPDLQYPGVYKLSCTCGDCYIGETKRHVSDRIREHKSDLKHGKTNSSAVADHCYNAVGDHDIIFSDTKVLCKPTGFYQRFVHEAIQIYKHRHNFNREDGFKLSNHWKDVLNRTKH

SEQ ID NO: 1883 - DNA, 388 bp, Petromyzon marinus
  source 1..388: mol_type = unassigned DNA
taactggctgtgatgtttccatcctacctaccgatgttagcagttattttcgactctctgagttacattcactaacacagccaaccgttagctgtgttagtaaatggcggcttgccactgcctcgtccatgccctggccgagcttggccccctccgatcttacatttacatgcaaatttctctcctactagccccgcccactcgctcctacatgacccttggctgctacacccatctctaaacctttataaacagcctgcctcagcagctttccctcttttttcacctgatgacgattgcttgtgttgcgatcgaaacgtcgtgatttttaatttttattattttttctatctacgtgactttaccgaaagacccaaagaatatgaat

SEQ ID NO: 1884 - protein, 334 aa, synthetic construct
  source 1..334: note = Description of Artificial Sequence: Synthetic polypeptide
MGSPLSPVVANVFMEKFETDAIQASTLRPSLWKRYVDDTFVIWPHGLPALNQFLNHINSIHPAIKFTMEVEKDGKLPFLDVLIEKRPDGSMGHSVYRKATHTDAYLKPDSHHHPSQKNSLIKTLHHRARCISDHHHLASELEHVHQALKMNGYSDYTIRKAITPTVGKEPSEDPIKTITLPYIAGVTKNISKIMSKHKIQVRFNTVHKIRDLIPSVKDVIPDMQYPGVYKLSCVCGSSYIGETKRHVSDRVREHKADLKHGRTNTSAVADHCFNAVGSHEIDFSKTKVLCKPTGYQQRFVHEAIQIYKHRHNFNREDGYKLSNHWKDVINQFKS

SEQ ID NO: 1885 - DNA, 293 bp, Anolis carolinensis
  source 1..293: mol_type = unassigned DNA
gatacggtcgatataatctgatgtattcgctggattaatgtgtaattgaatacagactggctctgacttttggcccaatgctactggccctgttgtaatggccacacagtgctttactgttttaaatggggtataatattggtttttaagtgtgtttttacgatcgtttgttttactatattttgtattatatgtggcattaatcttgccattatgtaagaccgctctgggtccccctgggggagaagagcggtatataaattaaataaataaataaataaataaataaataa

SEQ ID NO: 1886 - protein, 719 aa, synthetic construct
  source 1..719: note = Description of Artificial Sequence: Synthetic polypeptide
MPIKMVRPRRLMDPDGFLRSLGDLPASSRGDPVDALVTRYNSEMARAIDTIAPERPLSLRRAKPAPWFTEELAVMKRERRGLECVWRKLRSESDRARAKALRKAYSVALRAAKKSFQTARIAAAKNRPSELFRVVGELLNGTPQTGPPDDLAENCAAFSHHFADKVAQIRSELDATVDAVSEEVARAPVCPILMDSFQLVQPDDVDKILGEVRATTCALDPCPSWLVKEARGGLVEWVRVVINASLREGIFPSCLKQAVVKPLLKKPSLDPTNWNNYRPISNLPFLGKVLERVVASQLQGFLDDTDFLDPSQSGFRPGHSTETALVALVDDLRRELDRGSVTLLVLLDISAAFDTIDHGILLGRLLGMGLGGTVLQWLQSFLEGRSQMVKLGDTCSDPWPLTCGVPQGSILSPMLFNIYMKPLGEVIRSFGVRCHLYADDTQLYYSFPPASKEAPQILNQCLAAVSDWMRANKLKLNPDKTEVLLVSRKSDRGIGWQPVLDGVALPLKAQVRSLGVLLDSSLTLEAQVSAVAGRAFAQLKLVRQLRPYLVKSDLATVVHALVTSRLDYCNALYVGLPLKTARKLQLVQRSAARLLTGANYRERTTPLFKELHWLPVIFRAQFKVQVITYKALNGLGPTYLSDRISPYEPARRLRSSGEALLSVPPPSQVRLVGTRERAFSAVAPRLWNSLPREIRQAPTLLSFRKQLKTWMWDQAFGPS

SEQ ID NO: 1887 - DNA, 799 bp, Drosophila persimilis
  source 1..799: mol_type = unassigned DNA
ggctaatgcagcacacaaatttacttgcctgtgagatcgcaacgcacccatacattccaagaaggctggccaggccaaggtatgccgcaatgatagaagagcacaatccaaacagcaacagaagcctgacagccatccaaacaatactgctccaagtcagacgcgagaactggctgcgcaatccatttgcaacacacaatatggaaatcagccgcagtagcgctaatgcagctgctacgcaggcaaatgacggccccagcagagaacctgatgatggacggcggcagctccagaatccagatgatggcggcggctgaaaagaaactaaaaacctttttattcttccacagatacgaagccacttcacctgcacagaaattggtaatccacatccagaatgacgatgcactggacctcggccagcttcagccctgttgatgctgtcctgcagtcacagtttagcgccgacactcgcaaggattccacttcgcagccgacgacgagaccaataggcgtaatgatgttcttcacggctgcatactccacctgaaataattaaaaacaaaaacaatgtaaacaaagtagcaataagtttagtgttaccctggcatttagccaaattatcgatagctactaaaaaaaaataaataccaaataagccaataccgtaagaaatgttaccctgccaatttacagccacttctgcaactacatgtaatgtagataagcagttggcgcgaaacaatttgtaaaatatgctaattataagagtataaacaaataaaacggttctctcttc

SEQ ID NO: 1888 - protein, 846 aa, synthetic construct
  source 1..846: note = Description of Artificial Sequence: Synthetic polypeptide
MSASLPPANAGGDGNWFDMKRDYQFSSQDEHNRNNIPHISLAPTREDSIQMCTIAAKIKNHQTINIGAIYCPPAHEWIDTQFKQVFDSLGSRFIVAGDWNAKSQWWGNARSCRRGAALLKCIQENDQSILATGSPTHFPSNRRHMPSAIDFAVYKGIRHNLIHIETSYDLGSDHNMQIIKLLLRPEYGKKKILLPKNANIRRFQAHLEQRIHLETELHNGDDIDDAVAILEKNIYIAAELASQTSSNQHTVYGPQNFHLDSQTLKAIKIKRILCKINQKDRCSNPLIARTINQLTNRISKRIKLQKDKQMNRLLHDIDPTDRYSMQKLWRLTNTIKRQPIPNLPVRRHVAEGQQAPADPWCKTTEEKAEAFAQHLEARFTPKITAALEDREEINAVLQENGPDEAAQIIRPVTIQELKSEIKKLKTKKAPGLDSIDNRVIKSLPTSAIEYLLLICNSALQFGHFRKSWKCAKISMLRKPGKPSDRLESYRPISQLTGFSKILERLILKRLFEEESFAMAIPNHQFGFRSQHSAEQQIGRVTQFILRSYEAQRHCSAVYMDIQEAFDRVWHQGLLCKVKTIIPDNLYILLTSYLSDRSFHVVCCNNITSSLKHITAGVPQGSVLGPVLYNLYTADMPQPPRHANSTQMLATYADDAVYLVSALSPKQANENVERLLADALSWSKKWGITISLAKTAHVLHTLSPVQQHTPAPRLAGQLLAKKSVMPYLGIHMDTKLNFNKHVAAIVTKTRARIKKLDWIIGRNSKLPLPPKVLLYKQLIAPIWQYALPVWGPLTSSMQMAKLQTIQSKALRAMTNAPRYVSNNALHADLQVATVEEVYNRLCRNCYT

SEQ ID NO: 1889 - DNA, 488 bp, Parhyale hawaiensis
  source 1..488: mol_type = unassigned DNA
ccgaccgccagcgggataactggcaaaccctgtctcgaccaccggcccgtgaatccatcggggcgtatgagtcagacacaggggggtgtttaaggtgaccctgttgcgaggaaatgcgcagcaaaagccggatgagccttagaacatcgaaggccaacgacaacctgccgaaagactggcggctaatccagtcaacctcctgtaggtcaccggctggtcatgctgaatctcagcttaaccaggcgtacgaacttacagttggagggtcgagcacccctgatggctgaaaaggaccatcaaagtcgaaggtagccaacgagaagaccaacggctgattcaggcggaagagtcaactcgttgaatgcgttcgacagcttggggtagatggaactcctaagccctgaaaggcagtccatcttcgcagacgctaaggtgccccgccgcctgagggttatcaggccccgccgcctgagggttaccaggcaacc

SEQ ID NO: 1890 - protein, 1284 aa, synthetic construct
  source 1..1284: note = Description of Artificial Sequence: Synthetic polypeptide
MKMSHNRDTPSNGVKGTSVRLGTSLVRSPVGEAGAVRERGTHPSESVSQDSDASVNATGEGSVREQAPLSPPGAEEATVPTQRRTRHKWSKEDRVVLWECFVASKREGPGYLKRLKQLWDERGIPGNFPQASLSGQIRQICSKNLLSEEERLQIAARMEAQVASPSADEPARQVPTRPVTPPRSPPVEPARRPSIPSEETPDLGAVPSEIDSADPNRSPSRGPRHLPAHNMSQSESEDDVTDPDVSDQQRSDSLEPRDLLRNSSVESTPGHPNQELSDTLLSNYVPSEIDSDDPNQSPRRGPRHLPAHDMSLSDSMDEETEPDLSDQQRSDLLELRDLLRNSSVETTPKGHPSLRHLPEPKIRAAAFRVNSVIGKIHTNNITETNALIKAGADLAVRILEVQPRPQRTQRKKDPPWKHRLEKNIAEIRKHLSWISEWRRGNLHDEEKKTLLESRYRCLEVGLTNLEDTLKQRLSAKRSKVRRFEARVAGFHQNQLFNTNQKRLYQTLRGEETSSDSPNAEESIRFWSDIWSKEVRHNNAAEWLHDVKEKNVAADPDLTITSQQLKKQLSKTKNWKAPGPDMVQGYWIKTFTSLHSRIAAQLNHCLQRGTVPTWMTTGKTVLIQKDKAKGTEVSNYRPITCLPLMWKVLTGIIYERVYQHLDSKKLLPDEQKGCRRNTRGTKDHLLVDKLLTKDARSKKKNLSMAWVDYKKAFDMVPHSWILECLDIYGIAGNIRNLIATTMPNWKTQLTSANKHLGEVSIRRGIFQGDSLSPLLFVLTMIPLSETLNKAGQGYNYSRTMKLNHLLYMDDLKLYAKSKDQVEQLLNIVHQYSQDIKMQFGISKCGVLNIERGEVTASEGIIIEEGTIKDIEETGYKYLGVMEYNTILHRTMKDSIRKEYLTRLRLILKSHLNGGNTIKAINTWAVPVVRYSAGIINWTKKDCTDMDIKTRKLMTIYRALHPRSCVDRLYINRREGGRGLISVEDCVEAEKRALSQHFRESDDPWARCLIEAKLLKETETADQFKERRRLDRTNKWKSMKMSGQYLEAVQDKIVPDSWNWLLRGELKRETEGTILAAQEQALRTRYIQNKIDKRNVPSTCRICRSSDETINHVISECGVLAQKEYKRRHDKVARHLHWTLLRIHNFPVSERWYEHEPAPVVENEAVQIYWDKRMETDRVLHANRPDIVVKDKQEKSAKLIDVSIPFDSRIIDKEAEKKEKYRDLAIELQRLWQMKVDVVPVVIGALGAMSKNLKTALRELKCGHLHPGTLQKSALLGTAHIIRKVL

SEQ ID NO: 1891 - DNA, 39 bp, Capitella sp.
  source 1..39: mol_type = unassigned DNA
gatgaattgtataattgtgttgattatgatcgtgattca

SEQ ID NO: 1892 - DNA, 114 bp, Capitella sp.
  source 1..114: mol_type = unassigned DNA
tgattaagctacctttatgttgcagttttgatttgtttgttcgtttgtttgattttctttcacctactataatcctgtatatttatttatacgaataaattattattattatta

SEQ ID NO: 1893 - protein, 550 aa, synthetic construct
  source 1..550: note = Description of Artificial Sequence: Synthetic polypeptide
MNELIAFFKISVQNVCDQGSCYSSHQFTAQGVRSAVSKLKDKSDCKDNFMSNHVIHGGDTLFVHLSFLFNCMISHTCDPKQLRMSVLIPIPKNRRKSLSVSTNYRSIALSSIVGKVFDRMILTEHVNIFSTSNLQYGFKPKHSTVQCTFVLQNVINHYKSRGSPCYVMLLDASKAFDRVQYVRLFYLLRERGLCARIFMLLALLYTNQSMCVRWKNCISDNFSCSNGIKQGGVLSPTLFCIYFDELLIRLKHCGSGCHLGHLFTGALSYADDVALLAPTLTAAKVMLNVCEQFANNFNVLFNADKSALLVCGRPIRKEVNLRLNGRIIQQNSTAVHLGTTIGDNSSTRNVKKAASDLYCLTNVLMCKFGHCSIDVLSALFFFFFFYCSSFYGCPLWDLRNIEPILTAWRKCLKRIWKLNIRTRTKYINNLPKGNLISALLIRSLSFYMQCLSSSNAIVKLASNYCFYGCMYSVISENVHLCSVLSSVPLRFIFDDFENVKSIIQRGMYDEATIAESLALKDLCYLRDGLMFLNFEITSEELLCAFNHFTI

SEQ ID NO: 1894 - DNA, 158 bp, Anolis carolinensis
  source 1..158: mol_type = unassigned DNA
cccccccgcaggtgccaccttgacgtggtgggggggcttagctgctccaatgatgactgagggctgtgctggcggtagtgtaactaccggcaggtccaaccaagccagagaggcctcagctgaggagcacaaccaagagcacctaacccattagcatt

SEQ ID NO: 1895 - DNA, 94 bp, Anolis carolinensis
  source 1..94: mol_type = unassigned DNA
tagacacttgggaagtgttcgacttgtggttttgtgaaacgaaatccagcatatctatcttgtttgctgtgtcatacaacgtcgttgtgttgat

SEQ ID NO: 1896 - protein, 1137 aa, synthetic construct
  source 1..1137: note = Description of Artificial Sequence: Synthetic polypeptide
MENQTQTKSILARSSPRIKRTAVDAADSGHPSTSGLRNHQNPNEQSQKRQKYTMPENRTIMKCYYKSEPQRRGYQKRMHQLWKQEYPDSQITEPRLADQRRFIIRNKVFSEVELEEIQKICKVNYHQTTAQTAAETPATLGMVEQIEPEESVELLQEFEEPALETSVEPPGTLTARQQELKDKIMAHAAANAIRKRLPTLKTVPKRHLAPLMKDVNAALSTVQITSIEQTNQYAYSAAVIVTEELGLLQPRQPQRKSTGKPKWKVRLELKIKKLRSDASNLKNMKEKKLKNDKIKQYLIRKYWLNTRKIEEALEIVKEQITATARKIERYEARIIQYRQNQLFQSDQRRFYQSLNQTTDTVTIKPEKTATTKFWKELWENNKNYNKNAGWIKEFEGKFSQNKMELMEITTEMISKRVQKVKNWTSPGSDQLHGFWLKHLISLHGKMAQQFNEMLQKGSISEWLTTGRTYLIQKDPAKGAAPGNYRPITCLPTMFKLLTGIIADRIQDYLEEKNILPDEQKGNKRKSRGTKDQLLIDKMILENCKSRKANLHMTWIDYKKAFDSLPHSWIIKCLDAIGICKNVGTFIENMMEHWKTELFVGNESYGLVNIRRGIFQGDSLSPLLFIIAMIPLSTILQKTNLGYQTSKNSHKISHLMYMDDLKLYGKTETEIQSLTNTVRIFSTDINMEFGLDKCSTVALKKGKIIESEGINMPNGQTIKCHQPEAYKYLGILQLDNIKHEHVKTVVSKEYTQRVRKILKSKLNGGNTIKAINTWAIPVIRYTAGIINWTQVELDNLDRKTRKLMTIHHSLHPRSDVDRLYLPRRSGGRGLLQVKQAVKEEEHALAEYVKQSEEPALIEVKNQKLLKTQQTKNQYKKTALQTRADSWHNKTLHGKFLDKIEGKADKEKTWLWLTNGTLKKETEGLILAAQEQAIRTNAIKAKIEKSADDPKCRLCKETDETIDHILSCCKKIAQTDYKQRHNYVAQMIHWNLCLKYHLPAAKNWWDHKPAKVLENEHAKILWDFRIQTDKVLEHNTPDITVVEKNKVWIIDVAIPGDSRIDEKQQEKLSRYQDLKIELQRLWQKPVQVVPVVMGTLGAVPKDLSRHLETIDIDKITICQLQKATLLGSARIIRKYITQS

SEQ ID NO: 1897 - DNA, 18 bp, Aedes aegypti
  source 1..18: mol_type = unassigned DNA
atcgctgttcgtacctga

SEQ ID NO: 1898 - DNA, 94 bp, Aedes aegypti
  source 1..94: mol_type = unassigned DNA
tagatttttatgttttttttttcattaagacaaacagatgtcagatgaataacaacttcaataaataaataaataaataaataaataaataaat

SEQ ID NO: 1899 - protein, 1080 aa, synthetic construct
  source 1..1080: note = Description of Artificial Sequence: Synthetic polypeptide
MYSKRFQPSNETLAISHDVQPGCTPVSLVEASYPLVTVEPILPATSSHPGPVYEYGEEVFQTLFAGKYSCDSSNFSPVTSVASSDIPTRKSDTKSAAPDDFASDNPANRLPNVITDDLNNNQSCHALRFYYQNVRGLRTKVDSFFLAVSECDYDVIVLTETWLDDRFQNAQLFGSKIIVYRTDRNAANSSKRRGGGVLIAVSTHLNSFIDPTLTSIALEQLWIKISTPSRTISVGVIYLPPDRRDNMDYIRDHLNSMNSVLSNLALNDCVLQFGDYNQPNLLWEASDDGFLRVNSQSILSTAGSTLVDGFHFHGLTQLNGIPNRNSRFLDLVLGNDEARYSCNVTEAIEPLSDLDVDHPALDVILNLPDSITFEDCSDNSQMYDFRQADYAGIHAAISRIDWQPIDDANNIDDAVTYFNHVVQDIIAQNVPLCRPKPKPPWSNSHLRQLKRNRAKSQRHYCRNRSQFTKQEFNRASNAYRTYNRLLYRRYVVRTQTSLRRNPKRFWSFVNSKRKEVGLPRSVHLDGQTATSEQEKCFLFAQHFQKTFHDSPATADQIAAAIEYTPRDVFDFRSFTIDEQTIQAAFRKLKMSHAPGPDGIPSCILKNCSHSLATPLAKLFSRSLQEGKFPDEWKVSSMFPVYKKGDKKDVHNYRGITSLCSCSKLFEILINDALFNSCKSFISTAQHVFFPKRSVTTNLTEFVSLCLLTLDSGGQIDTIYTDLKAAFDRVDHGILLAKLDKLGVSHSLVRWFESYLTNRLLYVKIGSSQSESFTNLSGVPQGSNLGPLLFLLFINELSQLLPPGCRLFYADDVKIYMIIDSTADCELLQSRVNIMANWCSSNFLTLSVNKCNVISFHRRQKPIIFDYRICDTVLNRVDQVKDLGITLDQEMNFKPHYNDVIAKANRQLGFIFKLSDDFRDPLCLKGLYCSLVRSILEFSVVVWCPYQSCWIARLESVQRRFLRYAFRHLPWRDPLNLPAYEDRCRLLGIETLEQRRRRAQAVFAAKLIVGDIDSPELLRQLNIYAPEQVIRQRNFLQLVPCNRLYGMNEPLRASADALNEAFTAFDFNLPLISFIRRLSLS

SEQ ID NO: 1900 - DNA, 188 bp, Aedes aegypti
  source 1..188: mol_type = unassigned DNA
ggtgggagctcaggcaacataactcctgggcgtccatgaaaaaccaccatcttgagtaggtgggagcttgaggtaaaatatcctgggcgtccatgtaaaaccaccctcggcgagcagcggcgcttgaaccaagctattaagcactgtaattggaggaaatgccaatgcagaacccgtagcttccggga

SEQ ID NO: 1901 - DNA, 153 bp, Aedes aegypti
  source 1..153: mol_type = unassigned DNA
tgagaagctcatccagcagactcattaggataagttaaaccgaccaatgagatccacagagcctaatcccctttggcatacagattgcccggggtaggtgaaagtttccagcattttttgctgagaagtgccaaaactctataataataataa

SEQ ID NO: 1902 - protein, 1221 aa, synthetic construct
  source 1..1221: note = Description of Artificial Sequence: Synthetic polypeptide
MKANPAMETRSMRNRRMRSPEEGAPTGAGPGTGDRASGQRLEEDNVQERPSSQRAQPVPRTRNRNGSSRNHQGHAAPTDVAVADRRQSLTLAGGRRQRIMWTREMNMYVIRCYYVCTRMETDMSGRSGMLEMFNERFPRFARQLDLNKLYTRQRAIMSHNMLTAAEVEYIKLEVQREIGEEGTRSSDTSRRSSVGLDAPITSESRDSPAPTAPGPTADMQRQQLRDELALHMGTAVTQFRGTDPMSRHRIPKLRYSYRLTSAVSILNQDILPQYLEAVENLEDLQFIVYSAAIAVVKTLGLRTRPQGEDGTRPNAQKPVWMRRLESRIATLRSKVGRLTQYKQGNRSTRLVRHVAEIVRPAELRDLREVDITEILDTHVQRLSALAKRLRRYGECSKRKEQNRMFNINEREFYNRIRNDKVDFGEGLPEIGDVTQFWANLWENPTEHNGDGMWLAEEERQCDGIGDMTAVVVTAQDIREATRYTRNWAAPGPDFVHNFWYKKLTTIHGRMAECFNTVLGDPTQLPEFITRGVTFLLPKDQHTADPAKYRPITCLSSLYKVLSSVIARRVQAHCDANNVMTEEQKGCRRNTQGCKDQVIVDAVIVGQATQKQRNLSMAYIDYKKAYDSVPHSYLLKVLQLYKVDGNVIRLMQHAMGMWSTSLHITDGTAVLRSRTLSIRRGIFQGDTFSPLWFCLAMNPLSKALNQCNYGYQLKSGERSTRVTHTFYMDDLKLFAESVQRLHQLLQLVTTFSNDIRMEFGIDKCRSIHLRRGQVMDASCFRVNEQEEIRNMVEGETYKYLGFLQLRGIRHTMIKKELQEKFLSRVNCILKSFLSAGNKVKAINTFAVPLLTYSFGVVKWTKTDLEAIERAVRVAFTKHRMRHPKSSIERVTLPRAAGGRGVTDIQALCVSQIQQLRAYFVESQNRHEIYRTVCEADHGFSALHLAQEDYQLNCDIKTVDEMIAMWKQKELHGTHPHQLELEHIDKVASNTWLVRGDLFSETEGFMVAIQDRVIATKNYRHYILHEDVEDRCRKCNSVGETIEHVVAGCSVLAGSAYLDRHNEVAKIVHQQLALKHNLVDRFVPYYKYLPDPVLENSCIKLYWDREIITDVLIRANRPDIVVYDKRMKRVTLIDIAVPLDHNVQSTFSNKIAKYHDLAEELKQMWHLEDVRIVPVVLSATGIVPKSLLRSLDELELKKDLHSIQKAVILGTCSIVRRFLNHHN

SEQ ID NO: 1903 - DNA, 113 bp, Arachis ipaensis
  source 1..113: mol_type = unassigned DNA
actccgcctatgttacacttgcggtacatagccggtcccaagcccggataaaggaggagggttgtgttaggtcttcggcaaccaacataaaaatatagccgaacccccatgac

SEQ ID NO: 1904 - protein, 1020 aa, synthetic construct
  source 1..1020: note = Description of Artificial Sequence: Synthetic polypeptide
MNQRHYCAKARSLPGSNAPYGSSTVSNEQEPLHRCPDVVLNEQGFSRFRERTRVNKLVHKVKGKGRSDRRLRFGTWNIGTLTGKSMEVVDTMTRRKINIMCLQETKWVGAKARELDTSGFKLWYTGKVKNRNGVGIIVDKQWKKDVVDVKRVGDRIISIKLVVEGGAFHVISAYAPQVGSDEQHKIRFWEDLESLVQGIPLGDKIFLGGDLNGHVGREVTGYGSIHGGHGFGVINAEGKTILDFSSTFDLLIANTCFKKRDEHLITYKSGMTSSQIDFFLLRRVDRKFCINCKIIPGESLTTQHRVLVMDFRVEQKLRKRHHTKNPRTRWWRMKGEEQRSFLRRVGEEAKWDGNGSAEEMWREMAEVIRRTAKESFGESKGIGPRDKESWWWNASIQEKIKIKRECFKEWSLCRNADNWEKYKAAKKETKVAVSEARTRAYEGLYQSLGTKEGEKGIYRIAKSRERRTRDLDQVKCIKDKDGEVLAQEEKINERWKSYFYELFNEGQKTLPSLGRLCTREEDQNFDYYRRIRDFEVKEALKQMKNGRAVGPDNIPIEVWKGLGEKGINWLTKLFNEILRSKKMPDEWRKSTLVPIYKNKGDIQSCGNYRGIKLMSHTMKLWERVIERRLRKETQVTENQFGFMPGRSTTEAIYLLRRMMERYRSNKRDLHMVFIDLEKAYDRVPREVLWKVLEKRRVRIAYIRAIKDMYDGATTSVKTQGGVTEEFPIGIGLHQGSSLSPYLFTLVLEVLTEHIQEPVPWCMLFADDIVLMGESREDLNKKLELWREALEVYGLRISRSKTEYMECKFSLRRENPNIEVKIGENILRKVKSFKYLGCIIQDNGEIEQDVNHRIQAGWSKWRSASGFICDKKVPLKLKGKFYRTAIRPAMLYGTECWAAKGEHEHKLSVAEMKMLRWMSGHTRLDKIRNEDIRERVGVAPIVEKMVESRLRWFGHVRRRPIEHPVRRVDEMEDGQRAKGRGRPKKTIHEVVKRDLHVNGLSVDMIHDRAQWRRLIHVADPT

SEQ ID NO: 1905 - DNA, 367 bp, Aplysia californica
  source 1..367: mol_type = unassigned DNA
ccggagtggggcgaccatccccgacccggcgggtcccaggtggcggatagggaacggccactgttatagaggttagctgtgaatatattgaataagcagccccggaccaactggcgatgctcttaccaggacggggtgaggtggtaggtggcactaccacgtcattaaatgccctaggagtcctctgacgggagcatcatgaggaaaaggaccgcattaagtcctggctacgggggggatccggtaacaattcctccctgtgctcccagggtaggtccttggacctggagctggagtgctgaaatcggaggtattgggccgcaaggcgcactctagagaaccacaataccacgtaatactgcaatat

SEQ ID NO: 1906 - DNA, 27 bp, Aplysia californica
  source 1..27: mol_type = unassigned DNA
tgatgcgatcgagaagaaaaagaagaa

SEQ ID NO: 1907 - protein, 1271 aa, synthetic construct
  source 1..1271: note = Description of Artificial Sequence: Synthetic polypeptide
MTLEEGNVRYGARPVRTHQAGAVPGPKPRRGPPQRLEGLPSSWSARRRGRKATGNTNTKQVKKSLNIMHWNAEGISNKKTELENFLKDNEIHISCIQETHLQEEASFKVRGYQCFRNDRQGRKKGGVLTLVRNNLNTVEIKKYTGEAEYIHNRITTSRGNLDLVNYYCPNDTNLVLETIEVPDTDFIIAGDFNSQSQSWGYNRLDRRGEEIEAWQDENHLLLVNDPLDQPTFYSRAWHSTTTPDLALCTENLHRHLSRKVETQLGGSDHRPVLLTIVESLPEDSPKRPRWNYKKADWRLFSIRTNELTKNIAVFGKNINNAIREFNENILKSAKETIPRGVRKNYTPYWTPELQKTHNDLIKAREEAETHPGRENNNKLQRCKAHYLKTKLECTRKSWRDKTHKLNLEKDTTKLWRLVKGLSDEGNKNDKISLEVEGEMEMEKRAAHTFVKAYAQESNIKIPRERQKEVRQEERRKRSTNNIPEAMEKDITMEELKKAINQLKQRKSTGPDEITNEMLQHLGNTALQTLLDIFNLSWKIGQVPQCWKEATMILILKPGKSKAQPLSYRPISLISCVCKTMERIIACRMQWYLETQHIIVPEQAGFRQFRSTEDQTIYLSQVIEDSFQAQKVMLATFVDLQKAFDKVWKEGLLVKLLRSGIQGNMYQWTKSYLHNRRARVLVDGYQGRKMLLRQGVPQGGVMSPLLFILFINDLMNELPKGIHAALYADDLVLWCSEEFVTTATYRMQLALDKLTTWTKTWCVTANKEMSSATLFTLSQAEPKHLTLDKTPLKFENQQKYLGIIFDKRLTWKQHIQNAENKARKKLNIMRKLAGTQWRANEKTLRQVYLGAIRPHLEYGSSAWMTAAQTHKYTLEKVQNQALRIITGAMRSTPIEKMEQKTSIVALQRRWECKALVQYTKATAMEDHILHTRTERSNTARLKRSNFIKESRKIQRSLQDHLPATVNMLNHTPEAPSWEKKNTNISIHTSIPMFTTKDDHSDLSKKSLTLSMLEERYPREAWIRIYTDGSATDAVKRGGAGVYVQFPNRRRQAEAVPTGRHCTNYRAETEALVQAANIIKNVVDPQSQVVFLTDAMSVLQAINSGKLPRLRKEIEDIPCLRIMLQWIPSHCGVLGNEQADRMAKLGAQKEQPDNSVNYTEIKTIINTLFKAPQTPDGYHELSRQEQVIIFRLRTQHTRLRQLMYKCFKIVQSPKCQCGEADQTVEHILQHCKTHRALRQETWPTPLTLEEKLYEPPDELTRTAQFMTDTGLQV

SEQ ID NO: 1908 - DNA, 716 bp, Aedes aegypti
  source 1..716: mol_type = unassigned DNA
ttggcgcggtaaatggctgggcatggcgtaccattggtacctcgcgtacctgcaggaataaaatagacccctttgtgcggtccttagcctcttgcccagcaactcctatccctacctcctcgtggtactggccggggtacgagtaaccttggggaagatcgggtaaccaacccccggtgggaactttggtcgtatgctgacagggaagggggggtttgcttttgcaaacctggagcgtctgtactccacgttaggagcggctcacaacagcgtctgttccccatgtcaggggcggctgatcatcgtccgagtgccagagaaggactctaagctaaactgcgcactatggccctccgaacatttagggggaatggtcctccggaaatctagggggttggtgtcaggccctgcaagccaaccgtaaaaacacatcagcacaggaacgtcaacgagagaatacggaccggaacaatcggcaaagaccacagcgacgaaaatggactagcgattggaaactcggtacgtggaactgcaaatctctcaacttcattggaagtactcgcatactctccgatgtactgaagacccgcggtttcgacatcgtagcgctgcaggaggtgtgctggacaggagcattggtgcgaacgtttagaggtaatcataccatctaccagagctgcggcaacacacgcgagctgggaacagctttcatagtg

SEQ ID NO: 1909 - DNA, 39 bp, Aedes aegypti
  source 1..39: mol_type = unassigned DNA
taattgatgtaaagccaaataagtaagtaagtaagtaag

SEQ ID NO: 1910 - protein, 903 aa, synthetic construct
  source 1..903: note = Description of Artificial Sequence: Synthetic polypeptide
MGDMQRRVIGWWPINERMCKLRIKGRFFNFSIINVHSPHSGSTDDDKDAFYAQLEREYDRCPSHDVKIIIGDLNAQVGQEEEFRPTIGKFSAHRLTNENGLRLIDFAASKNMAIRSTYFQHSLPYRYTWRSPQQTESQIDHVLIDGRHFSDITDVRTYRGANIDSDHYLVMVKLRPKLSVINNVRYRRPPRYNLERLKQPDVANAYAQHLEAALPDEGELDRAPLEDCWRTVKAAINDAAESVVGYVERSSRNDWFDEECQEVLEEKNAARAAMLQHGTRQNVERYRLKRKQQTRLFRDKKRRLEEVECQEMELLYRSQETRKFYQKLNTSRKGFVPRAEMCRDKDGSILTDGREVIERWKQHYDEHLNGAENTGTEGQDSEGDGYVSTADSGNQPAPTMGEVKDAIQQLKNNKAAGKDGIGAELIKMGPDRLAACLHRLIVRIWETEQLPEEWKQGVICPIYKKGDKLECENYRAITILNAAYKVLSQILFRRLSPIANEFVGSYQAGFIDGRSTTDQIFSVRQILQKCREYQVPTHHLFIDFKAAYDSIDRIELWKIMDENSFPGKLTRLIRATMDGVQNCVKISGEHSSSFESRRGLRQGDGLSCLLFNIALEGVMRRAGLNSRGTIFTRSGQFVCFADDMDIIGRKFETVADLFTRLKREATRVGLMVNASKTKYMLVGGTERDRTRLGSSVTIDGDTFEVVDEFVYLGSLLTADNNVSREIRRRIISGSRAYYGLQKKLRSRKIHPRTKCTMYKTLIRPVVLYGHEAWTMLEEDLQALGVFERRVLRTIFGGVQENGVWRRRMNHELAQLYGEPSIVKVAKAGRIRWAGHVARMPDNNPVKMVFATNPVGTRRRGAQRARWIDQVHQDLESVGHSRGWREAAMNRGNWRNIVGEALSR

SEQ ID NO: 1911 - DNA, 333 bp, Aedes aegypti
  source 1..333: mol_type = unassigned DNA
tgggttgtaaaatggtgagtcgacaaccaggaaggagcgtccaacatagctctggtcctcgcaagtccctacctcacgcttcctcgggtctaacgatgacaaagaccgccagctaagggttgcgtacttagctggtagtgcaacctgggcactgttgtccttctgacatcagctagagtgagggggtgcgtcccgagcgtctgttcaccaggaggtgcggctcaaacagcgtctgttctggtatccagcggctgagtatgaaatgttgtatcacgtcaactaacctaaggtggcagccccatcaacgtgatgtaggtagcgcaaccccggtaa

SEQ ID NO: 1912 - DNA, 55 bp, Aedes aegypti
  source 1..55: mol_type = unassigned DNA
tagattcaacgcaatagcaaggaattgttgcccatcaagtatcaagtaagtaagt

SEQ ID NO: 1913 - protein, 1007 aa, synthetic construct
  source 1..1007: note = Description of Artificial Sequence: Synthetic polypeptide
MGSIPNFSPTTKNGERRNNERYFRQPTWQRNKDYEWKLGTWNVRTLNEPGRASLLARELQKVGVGVAAIQEVRWPRSGEREFRAVDPIANTTFKYNIYHSGGDKAEHGVGFIVIGKQMKRVMKWKPISERICVLRIRGKFFNYSLINIYAPTNDKPDDVKDAFYEGLDKAYGECPKHDVKIVIGDANAQVGREDFFRPIIGKESLHSVTNDNGLRLVTFAAARGMAICSTYFARKDIRKHTWRHPNGDICNQIDHILVDGRHFSDVIDVRSFRGPNIDSDHYLVVSKIRARLSTVANSRPQRTMRFNIQRFSADGVTAEYHQKLDERISEVNVSENLNNLWDAIHGVVSETAREVIGTARRRPRSGWFDEECQRVTDEKNVARRRMLVSGTRLNRERYREARSAEKRIHRRKKKEFDENVIAEAQNCMEQNDMRRFYETVNGVRRKSAPSPVMCNDREGNLLTDKTMVAARWKEHFETLLNGGNDRASENRMNIDNDGQAVEPPSLDEVKKAIKELKNNKAAGKDELPAELLKHGSEQLHRIIHHILLRIWEEEELPASWMDGLICPLFKKGHRLECANYRGITLLNSAYKIMSRILFNRLRPLEESFVGEYQAGFREGRSTSDQMFTLRQILDKFREYNLQTHHLFIDFKAAYDSVKRNELWEIMMEHGFPTKLIRLIRATLEGSKSSIRVADEISTSFVTLDGLKQGDALSNLLFNIALEGAIRRACVHRNGTIITRSYMLLGFADDIDIIGIDRRAVEEAYVPFKRETTRIGLIINTTKTKYMVAGRHRGPIGDVGSEVVIGGDIFEVVEEFVYLGTLVTCDNDVTREVKRRIAAASRAFYGLRNQLKSRSLQTKTKLALYKTLILPVALYGHESWTLKEVDRRAFGVFERKVLRTILGGKLDNGIWRRRMNHELYQVYNEMDIVKRIKHGRLRWAGHVARMSEERQAKQIFSREPGRGRRLRGRPRTRWLFAVEEDLRSLNVQGDWKRLAQDRVQWRRLLHSA

SEQ ID NO: 1914 - DNA, 335 bp, Aedes aegypti
  source 1..335: mol_type = unassigned DNA
tgggctgtgaaatggtgagccgacaactaggaaggagcgtccaacatagctctggtcctcacaagtccctacctcacgcttccacgggtcaaatgatgacaaagaccgccagctaagggttgcgtacttagctggtagtgcagcctgggcactgttgtccttctgacatcagctagagtgaggaggtgcgtctcgagcgtctgtccaccaaggaggtgcggctcaaacagcgtctgttctggcatccagcggctgagtatgaaatgctgtatcacgtcagctacacctaaggtggcagccccaccatcgtgatgtaggtatcgcgaccctggtaa

SEQ ID NO: 1915 - DNA, 46 bp, Aedes aegypti
  source 1..46: mol_type = unassigned DNA
tagattcaacgtagcggattgtagcccatcaagtatcaagtaagta

SEQ ID NO: 1916 - protein, 1007 aa, synthetic construct
  source 1..1007: note = Description of Artificial Sequence: Synthetic polypeptide
MGSISNFLPTTKNGERRNNERYFRQPTWQRNKDYDWKLGTWNVRTLNEPGRVSLLARELQKVGVSVAAIQEVRWPRTGEREFRAVDPVANTAFKYNIYHSGSDKAEHGVGFIVIGKQMKRVMRWKPINERICVLRIRGKFFNYSLINIYAPTNDKPDDTKDAFYDCLDKTYGECPKHDVKVVIGDANAQVGREDFFRPIIGTESLHSATNDNGLRLITFAAARGMAISSTYFARKDIRKHTWMHPNGELCNQIDHVLVDGRHFSDVIDVRTFRGPNIDSDHYLVVSKIRARLSTVANTRTQRPLRFNIQRLSTEGVADEYRRKLDERIRGYNVGENLNNLWESIHGAMSTAAREVIGTAQRRPRNGWFDEECQNVTDEKNVARSRMLVSGTRQNRERYKEARAAEKRIHRRKKRQYEEDIITEAQNSIEQNDMRRFYETVNGVRRKTAPSPVMCNDREGNLLTDKILVAARWKEHFEQLLNGENTSASENRLIISNDGQAVEPPTLDEVRRAIKELKNCKAAGKDELPAELFKHGSEQLYEILHRTLLRIWEEEELPASWLEGLICPLYKKGHRLECANYRGITLLNSAYKIMSRVLFNRLRPLEESFVGEYQAGFREGRSTTDQMFTLRQILDKFREYNLQTHHLFIDFKAAYDSVKRNELWQIMVEHGFPAKLIRLIRATLDGSKSSVRVADETSTSFVTLDGLKQGDALSNLLFNIALEGAIRRAGVQRSGTIVTRSHMLLGFADDIDIIGIDRRAVEEAFVPFQRETARIGLTVNTSKTKYMIAGRQRGSNRDVGSEVVLGGEKFEVVEEFVYLGTLVTCDNDVTREVKRRLAAANRAFYGLRNQLKSRSLQTKTKFALYKTLILPVALYGHESWTLKEVDRKAFGVFERKVLRTILGGKQENGIWRRRMNHELYQVYKEVDIIKLIKHGRLRWAGHVVRMPEERQAKIIFSREPGRGRRLRGRPRTRWLFAVEEDLRALNVQGDWKRLAQDRAQWRRIIHSA

SEQ ID NO: 1917 - DNA, 187 bp, Aedes aegypti
  source 1..187: mol_type = unassigned DNA
accgctagcgcatgacggctcaccatagtagcatgtccgaaagaacttgaaactattgagaaccagagctacaggtccaaagccctgataaaggtggatggttgtgatggctatgaccgtggtcatcatgtaaagaacaagcggacgatgctgtatcgtgtcagcatcgaggaggcagcccctctag

SEQ ID NO: 1918 - DNA, 39 bp, Aedes aegypti
  source 1..39: mol_type = unassigned DNA
tgatgctacgctgtagccatcaaggtatcaaggtaggta

SEQ ID NO: 1919 - protein, 1018 aa, synthetic construct
  source 1..1018: note = Description of Artificial Sequence: Synthetic polypeptide
MHDVGSATLVRWPIEDSSPTKKGKSRANGLILRQQTRQRIKDNDWKVGSWNVRTLNEPARVGLLARELRNVGVNVAAIQEIRWPRTGEREFRAVDPIANTSFKYHIYYSGGDRAERGVGFIVIGKQMKRIIRWKPVSDRICVLRMKGKFFNYSLISIYAPTNDKPDDMKDEFYESLDKAYGECPKQDVKIVIGDANAQIGKEDFFRPVIGTESLHSVTNDNGLRLVTFAAARGMAISSTYFARKNIRKHTWRHPSGDACSQIDHVLVDGRHFSDVIDVRTFRGPNIDSDHYLVVAKIRARLSSVTSSATHRTLRFNIQRLSTDGVAAQYRQQLDEKLGRVNVAGDVDSLWDPIHEAVTTTAREVIGTGQRRRRNDWFDEECQRVTDMKNVARSRMLVAGTRQNRERYRAARAEEKRIHRRKKRQHEESVVADAQESMNRNDMRRFYATVNGARHNTVPVPAMCNDREGNLLTDKTAVAARWKEHFQQLLNGENGNVARNRMNIDDDDQAVDPPTIGEVKKAISELKNCKAAGKDEIPVELLKHGSEQLYQSIHRVLLKVWEDEELPTGWLDGLIRPIYKKGHRLECANYRGITLLNSAYKILSRILFNRLRPLEESFVGEYQAGFREGRSTTDQMFSLRMILDKFREYNLQTHHLFIDFKAAYDSVKRNELWQIMSENGFPAKLIRLIRATLDGSKSSVRIADEVSTSFVTLDGLKQGDALSNLLFNIALEGAIRRSGVQRNGTIITRSHMLLGFADDIDLIGIDRRSVEEAFVPLKRETARIGLTINSTKTKYMVAGRDRVRHGGVSAEVVFDGDVFEVVEEFVYLGTLVTCDNDVSREVKRRVAAANRAFYGLRNQLRSRSLQTETKFALYKTLILPVALYGHEAWTLKESDRKALGVFERKVLRTILGGKLENGVWRRRMNHELYQVYKDANIINRVKYGRLQWAGHLVRMSEERIAKIIFSREPGRGRRLRGRPRIRWLYAVEEDLATLNVRGNWRSFAQDRRRWSSTIRPAMA

SEQ ID NO: 1920 - DNA, 333 bp, Aedes aegypti
  source 1..333: mol_type = unassigned DNA
gggctgcaaaatggtgagtcgacaatcaggaaggagcgtccaacacagctctggtcctcacaagttcctacctcgcgcttccacgggtcaaatgatgacaaagaccgccagctaagggttgcgtacttagctggtagtgcagcctgggcactgttgtccttctgacatcagctagagtgaggaggtgcgttctgagcgtctgtacaccaggaggtgcggctcaaacagcgtctgttctggtatccagcggctgagtatgaaacgctgtatcacgtcagctacacctaagatggcagtcccatcaacgtgatgtaggtagcgcgaccccggtaa

SEQ ID NO: 1921 - DNA, 25 bp, Aedes aegypti
  source 1..25: mol_type = unassigned DNA
tagcccatcaagtatcaagtaagta

SEQ ID NO: 1922 - protein, 1014 aa, synthetic construct
  source 1..1014: note = Description of Artificial Sequence: Synthetic polypeptide
MGSIPNSLSTTKNGERRRNERYFRQPTWQRNKDYDWKLGTWNVRTLNEPGRVSLLARELRKVGVCVAAIQEVRWLRSGEREFRAVDPIANTAFKYNIYHSGGDKAEHGVGFIVIGKQMKRVIRWKPINERICVLRIRGKFFNYSLINVYAPTNDKPDDVKDAFYECLDKTYGECPKHDVKIVIGDANAQVGKEDFFRPIIGKESLHSVTNDNGLRLVNFAATRGMAISSTYFARKDIRKHTWQHPNGELCNQIDHVLVDGRHFSDVIDVRTFRGPNIDSDHYLVVSKIRARLSTVSSSRNRQSLRFNIQRLSADGVAADYHQKLDERISEIDESVNLSDLWESVHGAVSTVAREVVGTAQRRPRNGWFDEECQRMTNEKNLARSRMLVSGTRQSRERYKEARAAEKRIHRRKKKEHEEAVIAQAQEAMEQNNMRRFYESVNGVRRKTAPSPAMCNDREGNLLTDKTMVAARWKEYFESLLNGDNGSGSGSRIQIDDDGQAVEPPTLDEVKKAINGLKNNKAAGKDELPAELLKHGSEQLHELLHRIISRIWEEEQMPTSWLEGLISPLYKKGHRLECANYRGITLLNSAYKIMSGILFNRLRPYEESFVGEYQAGFREGRSTTDQMFTLRQILDKFREYNLQTHHLFVDFKAAYDSVKRNELWQIMSEHGFPAKLIRLIRATLDGSKSSVRVVDEISSSFVTLDGLKQGDALSNLLFNIALEGAIRRAGVQRSGTIITRSHMLLGFADDIDIIGIDRRAVEEAFVPFKRETARIGLTINTTKTKYMIAGGQRGSGRVSGSEMVLGGDKFEVVEEFVYLGTLVTCDNDVTREVKRRIAAASRAFYGLRNQLKSRSLQTKTKLALYKTLILPVVLYGHESWTLKEVDRRAFGVFERKVLRTILGGKLENGIWRRRMNHELYQVYKEVDIVKRIKHGRLRWAGHVARMPEERQAKIIFNREPGRGRRLRGRPRTRWLFAVEEDLRALNVQGDWKRLAQDRAQWRRLIHSAQIHRSEL

SEQ ID NO: 1923 - DNA, 402 bp, Aedes aegypti
  source 1..402: mol_type = unassigned DNA
gggtggtaaatgactggacaatgcgtaccattggtacttcgcgtacctgcaggtataaaatagaccccatttgtggtccttagcctcttgtccagtaactcctatccctacctccccgtggtgccgcctgggatacgagtaaccgtagggaagatcgggtaaccaaccctggtggaaccttggtcgtatgctgacagggaaggggggctcctctcttctgagggtgtagcttatcagagcgtctgttctccatgttaggggcggctcaaaacagcgtctgttctccatgttaggagcggctgatcatcgtcctagtgccagcgtgggactctaaacagtgctgtgcacgatgatcctccggcgagacagggggttggtgcaggccttacaagccagccgtaa

SEQ ID NO: 1924 - DNA, 35 bp, Aedes aegypti
  source 1..35: mol_type = unassigned DNA
tgaaggacgtagagccagcaaaagtaaagtaagta

SEQ ID NO: 1925 - protein, 997 aa, synthetic construct
  source 1..997: note = Description of Artificial Sequence: Synthetic polypeptide
MKSSVQEAYNVNSDRNNRHRPRHRKRTNDWKLGSWNCKSLNFLGSTRILSELLRVRKFDIVALQEVCWKGSTVHTYRDGYTIYQSCGNRHELGTAFIVMGEMQRRVIGWWPIDNRMCKLRIKGRFFNISIINVHSPHLASDDDDKDAFYAQLEREYDGCPSHDVKIVIGDLNAQVGQEEEFRPIIGKFSAHQLTNENGLRLIDFAASKNMAIRSTYFQHSLPYRYTWRSPQQTESQIDHVLIDGRHFSDIIDVRTYRGANIDSDHYLVTVKVRQRLSVVNNIRYRRPPRYNLERLKQPEVATEYAQSLEAALPEEGELTEAPLEDCWSSLKAAINNAAEGAIGFVEANRRNGWFDEECQTVLDEKNAARAMMLQQGTRQNVERYKQKRRQQTHLFRDKKRRLEELECEEMEQLYRSQETRKFYKKLNASRKGFVPRAEMCRDKDGGILTDEREVIERWKQHYDEHLNGAEEEDQDSRRNGFISTADEGDVPTPTIGEVKDAIKQLKNNKAAGKDGIGAELIKMGPDRLATCLHRLIARIWDTEQLPEEWKEGIIYPIYKKGDKLECENYRAITILNAAYKVLSQIIFRRLSPLASRFVGSYQAGFVDGRSTTDQIFMLRQILQKCREYQVPTHHLFIDFKAAYDTIDREELWKIMDENGFPGKLTRLIKATMDSVQCCVKISGALSDPFETRKGLRQGDGLSCLLFNIALEGVMKRAGFNMRGTIFNKSSQFICFADDVDIVGRTFQVVAEQYTRLKREADRVGLKVNTSKTKYLLAGGTERDRARIGRRVTIDGDEFEVVDEFVYLGSLITSDNNCSREIRRRIIAGSRAYYGLHKTLRSGKLHFRTKCTMYKTLIRPVVLYGHETWTMLEEDLQALGVFERRVLRTIFGGVCENGVWRRRMNHELAQLYGEPSITKVAKAGRVRWAGHVVRMPDNNPAKMVFNSNPAGTRRRGAQRARWFDQVEQDLGSVGRSRNWRLAAMDRVSWRNIVAQVMS

SEQ ID NO: 1926 - DNA, 429 bp, Aedes aegypti
  source 1..429: mol_type = unassigned DNA
ggtaaatggctgggcatggcgtaccattggtacctcgcgtacctgaaggaataaaatagacccctttgtgcggtccttagcctcttgcccagcaactcctatccctacctcctcgcggtactggccggggtacgagtaaccttagggaagatcgggtaaccaacccccggtgggaactttggtcgtatgctgacagggaagggggggtttgcttttgcttttgcttctgcaaaccttgagcgtctgtactccatgttaggagcggctcacaacagcgtctgttccccatgtcaggggcggctgatcatcgtccgagtgccagagaaggactctaagctaaactgcgcactatggtcctccgaacatttagggggaatggtcctccggaaatctagggggttggtgtcaggccctgcaagccagccgtaa

SEQ ID NO: 1927 - DNA, 24 bp, Aedes aegypti
  source 1..24: mol_type = unassigned DNA
tagatgttaactaaataaatgaat

SEQ ID NO: 1928 - protein, 983 aa, synthetic construct
  source 1..983: note = Description of Artificial Sequence: Synthetic polypeptide
MKNQATNNQRENTNRDNRRRPQRRKGTSDWKLGTWNCKSLNFIGSTRILADVLKDRGFGIVALQEVCWKGSMVRTFRGNHTIYQSCGNTHELGTAFIVMGDMQRRVIGWWPINERMCKLRIKGRFFNFSIINVHSPHSGSTDDDKDAFYAQLEREYDSCPSHDVKIIIGDLNAQVGQEEEFRPTIGKFSAHRLTNENGLRLIDFAASKNMAIRSTYFQHSLPYRYTWRSPQQTESQIDHVLIDGRHFSDIIDVRTYRGANIDSDHYLVMVKLRPKLSVVNNVRYRRPPRYDLERLKQPDVAAAYAQQLEAALPEEGELDEAPLEDCWRTVKAAINDAAESNVGYVGRSRRNDWFDEECQEVLKEKNAARAVMLQQGTRQNVERYKRKRQQQTRLFREKKRRLEETECEEMEQLCRSQETRRFYQKLNASRNGFVPRAEMCRDKDGSILTDEREVIERWKQHFDEHLNGAESTGNEGRDNGGNAFVSTAEDGNQPAPTLREVKDAIHQLKNNKAAGKDGIGAELIKMGPERLAICLHRLIGTIWETEQLPEEWKEGVICPIYKKGDKLDCENFRAITILNAAYKVLSQIIFRRLSPVVNEFVGSYQAGFVDGRSTTDQIFTVRQILQKCREYQVPTPLGIMDENSFPGKLTRLIRATMEGVQNCVKVSGEHSSSFGSHRGLRQGDGLSCLLFNIALEGVMRRAGLNSRGTIFTRSSQFVCFADDMDIVGRTFEKVADLYTRLKREAAKVGLVVNAAKTKYMLAGGAERDRARLGSSVTIDGDTFEVVDEFVYLGSLLTADNNVSREIRRRIISGSRAYYGLQKKLRSKKIHARTKCTMYKTLIRPVVLYGHETWTMLEEDLQALGVFERRVLRTIFGGVQENGVWRRRMNHELAQLYGEPSIQKVAKAGRIRWAGHVARMPDSNPAKMVFASDPVGTRRRGAQRARWADQVRIDLASVGQNRGWRDAATNRVLWREIVDSVLSV

SEQ ID NO: 1929 - DNA, 640 bp, Aedes aegypti
  source 1..640: mol_type = unassigned DNA
ttagtggctgcttgggcacgtcaggagttaatcatcaatattaacctccttttcccgagcagcctagatagccgcgtagtgtcggtagcggttgtttcaactggctaagaattaacactacggactgcctgttccggtggtaaaagtccacctcacaggtgacccctaatttatggtgtgatgcgtaccgtgcctaagaatgaatggttaggggggtctaaataaaacctaaccgcaaacggagcctgtggggtaccagggcgccctccacagtattgagtccttcctgtgctacccggagcaatggtgcaggtgaccttgtgtttctccgagataatcggctgcccttcttcagtctctatcttgaggcttaataagggtgggattatgaatatgttgacatttaatttaaattatcacctatatggattcgcattatgcgttttacacagtgtattctgtgctctttcgcctttggcgactttaaatagataccgatctggttttttcgttgctggtctttttcgtgctgagattgcaaaaagcttaatcctgcctagtttgggtagtggctacggttaggttagctcagatcaatcttcagcataaaagaacagcaacgatcaatctttgcagactc

SEQ ID NO: 1930 - DNA, 266 bp, Aedes aegypti
  source 1..266: mol_type = unassigned DNA
taggctctctttacgctcatgcgttttgcagtgccctttttagggcgctgttcgaacccattgtggtatggagctacatgctctcatttcgcttatgcgatcttccctcttcaagggaccccactcctatttcctcccatctttcccttccctttcctctcccatcgggtagatgatgaaataggctcaaatatggcgatggcacaaatctcccaactggtggggaacgtgcctttggagccggccttctgatacctgatacctga

SEQ ID NO: 1931 - protein, 1190 aa, synthetic construct
  source 1..1190: note = Description of Artificial Sequence: Synthetic polypeptide
MQNGAAQVALVQEPYFRRGNFYLGNLVDPVFATFSKLEMANSRSMPRACVLVNKAIVATLISELTTRDVCAVTIDVSVGDLNRKYVYCSVYLPHDEPSPTDDFKRVVVHCVTKGLPLIVGSDANAHHIIWGSSDINLRGSSLMEYLSSTDLGLLNIGNRPTFMVSNREEVLDITLCSNRISHELTNWHVSDEESLSDHRYIFFEHSNVTAQTLRFRNPRSTNWELYIELVATKFHGYSPSIENPSDLDDAVDTTTSYIMEAFEEACPLRSVKTTRGTPWWNSDLTRLRKQCRRSWNRRRSAGSESFKSARKAYKKALRSAERSGWKNLCTNVSSLSEVSRLNKILAKSKDFQVNEIRLPNGDFTSSDEEVLECLFNTHFPGCVDIASTDEPNVFSCSYESLASARSIVTTESIQWALNSFAPFKSPGADGIYPVLLQKGFEFIKHVLKKLLVSSFATGYIPKSWRDITVKFIPKGGRASYEEAKSFRPISLTSFLLKCLERIIDHHIRDVYLANMPLHVNQHAYQSGKSTVTLLHKVVYDIEKAFAQKQSCLGVFLDIEGAFDNVSFDAILEAARNHGLPTMITNWIHQMLKNRHLFSTLRQAAIRKLSVCGCPQGGVLSPLLWNLVADTLLRQLNNCGFPTYGFADDYLALIVGMCISTLFDLMQSALQVVESWCRQYGLSVNPNKTSIVLFTERRNRDGIRPLRLFGTEINVTDQVKYVGVILDSKLSWTPHIDFRVKKACMAFGQCRRTFGKTWGLKPKYIKWIYTTVVRPILAYGCLVWWQKGEVRTIQSKLGHLQRMCLMAMSGAFSTTPTAALEALFDVAPLHIYLKQEALSCSYRLWVLDLLEKNPVNRRSTHTSLFPLLVNWDKIVLAPSDLTIACNFPYRTFTTQFPSREEWTSGYLERSISNNIVCYTDGSLLEGRAGAGVYSRELRLNQFYSLGRNCTVFQAEIFALMCGVQSALQQRVMGKVIYFCSDSQAAIKALASANSRSKLVIACRTQIEELNSVNSVNLVWVPGHSSIAGNELADELARDGASHDFIGPEPAIPISKCWVKLQINSWAATQHKQYWNSLESCRQTKLYITEPSPKVAKYLTNLSKQNCSLLVRALTGHCRLNYHMANIQRADSFVCDSCDSDYGTSYHLICNCPVFAQMRFQLLGKHLLSETEYRSLNLQDILLFLTRCGNEL

SEQ ID NO: 1932 - DNA, 297 bp, Aedes aegypti
  source 1..297: mol_type = unassigned DNA
gggctgcaaaacggtgagtcgacaactaggaaggagcgttcaacacagctctggtcctcacaagttcctacctcacgcttccacgggtcaaacgatgacaaagaccgccagctaagggttgcgtacttagctggtagtgcagcctgggcactgttgtccttctgacatcagctagattgaggaggtacgtctcgagcgtctgttcaccaggaggtgcggctcaaacagcgtctgttctggtatccagcggctgagcaagaaatgctgaatcgcgcacagctaaatccaaggtggtag

SEQ ID NO: 1933 - DNA, 18 bp, Aedes aegypti
  source 1..18: mol_type = unassigned DNA
tgactggtaaggtaagta

SEQ ID NO: 1934 - protein, 1041 aa, synthetic construct
  source 1..1041: note = Description of Artificial Sequence: Synthetic polypeptide
MPHQRDRPSVSWDVKQSWHDGAPARQECWRRPNKPPVKNLIANNIGDNTTRNNRQRPTRRNKDYDWKLGTWNCKSLGFAGCDRIIYDELHPRNFDIVALQELCWTGQKVWKSGHRAATFYQSCGTTNELGTGFIVLGKMRQRVIGWQPINARMCKMRIKGRFFNYSIINVHCPHEGRPDDEKETFYAQLEQIYDGCSPRDVKIVVGDMNAQVGREEMYRPVIGRNSLHAVSNDNGQRCVNFAASRGMVVRSTFFPRKDIHKTTWRSPDNLTENQIDHVLIDGKFFSDITNVRTYRSANIDSDHYLVAVCMRSKLSTVTNSRRSRTPRLNIERLRDSEVAQEYAQQLEVALPTEEQLGAATLEDGWRHIRSAIGSTATAALGPAAPNQRNDWYDGECEQLKNEKNAAWARMLQHRTRANEARYKQARNRQNSIFRRKKRHQEERDREAMEELFRAKDTRKFYEKLNRSRKGFVPQADMCRDCDGNLLTNEREVVERWRQHYDEHLNGDVASSGGGTEITLGARADDERLPPPDLQEVETEIRRLKNNKAAGVDQLPSELLKYGGDALARALHWVISKIWEEEVLPEEWMEGVVCPIYKKGDKLDCANYRAITILSAAYKVLSQILCRRLSPIAREFVGQYQAGFMGERATTDQIFAIRQVLQKCREYNVPTHHLFIDFKSAYDTIDREQLWQIMHEYGFPDKLIRLIKATMERVMCVVRVSGTLSSPFESRRGLRQGDGLSCLLFNIALEGVIRRAGIDTSGTIFRKSVQLLGFADDIDIVARNFETMADTYIRLRAEARRIGLNINVSKTKYMIARGSREDTARPPPRVHIDGDEIEVVEEFVYLGSLVTADNDTSREIQRRIVAGNRAYFGLRRTLRSSKVRHRTKLTIYKTLIRPVLLYGHETWTLRAEDQRALGVFERKVLRTIYGGVQMEDGTWRRRMNHELHQLLGEPTIVHLAKIGRLRWAGHVTRMSDTNPVKMVLENNPTGTRRRGAQRARWVDQVEDDLRTLRRMRGWRRAAMDRVEWRRLLRTAEATQALA

SEQ ID NO: 1935 - DNA, 94 bp, Alligator mississippiensis
  source 1..94: mol_type = unassigned DNA
tgacccccagttgtctttcctgcctagtgcagggggctggacccgatgatcttccaaggtcccttccagccttacaatctatgaatctatgaat

SEQ ID NO: 1936 - protein, 981 aa, synthetic construct
  source 1..981: note = Description of Artificial Sequence: Synthetic polypeptide
MGQGFKLRLLGDGETLIGACPGTNTQESPVDRDTRRATLAGAEGIVLPQHDRKSRVSVGGLRCLYTNARSMGNKQEELALLLSSGHYDLVGITETWWDSSHDWSVAIEGYTLHRRDRVGKKGGGVALYVKEQYTSLEADIGSKEGQLETLWVKLWGGGGERDLTVGVYYRPPNQGEELDLEFSRELTEAAHARDMVVMGDFNYPDISWEEHSAKSDQSRSFLTCIEELFLTQEVHGPTRGNALLDLVLAKGDDLVTDLNIEGSLGDSDHETIMFTVHHKADKSDSRIEVLDFKNANFNKLRSLVGEVLWDQGPKVKGVHEEWLFLKDTILEAQRKSIPMQRKGSRRAGKPSWLNREIMVLLRKKKEAYKQWKLGTVPKEDYTTMAHTCREQIRKAKAATELRLATGIKDNKKSFFRYVGNRRKTNGSVGPLLNNSGQLVTDTQEKAELLNDYFASVFHQTKGKIMPGRVQDEHGRNDHLPTIAVELVYDQLEKLDIYKSAGPDELHPRVLKELAEVIAEPLAKLFQNSWCSGEVPEDWKRANVVPIFKKGRREDPGNYRPISLTSIPGKILEKFIKESICDKLAEGKILNDSQHGFIAGRSCLTNLISFYDQVTHHLDKREEVDIVYLDFQKAFDLVSHDVLMRKLEDCGLNCETVRWVGNWLQGRTQRVLVNGSVSSWREVASGVPQGSVLGPVLFNIFINDLDVGVKSSLAKFADDTKLWGSVVTLEDRLQIQADLDRLASWADQNQMKFNVEKCKVLHLGTNNPQHTYRLGGTKLTSTMNERDLGVIIDHSMNMSHQCDAVASRANNTLACINRCISSKTKEVILPLYSALVRPQLEYCIQFWAPHFNKDVEKLERVQRRATHMIRDLQGKPYEERLRDLGLFSLKKRRLRGDLVAAYHYIRGVHQGLGEQLFTRAPLGKTRSNGHKLLEDRFRLNIRKNFFTVRVSRLWNKLPPEVVQSPTLEIFKRRLDSHLAGVT

SEQ ID NO: 1937 - DNA, 667 bp, Alligator sinensis
  source 1..667: mol_type = unassigned DNA
cctgaccgtattatgagggacttcgaggctctggggaccaggctgaaggagacgggggcgcaggtggttttttcctctctccttccggtgagggggcggggacagaggcatgggacctgcattggtgaggtcaaccagcgcttacgcagctggtgccgccgggcaggccttgggttccttgacaacgacccatgctttcgggaggggggattgctggggcgggatgggcttcatctctcccctaatggcaagcgtatcttctcttccaggttggctgatctcgtacggcgagctttaaactagactcgccgggggagggggctgcaggaagacgaggagacgccatcagggcaaggggtgcaaaggtaagtaatgggggtcttgccatcagggcaaggggtgcaaaggtaagtaatgggggtcttgccatcagggcaaggggtgcaaaggtaagtaatgggggtcttgccatcagggcaaggggctgcaggaagatggggggtcgccatcagggcaaggggctgcaaaggtaagtaatgggggtcttgccatcagggcaaggggtgcaaaggtaagtaacaggggtcctgatggtctggctaatcagggggtgggggggcacacagtcttgcaaggccttaaatgcctgtacaccaatgctcgtagc

SEQ ID NO: 1938 - DNA, 130 bp, Alligator sinensis
  source 1..130: mol_type = unassigned DNA
tgagtcccgtttttgtttttagggtgagtggttttgtttgtgtttttgggttgttctcccgccctggcggggggtcgggctagaagatctattaggtcccttccgaccctgaaactatgaaactatgaaa

SEQ ID NO: 1939 - protein, 910 aa, synthetic construct
  source 1..910: note = Description of Artificial Sequence: Synthetic polypeptide
MGNKQEELALRIASSNPDVVGLTETWWDSSHDWAVNIRGYRLYRRDREGRKGGGVALYVKEHYTSSASSMGSGEGRAEVLWVKIQGGQGERDLTVGVYYRPPNQEEELDREFSGQLAETLKARDVVVMGDFNYPDICWEEQSAGTDRSRRFLAELQDLHLIQEVHSPTRGDALLDLVLAAGDDLVRGLQVLDHLGNSDHRVLEFTIQRRVSRARSKVVALDFRRANFSEMRRLVGEELGSLRAEELSVQEEWSFLKETILGAQGVSIPTRSKAGRSVQKPPWLTKGVRECLLAKRVAYARWKGGVISKEEYTSSARACRRAVRKAKAEIELGLASRIKDNKKSFFKYIGRMKKAPGNVGPLQDMRGNLVVASEDKADLFNQFFTSVFLCRDRDFPAVIEAGREGIAFRPQVGEDRVRELLEGLDAFKSAGPDALHPRVLRELAGVIAGPLARLYERSWCLGQVPDDWKVANVVPIFKKGKREDPGNYRPVSLTSILGKLFEKIIKEHICDGPASEMMLRGNQHGFIRGRSCQTNLIAFYDQVTKAMDAGVAVDVVFLDFSKAFDTVSHPILINKLGDCGIDAYTVRWIADWLKGRTQRVVVDGSYSTWGEVGSGVPQGSVLGPALFNFFISDLDVGVESNLFKFADDTKIWGEVSTLAGRERLQKDLDRLQGWANRNRMCFNTDKCRVLHLGSRNQQHTYTMGSSLLESTEAERDLGVIIDSKMNMGRQCEVMVGRANRTLSCIHRCISSRAREVILPLYATLVRPQLEYCVQFCAPHFRRDVDNMERVQRRATRMIRGQQGRPYSERLRDLNLFSLHKRRLRGDLVTVYKLTRGNQKGLGETLFPLAPAGITRNNGHKLMERRYRLDIRKNYFTVRAARSWNQLPREVVLAPTLGIFKKRLDTYLAGLI

SEQ ID NO: 1940 - DNA, 1050 bp, Anolis carolinensis
  source 1..1050: mol_type = unassigned DNA
gagaggcctgctgttgtgctgcagaagaggccagaaacatctccagccagcctgcctgttgctgcctctgggactccttgtgagtagactgcagccccaggccctttccatctgggtgtgactcagcacttcctaggaaggaccatctataaagcctgagtccacaaggccctggcagggctgagaggcctgctgttgtgctgcagaagaggccagaaacatctccagccagcctgcctgttgctgcctctgggactccttgtgagtagactgcagccccaggccctttccatctgggtgtgactcagcacttcctaggaaggaccatctataaagcctgagtccacaaggccctggcagggctgagaggcctgctgttgtgctgcagaagaggccagaaacatctccagccagcctgcctgttgctgcctctgggactccttgtgagtagactgcagccccaggccctttccatctgggtgtgactcagcacttcctaggaaggaccatctataaagcctgagtccacaaggccctggcagggctgagaggcctgctgttgtgctgcagaagaggccagaaacatctccagccagtctgcctgttgctgcctctggactccttgcctactgcccccctccctttttcccagcgctggtgagtggacataagaagggagggaagacttttaaaactccaaagccatccggaggaagaaggcagaggaactgactttaaaatcattctgtctcttgctgcaggcctactgccctcctcgctttccccagcattggctattgaactaagagtctgtcttactgaggtccactcattatttatatattgctgctataacaatctttaaatgctgttataataactattatgcactgtgaagcctggtccccctgactagtttactaagtctatcatctctaattggtcctgccctggcaccttataataccatattgcaccatattgaattagttcaccatcataatccccactgcctgccttgcactttagtcagctcagacccctatacct

SEQ ID NO: 1941 - DNA, 250 bp, Anolis carolinensis
  source 1..250: mol_type = unassigned DNA
taagaatatatgacctcaactgacagacccagtcacatgaacatggaaagcgccttaaatgtatatttaaatgtataattatgtatattttaatggctattcttaattttattgtaatttttaatcttgatggatttttaaatttgatgaaaactgtttttaatgtgtatggttatactgtaagccgccctgagtcccctgatgggtgagaagggcggggtagaagtgatgtaataaataaataaataaa

SEQ ID NO: 1942 - protein, 1077 aa, synthetic construct
  source 1..1077: note = Description of Artificial Sequence: Synthetic polypeptide
MLLMHPLHFTTAFALCIVGGGWGRLEGYGDCRVGEGNGCERMPIYNRKLVNQITSFGPGEEKGKGQCDRGGGCSDGWGAPIEVVSGRGRYGKGRPNHLIRPRVFGRTLIVPKRSPDIANLGSQDGGPSRLKVVLFNARSVNGKTSFIQDLILDEHVDLACITETWLDEMGGVNLTQLCPPGYSVQHQPRSGGRGGGVAVVYKDSIPLTRCPVPQSTMFECVHLRVGDRDRLGILLVYRPPRCTTVSLPELAEVVSGLALESRRLIVLGDFNVHAETNLSGAAQDFMAAMATMGLSQLVTGPTHSAGHTLDLVFCQGWEEGGGVEELTIAPLPWTDHHLIRFRLTAPPNLCRGGGPKMVRPRRLMDPEGFLTTLGEFPASSAGDPVDALVSLWNGEMTRAIDTIAPERPLSSNRAKPAPWFTEELAAMKRKKRELECVWRSGYNESDRTRLGSYLRAYAAAIKAARRAHLAANIASAQNRPAALFRVIRGLLTPTNQGGSPDNSAARCEAFARFFADKVALIRSDFDTILTAVSEDVTSAPACPVLLDSFQLVELEDVDKILGEARPTTCILDPCPSWLVREARGGLAEWVKVVVNASLREGKFPASLKMAVIKPLLKKPSLDPTQFGNFRPISNLPYLGKVLEHVVASQLQGFLVDTDFLDPAQSGFRPGHGTETALVALVDDLRRELDRGSVSLLVLLDLSAAFDTVDHGILLGRLAGMGLGGTVLQWLHSFLEGRSQMVSLGDACSAPQPLTCGVPQGSVLSPMLFNIYMKPLGEIIRSFGVRCHLYADDVQLCHSFPPVTKEAVQVLNRCLAAVSDWMRANKLKLNPDKTEVLLVSRKAEQGTGLQPVLDGVTLPLKAQVRSLGVILDSSLSLEPQVSAVARGAFAQLKLVRQLRPYLGKPDLATVVHALVTSRLDYCNALYVGLPLKTVRKLQLVQREAARLITGAAYRERTTPLLRQLHWLPISYRAQFKVLALAYKALNGSGPAYLSERVSRYDPPRSLRSSDEALLAVPSASQVRLAGTRDRAFSVVAPRLWNALPIEVRQAPSLLSFRKRTKTWLWDQAFEHESAAKMR

SEQ ID NO: 1943 - DNA, 1034 bp, Anolis carolinensis
  source 1..1034: mol_type = unassigned DNA
ccccctcgatggattgtcaccttgccgtggtgagggggcttgcgtgttccgatgaacctgtgggcacaaccactggagtgatgcactcccaggagtggccgcaggggaggttccagaccaagcacaatccgaagacccaaagacctcaacggcggagcaggcggaggataacatggtacatgttacaacggctgtgaaggcggaagaaggctgcaacagactgagaagccactgtcgttgtgttaaccacaccactgctggaacctcactctgtgaagactgtgtgttgaccggccgtgcaccgacctccacacattaaaaaaaaatcacgcacaggcgtcttccaacaaaaataaaaacaaacctacaaaagtcccatggcgatcagcgagtggcgacgggggcaggactgtgaaatctggaagcccctagtcacagactggcacatgggcggtggatatggactcagtcgttctacctcaaggaccgaggcagttgagtagtccggcagctgtatccatgactgagcagccctttttaggatccgctctgctcaccccacacggggaaggggctagaaaaggtgccctaaacatagtctgcctctcctaccctgactggactgccgcgtccagaggggtcaccactctgcggccaaaaaagaaaaatgaactttggaacatggaacgtacggacattgttagataacactgacagcgaacgccccgaacgcaggactgctctcattgcaagggagctgggacgctttaagatcgacatagcagcccttcaggagacccggagagcaggagagggacagctgaaggaagaaaagggaggctacaccttcttctggaagggactgcctgaagaagagcgaagaatacacggagttggctttgctatcagaaacgacctggtgaagcacctgactgaagcacccactggcatcaacgaacgactttcaaccctccgaattaaccttgccaaaaaccaacaggcaaccatcatatgcgcctatgcaccaactctag

SEQ ID NO: 1944 - protein, 957 aa, synthetic construct
  source 1..957: note = Description of Artificial Sequence: Synthetic polypeptide
MLTKTSRKIFYCQLDTILSEIPKEDKIILLGDFNARVGRDSDLWPGIIGKDGVGNSNSNGILLLTKCGEHNLVITNTLFRQKNKLKTSWKHPRSKHWHLLDYVITRARDRRDVLLTRAMTGTDDCWTDHRLIRSTMAIKIVPKRRLQGRKTRRKMNTQALQEPSKRALLQTTLKDHLPTEHPENVEEHWNKLKTSIITACEESIGYLTKKHQDWFDDNDKEIQQLIDNKRKAFQTWQRDTNCAAKKKIYASAKAEVQRRTRELKNIWWTKKAEEIQHLADTHDAQGFFKATKIIYGPRNHGIQPLRSSDGTKILKDKTSIALRWKEHYQNLLNRSSNVAEETLSQIPQQQTRDELAALPSLEEVSNAISQQKNNKASGPDGIPAEIFKEGGPELIQQLHQLIEKVWMTEKIPADFKDATIITLFKKGDRTDCGNYRGISLLTSAGKILARILANRLLPVSEDTLPESQNGFRPSRGTVDMIFTARQLQEKCREQNQPLYMAFIDLAKAFDTVNRSALWTILQKIGCPDKFVNILRLLHDDMMATVLDSNGSQSDPFKVESGVKQGCVIAPTLFSIFIAMILHLVDGKLPTGVEIIYRTDGKLFNLSRLRAKTKVTTTSVIELQYADDNVVCAHSEEDLQATLNTFAEAYEKLGLSLNIEKTKVLFQQAPANPSAKPGIQLNGVTLENVDHFRYLGSHLSTKVNIDTEIQHRLSSASAAFFRMKQRVFDDRDIRRETKVLVYKAIVLPTLLYACETWTVYRRHTKLLERFHQRCLRKILQISWEDRRTNVSVLEEAKTTSIEAMLLRHQLRWTGHVVRMPDHRLPKQLLYSELKNGKRNVGGQEKRFKDGLKANLKNCGIDTENWEALALERSNWRSAVTSSAAEFEEARTEGLREKRAKRKERQANPDRDRLPPGNRCPHCGRICGSRIGLFSHLRTHAQDTKVGRPSSSNYEGSPK

SEQ ID NO: 1945 - DNA, 109 bp, Anolis carolinensis
  source 1..109: mol_type = unassigned DNA
gggggacacggaaagagcctccccgaagattgagtgaattcagtcgggcgtcccctgggcaacgtttcttgtaagcggccgatctttccaccccaaaagcattggatga

SEQ ID NO: 1946 - DNA, 91 bp, Anolis carolinensis
  source 1..91: mol_type = unassigned DNA
tagttgcttgtgatttcttttcttttttattttatttccattatttgaaatgtatttgttgtagcaatgcttttgacacgaaataaataaa

SEQ ID NO: 1947 - protein, 982 aa, synthetic construct
  source 1..982: note = Description of Artificial Sequence: Synthetic polypeptide
MDEYQRSLSRPLLTIMSINIEGLSLAKEELLAKMSEDISCDILCIQETHRDITMRRPKILGMQLAVERPHRQYGSAIFVRSGVAISATSLTEVNNIEILSVELDSCTVSSLYKPPGADFYFTPPTSCHNHEAHFVVGDFNSHSCVWGYDEDDRNGEAVLTWADNSRMSLLHDSKLPPSFNSGRWKRGYNPDLIFVKESISHQCTKRVLNPIPNTQHRPICCVAYAAVRPKSVPFRRRYNFNKANWTKFTETLEAAISDIEPSIENYDLFVEAVKRSSRLSIPRGCRTSYLPGLNEESLNQLQEYLRLFQENPYSDGTIAAGQKLSTALANAKKDRWIELLENLDMSKSSRKAWQLLRRLDSDPLVNPGHANVTPDQIAHQLIQNGKTNCSRIKMKINRVPELETHQLSSPLNLKELREAIKRCKTGKAPGLDDLMMEQIKHLGPKAENWLLKFYNQCLAHKQIPRAWRKTKIIAILKPGKDASNARNYRPISLLCHLYKVYERMLLNRLGPVIEPKLIAQQAGFRPGKNCTGQILHLTEHIEEGYEKGCITGTVFVDLTAAYDTVQHRKMLHKVYHITRDFDFTKTVQTLLENRSFYVEFQGQKSRWRRQKNGLPQGSVLAPTLFNIFTNDQPQPPLTKSFIYADDLGLTTQAKDFETVEKQLTNALKDLSSYYKENHLKPNPAKTQVCAFHLRNREANRKLKVTWEGQELEHCFHPKYLGVTLDRTLTYRKHCMNTKHKVAARNNILRKLTGSAWGADPQVIRTSALALSFSTAEYACPVWHKSAHAKQVDIALNETCRIITGCLKPTPVDKLYKLAGIAPPDVRREVAANGERKKVEHCESHPLHDYHPPPTRLKSRKGFMRTTTPLDVPPATARVSLWAAKPGNSNWMAPQEGLPPGANQEWATWKSLNRLRSGVGRSKDNLARWHYLEESSTLCDCGAEQTTQHMYACPQCPASCTEEELFKATDNAVAVARFWSKTI

SEQ ID NO: 1948 - DNA, 372 bp, Anopheles gambiae
  source 1..372: mol_type = unassigned DNA
tgctctgtaatgggatgggatccgaagccccattgagggataatacaggctctcccatccaactcctattccgacacgtcctcgtcgtgcagagtggtaacatgtgtcaccacatatccaagcttgggtacacgggcttgacccaaccccttgggcggatggtggcacatggcgaaccaggaggggggtgggtatcccgggaaactgggtgcctgaacgtcgggggggcaacccgacgctaaacaaaacggtcacgtgggcgcagggccagtcacccagtcccatgaatcaacgactacggaaagcaccagaaatattcgaaacggacttaacgataccgaccctacgcaatgcccccggactactctgaaa

SEQ ID NO: 1949 - DNA, 26 bp, Anopheles gambiae
  source 1..26: mol_type = unassigned DNA
tagcgccggataagtaagtaagtaag

SEQ ID NO: 1950 - protein, 972 aa, synthetic construct
  source 1..972: note = Description of Artificial Sequence: Synthetic polypeptide
MGSWNVRTLSEAGALKKLDDALATLSMDLVALQEIRWLGNGVHNRRGKHCYDIYYSCHDRHRVLGTGFAVGPRLKPAIMDFKAINDRLCTLRMRGKFFNISLINVHAPTEDKEEEEKDLFYGRLARIVDACPRHDLIIILGDFNAKVGREPMYRQYTGCHSLHEHSNDNGSRLVQFAAANNLVVGSTKFARKKIHKITWAHPGGESFNQIDHVLISRRRQSSLLNVRTYRGANIDSDHYLVGLVIRCRIARPRANGGGENTQARLNTDSLRDIAVQQEFKTALEESLLPEDRYETTSERWNALKTKIINCARNILPPRRGNTKSGWFDDECRQVTERKNTAYRAMQQRHRTRACAEEYSRLRREEKRVHRSKKHALEEQNMRELEQTREAYGPTRKFYQAIAGHRNNVVPKVTCCRNKDGDLVSNQPEVLSRWAQYFDELLNDQFSEQLEAPLADNVMLLPPSIEETRKAIRRLKNNKAPGTDGIAAELVKNGGARLENEIHQIVTEVWDSESMPCDWNLGIIYPIYKKGDRLDCNNYRGITVLNTAYKIFSLILQDRLVPHVEEIVGNYQRGFRNGKSTTDQIFTMRQILEKMAEYRNDTYHLFIDFKAAYDSIARVKLYDAMSSFGIPAKLIRLVRMTMTNVTCQVRVDGKLSGPFATTKGLRQGDGLACLLFNLALERAIRDSRVETTGTIFYKSTQILAYADDIDIIGLRLSYVAEAYQGIEQAAENLGLQINEAKTKLMVATSADLPINNPNLRRRDVQIGERTFEVVPEFTYLGSKVSNDNSMEVELRARMLAANRSFYSLKKQFTSKNLSRRTKLGLYSTYIVPVLTYASETWTLSKSDEALLAAFERKMLRRILGPVCVEGQWRSRYNDELYEMYGDLTVVQRIKLARLRWAGHVVRMETDDPARKVFLGRPQGQRRRGRPKLRWQDGVEASAIKAGITDWQTKARDRERFRTLLRQAKTAKRL

SEQ ID NO: 1951 - DNA, 213 bp, Aplysia californica
  source 1..213: mol_type = unassigned DNA
tggctggagctaatgctcctggtagggccacccatgccagacaggtcgacgggtagaggtcagacatagcgtgatccaccggccctccaggtttcggaggttcagctcagggctagcgacccagactggtaaaaagcatatgttacggaaacagcaacaaagagaaaccatatttctgtgtgtgttggaccttcagagtcgcttgtgactcgt

SEQ ID NO: 1952 - DNA, 18 bp, Aplysia californica
  source 1..18: mol_type = unassigned DNA
tagtaagtaaataagtaa

SEQ ID NO: 1953 - protein, 999 aa, synthetic construct
  source 1..999: note = Description of Artificial Sequence: Synthetic polypeptide
MNAGSESRQEAVCRKIEDLNTAKTKVIIGLWNVKTLYGTGKSAQVTAEMRRYGLHVLGISESQWTGSGWLRTATGETLIYFGREDNQHREVVATILNKGLEKCLMEWKPINSRMMTLRLKGKHTNTSIIQCYAPTNDSEDESKDYFYEELQRGLTGIPRHDLIVVMGDLNVKVGEDNTNYERTMGQHGMGTRNENGERLVDFCALNNLVIGGTLFPHRTIHNLTWNSPNGRDKNQIDHLMIGGMLRRSLQDVKVRRGADVGSYHHLVTSRIKFKLKKTFTREATRTQFNIQKLSDGNVTSAFRLELKNRFQALQDLEETTPNTDEVNTQWKLIVEAYTESSKTCLGVKKKNASNEWIQQGTWNIIEERREIRKRELAAKSIRLQEKYAEDYKEVCQKVKRLVREDKREAMENLATETEEAAAKGEQGNVYKITRIICGKYHGGMSGPIKGKIGRLLTIEKEQEARWPEHFREVLNQPPPEDTPDIQEATLNLDISSDPPQRHEVVKAVKSLKEGKSPGMDNLNAELFKVDPELTTTILQPLFKTIRKGEQITEDWRTGVIVKVPKKRALGDLNNWTGITLLSVASKILAKIIINRMSDAVDICLRKEQARLRKERRCTDQIFALRNITEQCTERQRQLYVNVVDFEKVFDGVHRESLWCILRSYGIPGKIVEVIKSFYQSFKHVVGNRTTAFEVKTGVRQGCNMSAIMFNLAIDWVMRKTTEDTSRGIRWTLFSTFEDLDLVDDLAQLSHTNQHMKEKTNPLHKYERHIGLRISQKKTEMMTLNVSSPTLIMENNAHLPITDKFTHLGSINKTDGGTKEDIMNRLGKERSVHRSVINIWKSEQFSIQTTLKQYNSCVLSTLLYGFECWRKTGHDRAKQSSFHTTSLRQILRIFWPDNISNTDLLQKWRQEDRTTIIKRRRWRLIGHVLRREPDSVVKTAFHWTPEGHRKRGRPKVTWRRKVESEMKSWNHSWGTLTKLGQNRQSWRSFVAARNSRWRNG

SEQ ID NO: 1954 - DNA, 690 bp, Bos taurus
  source 1..690: mol_type = unassigned DNA
gcgcaggcggctgcgacgggcgcactaagcgcggccgagaggagctaccccacgtccgaggtcaggggcagaagccgggaggaccccatgcccgaagggcggcggccaagaggagttaccccacgtccgaggtcaggggcagcggccgagagtgccagactgcgacggcgcaggaacggccgagaggagctaccccacgtccgaggtcaggggcggcggccgagaggagatacccagcgtccgaggtcaggggcggcgacgagaggagttaccccgcgtccgaggtcaggggcggcggccgggaggagctaccccacgcccctaagcccgaggccaggggcggcggccgggaggagcaaccccacgcccgaggccaggggcggcggccgggaggaccaaccccacgtccaaggagccgtggctgcgcgggcgcaggagggcctagaggagctatcccacgttgaaggtcaggaagggcggcggtgaggagatacccctcgtccaaggtaaggagcagtggctgcgctttgctggagcagccgtgaagagataccccacgcccaaggtaagagaaacccaagtaagacggtaggtgttgcaagagggcatcagagggcagacacactgaaaccatactcacagaaaactagtcaatctaatcacactaggaccacagccttgtctaactca

SEQ ID NO: 1955 - DNA, 13 bp, Bos taurus
  source 1..13: mol_type = unassigned DNA
tgaactgaactga

SEQ ID NO: 1956 - protein, 1048 aa, synthetic construct
  source 1..1048: note = Description of Artificial Sequence: Synthetic polypeptide
MKLSHARGATQDGRVMVERSDRMWSTGEGNGKPLQYSCLENPMNSMKRQNDRILKEELPRSVGAQYATGDQWRNNSRKNEGMEPKQKQYPAVDVTGDRSKVRCCKEQYCIGTWNVRSMNQGKLEVVKQEMARVNVDILGISELKWTGMGEFNSDDHYIYYCGQESLRRNGVAIMVNKRVRNAVLGCNLKNDRMISVRFQGKPFNITVIQVYAPTSNAEEAEVERFYEDLQDLLELTPKKDVLFIIGDWNAKVGSQETPGVTGKFGLGIRNEAGQRLIEFCQENALVITNTLFQQHKRRLYTWTSPDGQHRNQIDYILCSQRWRSSIQSAKTRPGADCGSDHELLIAKFRLKLKKVGKTTRPFRYDLNQIPYDYTVEVRNRFKGLDLIDRVPDELWNEVRDIVQETGIKTIPMEKKCKKAKWLSGEALQIAVKRREVKSKGEKERYKHLNAEFQRIARRDKKAFLSDQCKEIEENNRMGKTRDLFKKIRDTKGTFHAKMGSIKDRNGMDLTEAEDIKKRWQEYTEELYKKDLHDPDNHDGVITDLEPDILECEVKWALESITTNKASGGDGIPVELFQILKDDAVKVLHSICQQIWKTQQWPQDWKRSVFIPIPKKGNAKECSNYRTIALISHASKVMLKILQARLQQYVNRELPDVQAGFRKGRGTRDQIANIRWIMEKAREFQKNIYFCFIDYAKAFDCVDHNKLWKILKEMGIPDHLTCLLRNLYAGQEATVRTGHGTTDWFQIGKGVRQGCILSPCLFNLYAEYIMRNAGLEEAQAGIKIAGRNINNLRYADDTTLMAESEEELKSLLMKVKVESEKVGLKLNIQKTKIMASGPITSWEIDGETVETVSDFIFLGSKITADGDCSHEIKRRLLLGRKVMTNLDSIFKSRDITLPTKVRLVKAMVFPVVMYGCESWTVKKAERRRIDAFELWCWRRLLRVPWTARRSNQSILKEISPGISLEGMMLKLKLQYFGHLMRRVDSLEKTLMLGGIGGRRRRGRQRMRWLDGITDSMDVSLSELRELVMDREAWRAAIHGVAKSRTRLSD

SEQ ID NO: 1957 - DNA, 2736 bp, Choloepus hoffmanni
  source 1..2736: mol_type = unassigned DNA
gaggcggggcaagatggcggagtggtgaggtgtatgttttagttactcctccagggcagtaggtagaaagccaggaactgcgtggactggacaccgcagagcaatttgactttgggcatacttcatacaacactcatgaacacgtggaacagctgagatcagcgaaatctgtaagtttttgtggccaggggacccgcgcccctccctgccaggctcagtcccgtgggaggaggggccgtcagtgctgggaacgaggagggagaactgcagttgcagctcttattggaaactcattctactgatccaaactccaaacatagatagactgagaccagacaccagagaatctgggagcagccagcccagcagagaggagatagggatagcaaaaacagcaaagaaaaacccaaaaataaaagcagagactttttggagttctggtgaacatagaaaggggaagggcagagctcaggcagagtcaggctcatatgcaaatccagagggcgagtttccttgtctgaaaagctggtttctctgctctctggatcgttccttaatggccctaatctccttgtctcttagcatttcaatagcccattagatctgcaaggagggcccttctttttcttcttttttttttttttaatctttttctctttttctaaaacaattactctaagaagcccaatacagaaagcctcaaagacttgcaatttgggcaggtcaagacaagagcagaactaagagagctctgagacacaaggcaataagtccagtggctgagaaaattcactaaacaccacaacttcccaagaaaaggggggcgtcccctcacagccatcttcctggtgggcagggaacactcctgcccggcgccagccccacagcccagagctgccccagacaacccagtgtgacgggaagtgtttccaacaacacacgcacacaccacaaaattgggcatggacattagcctttcctgcaccctcagctgattgtcccagagttgggaaggtggagcagtgtgaaaagggggaaattaacacgccccattcagccatcctttcagcagactgggaacctccctacacagccctgcagcccagaacctccctggggggacggcactcacctgtgacatagcacagtcatccctcaacagaggacctgggggtgcacggcctggaagagggacccactcgcaagtctcaggggccatacgccaataccaaggacttgtgggtcagtggcagagacaaactgtggcaggactgaactgaaggattagactattgcagcagctttaaatctccaggaacaccagggagatttgattgttagagccgccccccctccctgaccgcccagacacacgccccatatacagggcgggcaacaccaactacacacgcaagcttggtacaccaattggaccccacaagactcacacccccactcaccacaaagacaaagtgggggagaactggcttgaggggaataggtggctcgtggatgccacctgctggttagttagagaaagtgtactccacgaagctgtagatctgacaaattagagataagggtttcaatcggtctacaaatcctaaaagaaccctatcaagttaagcaaatgccaagaggccaaaaacaacagaaaattttaaagcatatgaaaaaaccagacgatatggataacccaagcccaagcacccaaatcaaaagatcagaggagacacagtacttggagcaattaatcaaagaactaaagatgaacaatgagaccatggcacaggatataaaggacatgaagaagagcatggcacaggatataaaggacatcaagaagaccctagaagagcataaagaagaaattgcaagagtaaattaaaaaaatagatgatcttatggaaattaaagaaactgttgaccaaattaaaaagattctggatactcatagtacaagactagaggaagctgaacaacgaatcagtgacctggaagatgacagaatggaaaatgaaagaacaaaagaaagaattggggaaaaaaattgaaaaaatcgaaatggacctcagggatatgatagataatataaaacgtccaaatataagactcattggtgttccagaaggggaagagaagggtaaaggtctaggaagagtattcaaagaaattgttggggaaaacttcccaaatcttctaaacaccataaatacacaaatcataaatgcccagcgaactccaaatagaataaatccaaataaacccactccgagacatattctgatcacactgtcaaatacggaagagaaggagcaagttctgaaagcagcaagagaaaagcaattcaccacatacaaaggaaacagcataagactaagtagtgactactcagcagccaccatggaggcgagaaggcagtggcatgacatatttaaaattctgagtagagaaaaattgccaaccaagaattctttatccagcaaagctctccttcaaatttgagggagagcttaaatttttcacagacaaacaaatgctgagagaatttgctaacaagagacctgccctacttgagatactaaagggagccctacagacagagaaacaaagaaaggagagagagatacatggagaaaggttcagtactaaagagattcagtatgggtacattaaaggacattaatagagagagggaaaaaatatatatctgacaaacataaaccaaaggataag

SEQ ID NO: 1958 - DNA, 1975 bp, Choloepus hoffmanni
  source 1..1975: mol_type = unassigned DNA
caatagtacagacagcccaattataaaatgggcaaaagatatgaaaagacagttctctgaagaggaaatacaaatggccaagaaacacatgaaaaaatgttcagcttcactagctattagagagatgcaaattaagaccacaatgagataccatctcacaccaattagaatggctgccattaaacaaacaggaaactacaaatgctggaggggatgtggagaaattggaactcttattcattgttggtgggactgtataatggttcagccactctggaagtcagtctggcagttccttagaaaactagatatagagttacccttcgatccagcgattgcacttctcggtatatacccggaagatctgaaagcagtgacacgaacagatatctgcacgccaatgttcatagcagcattattcacaattgccaagagatggaaacaacccaaatgtccttcaacagatgagtggataaataaaatgtggtatatacacacgatggaatactacgcggcagtaagaaggaacgatgtcgtgaaacatatgacaacatggatgaaccttgaagacataatgctgagcgaaataagccaggcacaaaaagagaaatattatatgctaccactaatgtgaacattgaaaaatgtaaaacaaatggtttataatgtagaatgtaggggaactagcgatagagagcaattaaggaagggggaacgataatccaataagaacagataagctatcgtgggtaaatttaacgttctgggaatgcccaggaatgactatggtctgttaatttctgatgggtatagtaggaacaagttcacagaaatgttgctatattaggttactttcttggggtagagtaggaacatgttggaagtaaagtagttatcttaggttagttgtctttttcttactcccttgttatgagtttgtttgaaatgtttttttattgtatgttttttttaaaattttttttatatagttgatttaaaaaaaaagttaatttaaaaaaaaaaaaaacaatgaaaaaaatatgcagagcccccttgaggagctggtggagaatgcaggggtattgggcttccccacctcgatggttgctgatgtgctcacagacataggggactggtggtttgatgggttgagccctctaccacaggacttgcccttgggaagactgttgctgcaaaggagaggctaggcctccctataattgtgcctaagagcctcctcccgaatgcctctttgttgctcagatgtggccctctctctctagctaagccaacttggcaggtgaaatcactgccctcccccctacgtgggatcagacacccaggggagtgaatctccctggcaacgtggaatatgactcccggggaggaatgtagacctggcatcgtgggatggagaacatcttcttgaccaaaagggggatgtgaaaggaaatgaaataagcttcagtggcagagagattccaaaaggagccgagaggtcactctggtgggcactcttacgcacaatatagacaaccctttttaggttctaatgaattggagtagctagcagtaaatacctgaaactatcaaactacaacccagaacccatgaatcttgaagacgattgtataaaaatgtagcttatgaggggtgacaatgtgattgggaaagccatatggaccacactcccctttgtctagtttatggatggatgagtagaaaaatgggggaaggaaacaaaaaaacaaacaacaaaggcacccagtgttcttttttactttaattgctctttttcactttaattattattcttgttatttttgtgtgtgtggtaatgaaggtgtcagggattgattttggtgatgaatgcacaactatgtaatggtactgtgaacaattgaatgtacgctttgttttgtatgactgcatggtatgtgaatatatctcaataaaaatgaattaaaaaaaaaaa

SEQ ID NO: 1959 - protein, 1063 aa, synthetic construct
  source 1..1063: note = Description of Artificial Sequence: Synthetic polypeptide
MADSRNAFTVITLNVNGLNSPIKRYRFAEWIKKNEPSICCIQETHLRHRDTKKLKVKGWKKIFHASYSQKKAGVAILISDKIDFKCKDVMRDKEGHYILIKGAIQQEEITIINVYAPNQGATKYMRQTLAKLKEAIDVSTIIVGDFNTSLSPIDRSTRQKTNKEIENLNNLINELDLTDIYRTLHPKSPGYTFFSSAHGTFSRIDHMLGHKTSLNKFKKKIEIIQSTFSDHNGIQLEVNNHQRLRKFTNTWRLNNTLLNNQWVKEEIAREIAKYIETNENENTTYQNLWDAAKAVLRGKFIALNAYIKKEERAKIKELMDQLKKLENEQQTNPKPSRRKEITRIKAEINDIENKKTIERINNTKSWFFEKINKIDKPLARLTKSKREKTHINKIMNEKGDITADPEEIKKIIRGYYEQLYANKLDNVEEMDNFLETYEQPRLTREEIEDLNQPITSKEIQSVIKKLPTNKCPGPDGFTGEFYQTFQKELTPILLKLFQNIEENGTLPNSFYEANINLIPKPGKDATKKENYRPISLMNIDAKILNKILANRIQRHIKKIIHHDQVGFIPGMQGWFNIRKSINVLQHINKSKEKNQMIISIDAEKAFDKIQHPFLIKTLQKVGIEGNFLNMIKSIYEKPTASIVLNGERLKAFPLRSGTRQGCPLSPLLFNIVLEVLARAIRQDKEIKGIQIGKEEVKLSLFADDMILYLENPEKSTIQLLELINKFSKVAGYKINAHKSVMFLYARNEQTEETLKKKIPFSIATKKIKYLGINLTKDVKDLYKENYITLLKEIEGDLKRWKNIPCSWIGRLNVIKMSILPKLIYRFNAIPIKIPTTYFADLEKLVIKFIWKGKMPRIAKDTLKKKNEVGGLTLPDFEAYYKATVVKTAWYWHKDRHIDQWNRIENSEIDPQIYGRLIFDKAPKVTELGHNSLFNKWGWESWISISKRMKEDPYLTPYTKINSKWIKDLNIKDSTIKLLEDNVGKHLQDLVLGGHFLDFTPKAQATKEKIDKWELLKLRSFCTSKEFVKKVKRQPTQWEKIFGNHVSDKRLISCIYKQRNPTTQ

SEQ ID NO: 1960 - DNA, 15 bp, Clonorchis sinensis
  source 1..15: mol_type = unassigned DNA
tagtcggcgagctga

SEQ ID NO: 1961 - DNA, 337 bp, Clonorchis sinensis
  source 1..337: mol_type = unassigned DNA
tgaatgtacattcttgccattgaatctcacaccagacccagtatgacggacactttgtgcctgatgtgcgagtcttgactgtgctagcgcttaccgcgccttgaagagcattcagcattgtttgtcctttcttcggttgttagactttacacgcatgtttccttaccaaaattcttacgtacgttgggattcatcctatctgactggaactgttggttgcatgacttcgaatgagacatttctttcttttatctcatattctcctgtaaccctttcgcattcatcgcttgcattcactttttatgtctgtgaccatgctcttcaaaaataaacgata

SEQ ID NO: 1962 - protein, 1086 aa, synthetic construct
  source 1..1086: note = Description of Artificial Sequence: Synthetic polypeptide
MTTSSWCRLGSLDASLGELRVQQLQTGLTTLFGFNVLVTFDNVHYKTSGASAPVPTSTQERLVGLTCEECGKWCKSKAGLVAHHRVHDNDSVGTNMVAQLACADCSRLFPTKIGLSQHRRHAHPTQHNADKLSRVKHSGARWSQQESQSLLRLANNLYPSCETQTALFARLEQYFPGRSAISIKTRLRVLNWQAQQDESSSGGPDQTIGQIAAYSSEADDYSVWFKQTVDCAVSLLESHADSSLASVDLLAFARGLQSGIMTPEQVLSLLDLHASRTFPHTWKTVSRRRRQLAHRMPVNRKQIRRANYAAIQTLYHQRRKDAASAVLDGSWKDLYKGNCGLPPDAEQYWKQVLSAPKHVDSRPSRVVVPSDWSLIEPITGEEVGRTVRSMGNSSPGLDKLTPRMLRRFNANVLAGYFNLLLLAGGCPPHLCRARITLVPKVPNPTSPDQLRPISVSSILVRCFHKVLADRWSRRLQLPSLQFAFLHRDGCLEATSLLHALLRHSSATASNLSLAFVDISKAFDSVSHDTIVRSAEAFGAPSPLVRYIAQSYENAVAVFPSSEVHCHRGVRQGDPLSPLLFIMAMDEVLGLSMPQLGYQFHDTLVDGFAFADDWVVCAESQARLKEKLEAAAVELGRAGMKINARKTKAMVICGDRKHRATAVSVEPFCFAEELITPLGPTDTVTYLGIPFTFKGKGVFNHRQHLLKLLDEVTRAPLKPHQRMEITRNYLIPRLTYSLVLGQVHRNTLKRLDNYIRQSIRGWLRLPKDTPISYIHAGKQHGGLGIPSLSATIPMQRRVRMEKLLSTQCRVLRNVVNDSAFGKVVRDLSLPIRVHGSCVNTKEELVAAWGDSLHNSVDGRGLRELVASPLSNRWLVFPERVFPRIFIRGIQLRCNLLRTRVRSARHGHGGQTILCRGNCGQPESLVHILQSCWITHDARCARHNRVARELAKRLRRLGYTVFEELRAPTSTSFIKPDLIAVRERRATVIDVSIVSDGRGVTVWNEKKQKYGADEFSLAIISALRAIGCDVDFLVHQPMIISYRGICFPQSAKAVIGLGLSKVTVSDLCLLAIVGSLRTYDTFMRGTWR

SEQ ID NO: 1963 - DNA, 149 bp, Cyprinus carpio
  source 1..149: mol_type = unassigned DNA
caaaaggtaaagggggaggtgttgcttcaatttataacaatgttttcaggatttctcagagggcaggcttcaagtataactcgtttgaagtattggtgcttaatataacattatccagagaaacaaatgttaatgataaatcccctgtg

SEQ ID NO: 1964 - DNA, 797 bp, Cyprinus carpio
  source 1..797: mol_type = unassigned DNA
taacatactaatacacttctaatatccaaatccgttaaaggatttttaggctgcattaattaggtaaaccggaaccgggaacacttcccataacacccgatgtacttgctacatcgttagaagaatggcatctacgctcatattagtctgtttctctcttattccgaggtcaccgtagccaccagatccagtctgtatccaagtcagagggtcactgcagtcacccggatccagtatgtatccagcccagatggtggatcagcacctagaaaggacctctacagccctgaaagacagcggagaccaggacaactagagccccagagacagatcccctgtaaagaccttgtctcagacgaccaccgggacaagaccacaggaaacagatgattcttctgcacaatctgactttgctgcagcctggaattgaactgctggtttcgtctggtcagaggagaactggccccccgactgagcctggtttctcccaaggtttttttctccattctgtcaccgatggagttttggttccttgccgctgtcgcctctggcttgcttagttggggacacttcatttacagcgatatcgttgacttgattgcaaattattgcacagatactatttaaactgaactgagctgcatgatgacatcactgaattcaatgatgaactgcctttaactgtcattttgcattattgacacactgttttcctaattaatgttgttcagttgctttgacgcaatcttttttgtttaaagcgctatataaataaagatgacttgacttgacttgac

SEQ ID NO: 1965 - protein, 844 aa, synthetic construct
  source 1..844: note = Description of Artificial Sequence: Synthetic polypeptide
MFVLATVYRPPGHHTDFIKEFADFTSELVLAADKVLIVGDFNIHVDNEKDALGSAFIDILNSIGVRQHVSGPTHCRNHTLDLILSHGIDVDGVEIMQPSDDISDHYLVLCKLHIAKTVNSTSCYKYGRTITSTTKDCFVSNLPDVSQFLSISKTSEQLDDVTETMDSLFSSILNTVAPLRLRKVKENSLTPWCNEHTRTLKRAARKMERSWRKTKLEVFRIAWRESNLSYRKALKTAKSDYFSSLLEENKHNPRYLFNTVAKLTKNKASTSVDISQHHSSNDFMNYFTSKVDTIRDKIVTMQPSATVSHQTVHYRSPEEQFHSFSTIGEEELYKLVKSSKPTTCMLDPIPSKLLKEVLPEVIDPLLTIINSSLLLGYVPKTFKLAVIKPLIKKPQLDPKELVNYRPISNLPFLSKILEKVVSSQLYSFLEKNGICEDFQSGFRPYHSTETALLRVTNDLLLSSDRGCISLLVLLDLSAAFDTIDHTILLHRLEHFVGINGSALAWFKSYLYDRHQFVAVNEEVSYRSQVQYGVPQGSVLGPLLFTLYMLPLGDIIRKHGVSFHCYADDTQLYISSRPGETYQFEKLTECIVDIKNWMTSNFLLLNSEKTEVLIIGPKSSACNDLERCLSLDGCSVNSSSSVRNLGVLFDSNLSLESHVSSICKTAFFHLKNISKLRPMLSMSNAEMLIHAFMTSRLDYCNALLGGCSARLVNKLQLVQNAAARVLTRTRKYDHISPVLSTLHWLPIKHRIDFKILLITYKALNGLAPQYLNELLLHYSPPRPLRSQNSGNLIIPRISKSTAGGRSFSYLAPKLWNNLPNIVREADTLLQFKSRLKTHLFNLAYT

SEQ ID NO: 1966 - DNA, 1110 bp, Danio rerio
  source 1..1110: mol_type = unassigned DNA
gcaggagaagcactttagcagcatctagaacagcagcctgtaagtacatttaagatttgtttcagttgttgtgtatggtttgaggacttgtttccagctgtttgtgtaaagttgtaggacatttaaacttgctttcagttgtgtataatactagaagttgtttagccactgtttccttggttactataagagcttgtgtagcgaacgcagacgcggttcgcgtcgtccgcctcagtttcggcccttgttttgactcgggaggcgtgtccaaacgccaggtaaccactatatagtgagcacggtagcattagtcggcaggagaagcactttagcagcatctagaacagcagcctgtaagtacatttaagatttgtttcagttgttgtgtatggtttgaggacttgtttccagctgtttgtgtaaagttgtaggacatttaaacttgctttcagttgtgtataatactagaagttgtttagccactgtttccttggttactataagagcttgtgtagcgaacgcagacgcggttcgcgtcgtccgcctcagtttcggcccttgttttgactcgggaggcgtgtccaaacgccaggtaaccactatatagtgagcacggtagcattagtcggcaggagaagcactttagcagcatctagaacagcagcctgtaagtacatttaagatttgtttcagttgttgtgtatggtttgaggacttgtttccagctgtttgtgtaaagttgtaggacatttaaacttgctttcagttgtgtataatactagaagttgtttagccactgtttccttggttactataagagcttgtgtagcgaacgcagacgcggttcgcgtcgtccgcctcagtttcggcccttgttttgactctcgaggcgtgtccagctgaattcaatcagctagtgctttggggttatataaacaactagttcaccgcggcagcggtcgcggcagcctcgtgtgaagaccgacgagggtaaagaccatcgactctacctgcgcgactccaccgagcaaagacaccgacaaagcacttgagtactttactgtattgttttactttacacttattttttgttgtcagtgcacttttatt

SEQ ID NO: 1967 - DNA, 233 bp, Danio rerio
  source 1..233: mol_type = unassigned DNA
taatctgcaattgcctctttgaatatcacactaattgtacacaaaaaaaaaaaaaaaaaaaaaaaaaataaaaaaactactaacacttcccttcttagactttacagacctgaaacttgcctttagtacttattcattgttgctcttagttgtgtaaattgcttccttgtcctcatttgtaagtcgctttggataaaagcgtctgctaaatgactaaatgtaaatgtaaatgt

SEQ ID NO: 1968 - protein, 965 aa, synthetic construct
  source 1..965: note = Description of Artificial Sequence: Synthetic polypeptide
MCFLIPVVTNTRKTREVRCRRNPHNLRSIHVSTISQLSLSVGLWNCQSAVNKADFITSIATYSDYNLMALTETWLRPEDTATHATLSANFSFSHTPRQTGRGGGTGLLISKEWKFTLIPSLPTISSFEFHAVTIIHPFYINVVVIYRPPGKLGHFLDELDVLLSSFSNFATPLLVLGDFNIYVDKPQAADFQTLLASFDLKRAPTSATHKSGNQLDLIYTRHCFTDQTIVTPLQISDHFLLSLNIHITPEPPHTPTLVTFRRNLRSLSPNRLSTIVSDSLPPSRKLTALDSNSATNTLCSTLASCLDRLCPLASRPARASPPAPWLSDALREHRSKLRAAERIWRKTKNPAHLLTYQTLLSSFSAEVTSAKQTYYRLKINNATNPRLLFKTFSSLLYPPPPPASSTLTTDDFATFFCTKTAKISAQFAAPTTNTQDTTPTPHTLTSFSQLSESEVSKLVLSSHATTCPLDPIPSHLLQAISPAVIPTLTHIINTSLDSGLFPTTFKQARVTPLLKKPNLDHTLLENYRPVSLLPFMAKILEKVVFNQVLDFLTQNNLMDNKQSGFKKGHSTETALLSVVEDLRLAKADSKSSVLILLDLSAAFDTVNHQILLSTLESLGVAGTVIQWFRSYLSDRSFRVSWRGEVSNLQHLNTGVPQGSVLGPLLFSIYTSSLGPVIQRHGFSYHCYADDTQLYLSFHPDDPSVPARISACLLDISHWMKDHHLQLNLAKTEMLVVSANPTLHHNFSIQMDGATITASKMVKSLGVTIDDQLNFSDHISRTARSCRFALYNIRKIRPFLSEHAAQLLVQALVLSKLDYCNSLLAGLPANSIKPLQLLQNAAARVVFNEPKRAHVTPLLVRLHWLPVAARIKFKTLMFAYKVTSGLAPSYLHSLLQIYVPSRNLRSVNERRLVVPSQRGKKSLSRTLTLNLPSWWNELPNCIRTAESLAIFKKRLKTQLFSLHFTS

SEQ ID NO: 1969 - DNA, 89 bp, Dendrobium catenatum
  source 1..89: mol_type = unassigned DNA
gttgccaggtcccaagtcctggatgagaaaagtggagggttgcgttaggtagtcgacagccagcgtaaaacttgtcgaacaataatgac

SEQ ID NO: 1970 - DNA, 33 bp, Dendrobium catenatum
  source 1..33: mol_type = unassigned DNA
tagtgggataaaggcttgatgttgttgttgttg

SEQ ID NO: 1971 - protein, 1010 aa, synthetic construct
  source 1..1010: note = Description of Artificial Sequence: Synthetic polypeptide
MNPLRNCVNARASPGSDALYGLNTVTSVQGPLHRRPGAVLNRQGFPHQGRMWAKKLVHETKIRIGTWNIGSLTGKLMELIDIMIHRKLNILCIQETKWVGEKAKEIDSLGFKLWYSGRSRTRNGVGVIIDKSLKDNVIKINRIGDRIIALKIVVDDKIVNIISAYAPQVGLDMSSKLNFWNDLEELIQNIPLEERVFIGGDLNGHVGREVDDFKSIHGGHGFGTTNEGGKTILDFCLAYDFLIANTLFKKRNEHLITYKNGYSTTQIDYFLIRKLNRLDCKDCKVIPSENLCTQHRLLVLDFKIKGHKIKNKVKQFSRIRWGHLKNINKNIFESKILDLKILSVHEDANIMWEKVASDIKNIAKDVLGVSKGKAPNSKNSWWWNPNVQEKIKNKKICYKNWFNFKNSDNWEIYKVARKDSKKAICDAKTLAFSDLYNRLDTKEGERYMYKLAKQRDRSSKDLVQVKCIKDEDQKILFLEDDIQQRWMRYFAKLFNEDCENKIDYSDLSTLNENKDFCFYRRISKTEVREALKKMKGGKAVGPDDIPIEVWKCLGDEGISWLTKLFNTILKTKKMPDEWRMSVLIPIFKNKGDAQDCANYRGIKLMCHTLKLWERVMEHRLRRDTNVSQNQFGFMPGRSTMEAIHLLRGLMEKYRENKEDLHMIFIDLEKAYDKVPREVLWRVLEKKGVNNAYIQIIKDMYAGAITCVQTQGGLTKYFPISVGLHQGSALSPYLFALVMDVLTRHLQEDVPWCMLFADDILLVDKTREGVEGKLELWRSTLESKGFRLSRSKTEYMECNFSSNRPSEGIVTLGDQVINKSTRFRYLGSIVQSDGEIDGDIISRIQVGWLKWRNASGLLCDRNVPLKLKGKFYKMVVRPAMLYGAECWPLKEKHNTKLSVAEMRMLRWMSGFTLRDRIRNEHIREKVGVAPVEDKIRESRLRWFGHIKRRPSDDPVRRVEVLDLTYVKKGRGRPKKTWLENIRNDLSLLDLNENLTFNRTQWRKRIHVADPT

SEQ ID NO: 1972 - DNA, 1033 bp, unidentified
  source 1..1033: mol_type = unassigned DNA; note = Description of Unknown:Locusta migratoria sequence
tttcaccagaatattgggggactaaagaataaaatagatgagcttttggtttgtttagatgatatagaaactgataatgtaatagatatactatgcctgtctgagcatcacattgtcactggtatggaaaatgtgaatgtcagtggatataaattagctgcaaatgtaagtagagataataaggtaagaggaggagttgccatatatgtcaaaagctatcacagtgtaaaaaatttagaaacaaaaaagttttgtgtagagcaacatattgaagcatgtgcctgtcagcttaaactcaatgatgattctcttataattgtaacagtatataggtccccttcaggaaactttcattatttctggaaaacttggatgccttgttgtgctatctgtcagatagggggaagcaaattattatttgtggtgatttcaatgttgattcactgaaagagtgtaataggaagaatgacctggaagtcttacttggctctttcaatttgacatctgttattgattttcctactcgggtagtaaaggacagcagtacattgatagataattttttatagaccaagataagtttaacaacataaatgcttgtcctgttgagaatggtctttctgatcatggtgcacagctagtaacagtatatgacatagctcctttcagtaattcgaaacagtcctccagagttgtgcgctcaattaatgatttaacaactagaaatttcaaagaaagtctacagcagttagactgggatgaggtttataaggaacctgatgctaatttaaaatataacttatttcatgatacatttgtaagggtatttgaaaactgtttccccaagaaattagttaaatataattgtaagaaaccatgcaaaaaaccatggcttactaaaggaataaaaatatcttgtaaccgaaaaagggaactatatctatcagcaagaaagagtaataacccagaaacaatcaaatattataaaaactactgtgctacattaagaaaagttattaaaaaatccagaagc

SEQ ID NO: 1973 - DNA, 232 bp, unidentified
  source 1..232: mol_type = unassigned DNA; note = Description of Unknown:Locusta migratoria sequence
taaaggaatttctgaatggcaactccttctacactttagatgaatttttagataaaaattagtaatttaggaaaaaaattaaaaataaaaaaaaaataaaataaaatattaaaatattgagtgtcaagtaataatatgtatagacacatttcactaaactgacacgttccacatcattacgaaatgtcgtatttatgatctatggaacaagtattaatctaatctaatctaa

SEQ ID NO: 1974 - protein, 618 aa, synthetic construct
  source 1..618: note = Description of Artificial Sequence: Synthetic polypeptide
MCIMSEISTSNNKIKTIWNIITRETGQPRTQEDSITIKVNEKITNKKSEVENTFNNYFLNVVENIGSKCSLEEARQLMEQGVPRQFDTMEIPPTSQSEIRKLINSLKSKSSHGIDGISSRVLKACSQEICRILSHICNSSLEQGIFPDRLKYAIVKPLHKKGDTLDVNNYRPISLLTALSKILEKVMYSRVASHINKNKVLTKCQFGFQKGFSTENAIYIFTNEILNALDNRKSPVGIFCDLSKAFDCVNHGILLDKLKYCGMSGKVHKWFKSYLTGRVQKVDISNSHNIQKQPSPQTGELSSMGCHRVRYWDLCCSYTKTAESSNWGTIKHGVPQGSVLGPLLFLIYINDLPFYIHKDAKLVLFADDTSIAITPESQELTDEIVNEVFQRIIRWFSVNGLSLNFEKTQYIQFHTINGITPLINIDFNQKSVAKVEYSKFLGLCIDEGLNWKKHIEDLLKRLSSATYAIRVIANFGDVQLSKLAYYAYFHSLLSYGIIFWGNSSFSKKVFIAQKRVIRIIAGAHPRSSCRHLFKDLGIFTIYIYIYSLMKFVINNPTEFKCNSSVHSYNTRRKGDLHYSRLNLALSQKGVNYSATKVFGHLPSSIKILTDSQLAFKKN

SEQ ID NO: 1975 - DNA, 313 bp, unidentified
  source 1..313: mol_type = unassigned DNA; note = Description of Unknown:Locusta migratoria sequence
ccacccccatgaaccacagacattgccgaggtggggtggcttgcgtgcctcaacgatacagatagccgtaccgtaggtgcaaccacagcggaggggtatctgtggagaggccagacaaacgtgtggttcctgaagaggggcagcagccttttcagtagttacaggggcaacagtctggatgattgactgagctggccttgtaacatcagctaacatggctttgccatgcagttactgcgaacggctgaaagcaaggggaaactacagtcgttacttttcccgaggacatgcagctctactgtatgaatatatg

SEQ ID NO: 1976 - DNA, 14 bp, unidentified
  source 1..14: mol_type = unassigned DNA; note = Description of Unknown:Locusta migratoria sequence
tgaagaccacaaca

SEQ ID NO: 1977 - protein, 986 aa, synthetic construct
  source 1..986: note = Description of Artificial Sequence: Synthetic polypeptide
MMASSWVKYSGGKIVPHSDLRAGTTQEDVVIKKNKTGILRIGAWNVLTLNRVGKLENLKREMDRLKLDMVGISEVRWQDEQDFWSGEYRVINTKSVGGNAGVGLIMNKKIGMRVSYYEQHSERIIVVKIDTKPTPTTVVQVYMPTSSADDEDIEEMYEEIKEIIQKVKGDENLIVMGDWNSVVGKGREGNVVGEYGLGKRNERGDRLVEFCAEHNLMITNTWFKHHERRLYTWKRPGDTGRYQIDFIMVRNRFRNQVLNCKTYPGADIDSDHNLLVMNCRLKLKRLQKGRKVRRWNLDKLKEPEVVESFRGSIRQGLAETGESNTVEEEWVALRDRVVKAAEDHIGRRTRPNRNPWITQDILNLIDERRKYKNSASETGKREYRRLKNEIDRKCRLAKQEWLEDKCRTVEECITRGKIDTAYRKIKEIFGDKKSSCMNIKNSDGKPVLSKEGKAERWKEYIEGLYKGNKLEGSILEMEDEVEEDEIGDTILREEFDRALKDLSRNKAPGVDDIPSELLISLGEPVMKKLFHLVCKMYETGEIPSDFKKNIVIPIPKKASADKCENYRTISLISHGCKILTRIIYRRMEKLVESDLGEDQFGFRRNVGTREAILTLRLILEDRLRKGKPTFLAFVDLEKAFDNVDWNTLFQILKVAGVKYRERRVIFNLYKNQTAVIRVEGHERDAEVGKGVRQGCSLSPMLFNLYIEQAVKESKEKFGEGIKVQGEEIKTLRFADDIVILSETAKDLEEQLNGMDSVLKGRYKMNINKSKTKVMECSVRKSGDAEGIRLGNETIKVVDEFCYLGSKITSDGRSKEDIKCRMAMGRKAFLKKRNLLTSNINLNVRKSFLKAFVWSVALYGSETWTIRSSDKKMIEAFEMWCYRRMMKIRWVDHVTNEEVLNRIGEKRSFWHILTKRRDRLVGHILRHQGIVNLALEGSVWGKNRRGRPRDEYSKQIQKDVGCRTYSQMKRLAQDRVAWRAASNQSAD

SEQ ID NO: 1978 - DNA, 136 bp, unidentified
  source 1..136: mol_type = unassigned DNA; note = Description of Unknown:Locusta migratoria sequence
caaaatagtgaagcaagacctacaaaaaatccttggatatcacagaaatttaattagaaaatataaaaatgcagtatgaaggcaaaatgagtacagacgactaaaaatgagattgacaggaagtcaaaatggctaa

SEQ ID NO: 1979 - DNA, 20 bp, unidentified
  source 1..20: mol_type = unassigned DNA; note = Description of Unknown:Locusta migratoria sequence
tgaagaccacaacaacaaca

SEQ ID NO: 1980 - protein, 600 aa, synthetic construct
  source 1..600: note = Description of Artificial Sequence: Synthetic polypeptide
MAGVLEAKCKSVEECIKGKSRYRLQENKRTFGTRKQLYEYQELDGKPVLSKEGKAERWKEYIEQLYKGNELRDDVVGREEEVDQDEIGDTILRDEFDRALKDLGRNKAPGVDDIPSELLKSLGEPAMTRLFELVCRMYETGEIPSDFKKNVIIPIPKKSGADRCENYRTISLISHGCKILTRIIYRRMEKLVEADLGEDQFGFRRNVGTREAILTLRLILEDRLRKGKPTFLAFVDLEKAFDNVDWNTLFQILKSAGVKYRERRVIYNLYKSQTAVIRLEGHEREASVGKGVRQGCSLSPMLFNLYMSRRPFSDVIQFVHEQAVKESKEKFGIGIKVQGEEIKTLRFADDIVILSETAKDLEEQLNGMDSVLKRAYKMNINKSKTKIMECGLRKSGDAEGIRLGNETMKVVDEFCYLGSKITCDGRSTEDIKCRMAMGRKAFLKKRNLLTSNINLSVRKSFLKAFVWSVALYGSETWTISSADRKRIEAFEMWCYRRMLKIRWVDRITNEEVLNRIGEKRNFWHTLTKRRDRLVGHILRHRGIVNLALEGSVWGKNRRGRPRDAYSKQIQVDVGCRSYEEMKRLAQDRVGWRAASNQSPD

SEQ ID NO: 1981 - DNA, 104 bp, unidentified
  source 1..104: mol_type = unassigned DNA; note = Description of Unknown:Locusta migratoria sequence
taactaaaacctctaggacagcaattgataatatttttatagacaaatcaaaggaacaaaatcatatcataaaaccaataataaatggcctatcagatcatgat

SEQ ID NO: 1982 - DNA, 221 bp, unidentified
  source 1..221: mol_type = unassigned DNA; note = Description of Unknown:Locusta migratoria sequence
tgatgcatgcactcatactatattagtattattatattatcagcaaaaaaaacctaaaaattatgtatctgtattttattataagtgtatgtatctgtatttatattattagtattatctattattcagcttgtaaattttgtttcttgacatgttccacatccacgaggatctcctcaacatggatctacggaacgaataaactaatctaatctaatcta

SEQ ID NO: 1983 - protein, 744 aa, synthetic construct
  source 1..744: note = Description of Artificial Sequence: Synthetic polypeptide
MQLLVLGIDSKQIMKTAKSTYRRVVNPPKIENFRKLLKDMNWKDVYSAHGMNEKYNVFINNVSIMFENCFPLKVTRIKQKSIIKPWITQGIKISCKTKRKMYLSAKSSCNDDDLTKYKEYCKILKKVIQASKQMHYEKKIATSGNQIKTIWDIVKEETGRTRKEQEQVALRVDETLVTDGHSVANLFNKYFISVTDSMGLSGSVNNALEYLKLAFTNNFTYMNMSLTSPQEITSIIKSLKTKHSSGYDEISTKLIKACSCELSTILSYLCNQSIITGTFPDWLKYADIKPLFKKGDKEIPSNYRPISLLPAFSKILEKVMYKQLLNHLTTNDILSRTQFGFLKGSDIEKAIYTYSENVLNSLDNKLQAAGIFCDLSKAFDCVNHNILLSKLEFYGVTGNAAKWFKSYLTNRKQRVSVQVTSELSQQSSSDWEEITCGVPQGSILGPLLFLVYINDLSSVTLPEAEFVLFADDTSIAIKSTSSIVIERSANDIFMNINKWFKANSLSLNFEKTHYMQFRTCKRFPDSICIKYEEEQIEEVDSIKFLGLQLDNKFSWEEHTTELQKRLNKSVFSIRVLSDIGDIKITKLAYFAYFHSIMSYGIIFWGNSSSQSKVFRVQKRVIRIICGVNSRTSCRSLFKELGILTTASQYIYSLMKFVINNISLFPTNSSVHTYNTRNKNDLHKDLKALTLVQKGVHYSGTHIFNNLPSSIKNLATNKDQFKRNLKDFLVANSFYSISEFLNCTK

SEQ ID NO: 1984 - DNA, 84 bp, Melopsittacus undulatus
  source 1..84: mol_type = unassigned DNA
taggttaccctgctcttgcaggggggttggactagatgatcttttgaggtcccttccaacccttgggattctgtgattctgtga

SEQ ID NO: 1985 - protein, 433 aa, synthetic construct
  source 1..433: note = Description of Artificial Sequence: Synthetic polypeptide
MQIPVAPEGVRTKEEFALVDEDWVRDQLCNLDIYKSMGPDGMHPRVLRELAEVIARPLSIIFGKSWETGEVPEDWKMANVTPVYKKGKKEDPGNYRPVSLTSVPGKVMEQLILDSISRHIKDEGVIKNSQHGFMRGKSCLTNLIAFYEEVTRWRDDGRAVDVVFLDFSKAFDTVSHSILIDKLRKCGLDDQVVRWIKNWLKGRRQRVVVNGAESSWRSVTSGVPQGSVLGPVLFNIFINDLDEGTECTLSKFADDTKLGGVADTPEGCVAIQRDLDRLESWAGRNLMKFNKGKCRVLHLGKNNPMYQYRLGVDLLERSEGERDLGVLVEGRLRELGLFSLEKRRLRGDLISVYKYVKGGCQDDGARLFSVISSDRTRGNGCKLEHRRFHVNIRKNFFTVRVTEHWNRLPRGVVESPTLEIFKARLDKFLCDVL

SEQ ID NO: 1986 - DNA, 710 bp, Monodelphis domestica
  source 1..710: mol_type = unassigned DNA
gggtgtatggggtgctcagggaggggtagtatctctggtatggagggcttgtcgtgccctcctagggcagctctccagcctctgacccccacctgacacccagctctcacttgtggctcccagtagctgctagcatgtggcagcggccacaccccgggcaacggcttcgacaggccggctaaaccttgtgagggtagccatcgggtcatcgacccctggtgaaccagggctttgctcacccagcatgtgaagactgcttcggctgaacagacggaagaaaccaataagaaggttcaacggctgagagggcgacgcagcaaagcactgtggagtgcttagggcgtgttggagcacaaaggacaacacggccatccaatgcagctgaggaagtctccagatgtaacaatttttcgtgccactggacccaggcttccaacgccgagagagtgggactgtctctgtgcatcggcttttccacttaaatctctttcacgcacaagtatctttgtgcacactcatctatcctaaccccgtccaccctcttcaagacctgcggcgatgggggagtggcgacgcaacaggtggaggtgaccactggcagttgtagtcacgatcctgcacgtaggcggcccacggaccagtggtcgctcggccctgtgggcagcagggacgttcggcagcatcctgggcgactgagcagccctctctag

SEQ ID NO: 1987 - DNA, 51 bp, Monodelphis domestica
  source 1..51: mol_type = unassigned DNA
tgaaactgcacaaagacaatagtcattctcgatcaccgagagactaccact

SEQ ID NO: 1988 - protein, 1110 aa, synthetic construct
  source 1..1110: note = Description of Artificial Sequence: Synthetic polypeptide
MDSTAHPNQGRGLEKVSQTLPALQTPGQHTAAGGSSPLSGRNQRKNTKKLLLGAWNIRTLLDRENTPRPERRTALIGKELARYNIDIAALSETRLPEEGSLSEPTTGYTFFWKGRASNEDRIHGVGLAIKTSLLKQLPDLPVGISERLMKIRLPLSKDRYATIISAYAPTLTSTEETIEQFYSDLSAVLHSVPTNDKLILLGDFNARVGQDHERWKGVLGKHGVGKMNNNGLLLLSKCSEFELTITNTVFRMANKYKTTWMHPRSKQWHLIDYIIVRRRDIQDVKITRAMRGAECWTDHRLVRATLQMRIAPRHPKRAQTVRAFYNVSRLRDPSYLQTFQSCLDDKLSAKGPLTGSSTEKWNQFRDAVKETSKAVLGPKQRNHQDWFDENNTAIEDLLSKKNKAFMEWQNNPNSAPKKDRFKSLQATAQREIRKMQDRWWEKKAEEIQRFADMKNYKQFFSALKTVYGPLKPTTTPLLSSDGDTLIKDKKGISNRWKEHFSQLLNRPSSVDQSALDQIPQNRTIEQLDVPPSIEEVQKAIKQMSAGKAPGKDGIPTEVYKALNGKALQAFHIVLTSIWEEEDMPPELRDASIVALYKNKGSRAACDNYRGISLLSTAGKILARVILNRLLSSVSEQNLPESQCGFRPDRSTIDMVFTVRQMQEKCLEQNLSLYIVFIDLTKAFDTVNRDALWVILSKLGCPAKFVKLIQLFHVDMTGEVLSGGETSDRFNISNGVKQGCVLAPVLFNLFFTQVLRHAVMDLDLGVYIKYRLDGSLFDLRRLTAKTKTTERLILEALFADDCALMAHQENHLQTIVDRFSTATKLFGLTISLSKTEVLFQPAPGRPTNQPCITIDGTQLSNVNTFKYLGSTIANDGSLDHEINARIQKASQALGRLRCKVLQHRGVSTATKLKVYNAVVLSSLLYGCETWTLYRKHMKQLEQFHQRSLRSIMRIRWQDRITNQEVLDRANSTSIEVMVLKTQLRWSGHVIRMDPQRIPRQVFYGELSAGLRKQGRPKKRFKDQLKSNLKWAGITPKQLELAASDRSSWRTHINHAATTFEDERRRRLAAARERRHQATTAPPVTTGVPCPMCHKLCASAFGLQSHMRVHRR

SEQ ID NO: 1989 - DNA, 742 bp, unidentified
  source 1..742: mol_type = unassigned DNA; note = Description of Unknown:Nasonia vitripennis sequence
atggcggagtactagcatcgggtaacttcacgtacctgtatgggagtgggggatctctaggcaccggatttctcgtaagcaaaagcatcatacattcggttaaaagtttcaaatccgtcaatgataggctctcgtacatcattatcgaaggtgaatggtatagatatgtatttattaatgtacactgtcctacggaggacaaagaagaagaagctaaggatctctattacgaaactttagagcaggtaatcgaccagttcgcgtcttacgacacaagaatagtattaggcgatttcaatgctaaaataggtagggaggaaatgtttaggcctactatagggaaggaaagcctgcacgaagccagcaatgataacggtattagggtcataaatttcgcggcggcaaaagatcttataatcaaaactacgtgttttaagcacaaggacatacacaaggcaacgtggacatcgccggacggggccacacagaaccaaattgatcatttcctcattgaaaaaagacgtaagggcttacagaggggcagatagcgactcggaccacttcctagtagtagccaaattaagagctagactagtagcgaatcaaaatagtaagcgagcaaacaaggtagaaagcttcgatattgagaagctacgagatagaacagagcgaattaggtaccagatagaaattaataacaggtttcaggcacttgaagaagcaaacacatcgccggagggga

SEQ ID NO: 1990 - protein, 687 aa, synthetic construct
  source 1..687: note = Description of Artificial Sequence: Synthetic polypeptide
MTNRIAYGGTSKKTVKEAANKVLGKKKKPKSKPWFDEECELWFERRKKAKLDSLQNRSDRTVEEYSNVRKQTSAIYRNKKREYQKNLIRRIETNSKENNPREMYRGINAIRKGFRSRAQLMKDENGDLVTNDNELLSLWKNYFDKLLNVHENSEELGDEIHTAELHVEEPSYQEVEAAIKKLKNNKAAGNDSIPAELLKYGGVELTFKIYKLVCAIWKNETIPENWKESIIIPIFKKGDKTDCNNYRGISLLATCYKVLSNVIQARLTPFAEDIVGDYQCGFRRNRSTSDQMFTIRQLLEKKWEFCETIHQLFIDFKKAYDSIKRSKMYQILVLLGVPKKLVRLIQICLNGSTGKVRVGGNVSEPFMIRDGLKQGDGLSTVLFNLTLEYAVRKMQVSQLGATLNGTTQILGYADDLDILGDCRETVARNAEILIKAVEYTGLEVSESKTKYMIVDKLGICRGEEDLRVGNFTFEKVSEFRYLGTTINDRNEINVEINKRLHSGNACFYAVSNLLKSRLLSKNVKIRIYRTIILPVVLYGCETWALTKQADNRFRVFENKVLRKIYGPKKDEETGEWRRLHNDELHNLYASPNINRIIKSRRLGWAGHVARMGDDRTAARVMKGRPMVTRPLGRPRRRWEDNVKADLVEIGRVGVDRRGASWVGLTQDRAAWKACVDEAMNFRVPNAT

SEQ ID NO: 1991 - DNA, 776 bp, Nicotiana sylvestris
  source 1..776: mol_type = unassigned DNA
tactgtcagggctacaccagtggtagcggtgacagccctttttggtttttgggtcgtggtattttctgtgttttcagggaaattctcgaagttgttggagacaagttgggcgcacgagcactagcaaaggagagcaacctggacgagcgtcagcaaagggcggtgggaagcggtgcgtgagcgtacaactacatcgagtacagcaaatcaacacaggtttggttctcgggagttggtacctcccgttctactgtttcccttttggtgttagctaaattgatgttactttagttcacaatagttcaatcattcaactagtgtacttgtagtcacttgtttccttctagtttgattcgttgtccgttgtgcactagcgagtcttctttagatttgtcgtaggtgtagtggctgcagtctgggatgatagattaagggcatgtcctcgggtggggcagagtgtggggccggggtcagggtgtgggacgggaggcaggggaggtagagggggcaagggagcctataggttgagaatcgggtcatggaacataggttcgctaacgagtaagtctatagagttggcgaagatccttcagaagaggaagattaatatagcgtgtgtccaggagactaggtgggttggatcgagggcgaaaaacgcggatgggtataagttgtggtactctggagtcctgaggggtaagaatggagtgggtatcctggtagatagccatcttagagagtcggtggtagaggtcaggcgggtgaatgatagacta

SEQ ID NO: 1992 - DNA, 379 bp, Nicotiana sylvestris
  source 1..379: mol_type = unassigned DNA
taggggaagttgtgagatatttctacagcgcactagagtgagactagccagttaggagttagtcttaggatgctactggtcagctactgatgcagggctttatctgttggatattagtataccttccatctttttcgtatttcctatatttcttatattgctgttattttgtttttatgtattttatgttatgttatgtattttatgttattttattatgagtctattgatagtactaatatatcgtctcttgttgctttcttgagccgagggtctcctggaaacagcctctctgcccctcggggtaggggtaaggtctgcgtacatattaccctccccagaccccacttgtgggattatactgggttgttgttgttgt

SEQ ID NO: 1993 - protein, 866 aa, synthetic construct
  source 1..866: note = Description of Artificial Sequence: Synthetic polypeptide
MTIKLVVGECTLNVVSAYAPQVGLDEEIKRRFWEGLDDIVRSIPPSERLFIGGDFNGHIGSSAGGYTEVHGGFGFGERNGGGTSLLDFAKAFDLVIANSSFPKREEHLVTYQSSVAKTQIDYLLLRRCDRRLCEDCKVIPGETLATQHRLLVMDIGIMIRRKKRSVRGRPRIRWGALTKDKAQELEGRLSAMGAWRSSGDANTMWSTTADCIRKAAREVLGISSGRTGGHKGDWWWNAVVQGKVEAKKAAYLRLVGSTGEEEKRANSERYKVARKEAKMAVTEAKTAAFARLYEELGNKGGEKKLFRLAKVRERTARDLDQVRCIKDDDDKVLMGDDQIKRRWQTYFHKLLNEEGDQDIVLGELRNADSPHELSYCRDIEVDEVMEAMRKMRRGRATGPDEIPVELWRCVGRAGLEWLTGLFNVIFKTNRMPEEWRWSTMVPLYKNKGDIQSCNNYRGIKLLSHTMKVWERVVEMRVRRTVSISDNQFGFMPGRSTTEAIHLIRRMVEQYRDKKKDLHMVFIDLEKAYDRVPREVLWSCLEVKGVPVAYIRVIKDMYDGAKTRVRTVGGDSEHFPVVTGLHQGSAFSPFLFALVMDAITHHIQGEVPWCMLFADDIVLIDETRGGVNERLEVWRHALESKGFRLSRTKTEYLECKFGAEPTEAGVEVRLDSQVIPKRGSFKYLGSVIQGTGEIDEDVTHRIGVGWMKWRLATGVLCDKKVPPLLKGKFYRAVVRPAMLYGTECWPVKNSHIQKMKVAEMRMLRWMCGHTRMDKIRNEDIREKVGVAPMEDKMREARLRWFGHIQRRSTDAPVRRCERLAVVGTRRGRGRPKKYWGEVIRQDMARLRITEDMALDRELWRSSIKVVG

SEQ ID NO: 1994 - DNA, 59 bp, Orycteropus afer
  source 1..59: mol_type = unassigned DNA
actcgtctgtcagtttgtcatactgtggtggcttgcgtgttgctgtgaggctggaggct

SEQ ID NO: 1995 - DNA, 15 bp, Orycteropus afer
  source 1..15: mol_type = unassigned DNA
taacaacaacaacaa

SEQ ID NO: 1996 - protein, 1067 aa, synthetic construct
  source 1..1067: note = Description of Artificial Sequence: Synthetic polypeptide
MPLVFQMPAGLHMVHRFQWSFQTKTDSEEGRGHPLLKELARENLMNSSETLSDTLLENFMNSPETLSDTVPEDEPLRLEGTQNMTGKELPHQSRTNLNDMDKVKLSGPPFADVARLKLRRNSCKHPLIIGTWNVRSMNLGKLEVVKNEMECIKIDILGISELKWTGFGHFESDNHMIYYAGNDKLKRNGVAFIITKNVSRSVLKYNAVSDRIISICLQGRPVNTTIIQIYAPTTKAKDEEIEDFYQLLQSEIDQTCNQDVLIITGDWNAKVGNKEESPVVGKFGLGDRNNAGDHMIEFCKTNDLFIANTFFQQHKWWLYTWTSPDGVHRNQIDYICGKRRWKSSISSAKTRPGADCGTDHQLLICKFKLKLKTIKTSPREPKYDLEYIPPEFRDHLKNRFDALNTNDQKPEELWDDIKNIIHEESKRSLKRQERKKRPKWMSEETLKLALEWRVAKANGRNDKIKELNRRFQRAAREDKANYYNEMCKDLELENQKGRTCSAFLKLKELRKKFKPQVAILKDSMGKILNDAGNIKRRWKEYTESLYQKELVDVHPFQEVAYDQEPMVLKEEVEAALKELAKNKAPGIDGIPIEMFQQMDAPLEALTQLCQEIWKTATWPTDWKRSIFVPIPKKGDPTECGNYQTISLISHASKILLKIIQKWLQQYIDRELPEMQAGFRRGCGTRDIIADVRWILAQSKEYQKDVYLCFIDYAKAFDCVDHNKLWITLRRMGIPEHLIVLMRNLYIDQEAVIQTEQGDTAWFKIKKGVCQGCILSPYLFNLYAEQIIREAGLYEEEHGIRIGGRLINNLRYADDTTLLAESEDDLKHLLMKIEDYSLQYGLHLNIKKTKILTTGPISSITINGEKIEVVKDFILLGSTINTNGSSSQDIRRCIALGKSAAKDLFQVLKSKDVSLKTKVCLTQAMVFSIASYACESWTMNKEDRRRVDAFELWCWRRMLKVPWTAKRTNKSVLEEVQPECSLEARMARLHLTYFGHVVRRDHSLEKDVMLGKVEGQRKRGRPSTRWIDTVAATMGSSIARIVRLAQDQAVFHSAVHRVAMSQRRLDGT

SEQ ID NO: 1997 - DNA, 112 bp, Oryzias latipes
  source 1..112: mol_type = unassigned DNA
atctagccacaggggttgcaagccagttacttctgtgccggtcccaagcccggataaatagagagggttgcgtcaggaagggcatccggcgtaaaaaattgccaaaataacc

SEQ ID NO: 1998 - DNA, 30 bp, Oryzias latipes
  source 1..30: mol_type = unassigned DNA
tgatgggaaaagccgaaagagaaagaagaa

SEQ ID NO: 1999 - protein, 997 aa, synthetic construct
  source 1..997: note = Description of Artificial Sequence: Synthetic polypeptide
MRIIHNTLDIPDRSRPGLTTTATDAVNLQGVGGNLTTVGRRKRGGRRVRGQREKGKGRNIGLRIGTLNVGTMTGKGRELADMMERRKVDVLCVQETRWKGSKARSIGGGYKLFYHGVDRKRNGVGVILKGEFVNSVLEVKRVSDRMMSLKLEIEGVMVNVVSGYAPQVGCELEVKERFWSELDEVIESIPRGERVVIGADFNGHVGEGNRGDEEVMGRFGVKERNLEGQMVVDFAKRMEMAVVNTYFQKREEHRVTYRSGGRSTQVDYILCRRGHLREVNDCKVVVGESVARQHRMVVCKMTLEVRKKKRGKTEKKTKWWKLQNEETCEEFRQKLRQVLGGQDELPDDWETTAEIIRETGRKVLGVSSGKRKDGKDTWWWNEEVQECVQRKRLAKRKWDVERTEEGRQEYKEAQRRVKREVAKAKQKAYDELYDRLDTKEGEKDLYRLARQRDRDGKDVQQIRVIKDRDGKVLTTQESVQKRWKEYFEELMNEENDRERREEDVVVVEQEVAEIGKDEVRKALKRMKSGKAVGPDDVPVEVWKCLGETAVEFLTSLFNRILESEKMPEEWRRSVLVPIFKNKGDTQNCSNYRGIKLMSHTMKLWERVVEARLRKKVEICEQQYGFMPRKSTTDAIFALRMLMEKYRDGQKELHCVFVDLEKAYDRVPREELWYCMRSSGVAEKYVRVVQDMYERSMTVVRCAVGQTEEFKVEVGLHQGSALSPFLFAMLMDRLTDEVRQESPWTMMFADDIVICSESREQVEEQLERWRFALERRGMKVSRSKTEYMCLNERDQGRSVRLQGAEVKKVQEFKYLGSTVQCDGECGKEVKRRVQAGWSGWRKVSGVLCDRRVPARLKGKVYKTVVRPALLYGLETVAVRQRQEAEMEVAEMKMLRFSLGVTRLDRIRNEYIRGTAHVACVSDKVREARLRWFGHVQRRDSGYIGRRMLEMELPGRRARGRPKRRYMDVLTEDMKLANVRVEDVHDRVRWKRMIRCGDP

SEQ ID NO: 2000 - DNA, 151 bp, Oryzias latipes
  source 1..151: mol_type = unassigned DNA
tgtgaaccgccaccttaacgtggtgggggagtttgagagctcgggtgatcccaggagctaagctgtctggggcttaagcccctggtagggtctcccatggcagacaggtcctgggtgacgagccagacaaagagcggttcagaaacccctg

SEQ ID NO: 2001 - DNA, 30 bp, Oryzias latipes
  source 1..30: mol_type = unassigned DNA
taagcggaggaagatggatggatggatgga

SEQ ID NO: 2002 - protein, 1058 aa, synthetic construct
  source 1..1058: note = Description of Artificial Sequence: Synthetic polypeptide
MKRNNEDPITSPGLASPGPHSGARPRVGARRRAPGGRGSSHGPRSGTARRSDVGPLSHGPTTRRRPQKGPVQCGLGGSRGRVPRRPKPRSWNLAFGTWNVTSLGGKEPELVREVERYRLDIVGLTSTHSLGSETQSLERGWTLYHSGVAQGERRRAGVGLLVSPQLSRQVLEFTPVDERVMSLRLRVGDRSLTVVSAYGPNSSSEYQAFLVSLEGVLESAPTGDSIVFLGDFNAHVGNDSGTWRGVIGRNAPPDLNPSGVLLLDFCARHSLSITNTMFEHKGVHQYTWHQDTLGRRSMIDFVVVSGDLRPCVLDTRVKRGAELSTDHYLVVSWIRWRGRRPERLGRPKRTVRVCWERLAEPSVREVFNSHIRENFKQVPREVGDIESEWTMFSTSIVSAAARSCGRKVSGACRGGNPRTRWWTPEVRDAVKLKKESYQAWLACGTPEAADRYRQSKRAAARTVAEAKTRSWEEFGEAMEKDYRLASKKFWQTIRRLRRGKQFSTGTVFSAGGELLTSTGDIVGRWKEYFEDLLNPTDTPSFEEAESEDFGVGLSITRAEVTEVVNELLGGKAPGVDEVRPEHLKSLDAVGVSWLTRLCSIAWRSGTVPLDWQTGVVVPLFKKGDRRVCSNHRGITLLSLPGKVYARVLERRVRPIVEPRIQEQQCGFRPGRGTVDQLYTLSRVLEGLWEFAHPVHMCFVDLEKAFDRVPRGILWGVLWEYGVRGALLRAVRSLYDRSRSLVRIAGSKSDLFPVHVGLRQGCPLSPVLFIVFMDRISRRSQGPEGIWFGDHRISSLLFADDVVLLASSNRDLQRALGRFAAECEAAGMRVSTAKSEAMVLDRRKVVCHLSVGGVSLPQVEEFKYLGVLFTSEGRSEREIDRRIGAASVVMRSLYRSVVVKRELSRKAKLSIYRSIYVPVLTYGHELWVMTERTRSRIQAAEMSFLRRVAGRSLRDRVRSSVTRGELGVEPLLLHIERSQLRWLGHLVRMPPGRLPGEVFRACPTGRRPRGRPRTRWRDYVSRLAWERLGVPPEELEEVAGVREVWASLLSLLPPRPGPG

SEQ ID NO: 2003 - DNA, 202 bp, Oryzias latipes
  source 1..202: mol_type = unassigned DNA
aattcacacatcagtcacaaaacctacgacatgcacacatcagattttacccacaaccatgaagatggctcttttaaatgtcagatcacttttaaataagtcttttatcattaatgatctgatttagaccatgatttaacctgtttgtttttaactgaaacctggcttggctctgcagctctactgagttctacctttttaa

SEQ ID NO: 2004 - DNA, 612 bp, Oryzias latipes
  source 1..612: mol_type = unassigned DNA
tgattttaactgctaatttattctattagttttagtataggctattttatgtatttattttaattttatgcatcttattttcaattttatgttttttttttctttttatgtttttaattttagcatcttatgattttagccccagtgtttcttgaggggatcttttcctccagggattgccggcttggtcagcggttgttgctgcagttgttgcccttgctggggcggcaggggtctaattttacagcttcttggctgtgaaggggaccctggtgttgtcccggtctgggtgggcactgtggcgatgttccggtggccgggctggctcctggtatgaaaggattcccagatactgtttcctcgcagcagagctaagccatacttgtttatttatttatttatttatttatttatttaagttacatagtcatatttcattgtacgtgggagccatgggtcatgtggtttaatggaggggagtgggaagggtgaagggtgggttgggtttttattgtaatgttgtgtgtttactgtttttagtgttaaagcgcttcgagctgcacaaagtgcatgagaagcgctattttataaatttgatttgatttgatttga

SEQ ID NO: 2005 - protein, 878 aa, synthetic construct
  source 1..878: note = Description of Artificial Sequence: Synthetic polypeptide
MFFFSIRGGKKGGGTASIAHKTILSENILLSKYCSFEHHAFLFGDPPVLTVTVYRPPTPPSCFIEEFSEFLSSLHIRYNRILITGDFNLHVDKNDDIYACEFLNLLNSMDFQQHVTQPTHNRGHTLDLVITYGLSTGVSSVVDLAISDHYCVFFNVTSEIQQEASVRTVRKRYLTPEVAASFIDIFKQTPAQILPAPCDFIVDHFNNRLQSSIDAVAPFKTKTLRTTPKMPWKTDDIKGLKQNCRRAERRYRKTKLIIHKDILKEQLKIYNNSVKRARTSYFSKIISENKNNPKFLFKTIDILINKDFNKSSMPSSNAACEDFADHFMGKINAIRSNISSMQYTDLNRPPALFLPEETLGSFVLVDAEMLGRVVSQVNTTTCLLDPIPTSLFKTFYGFFESELLNIVNCSLQTGVFPSACKTAVVRPLLKKSQLDPKNLDNYRPVSNLPFLSKINIEKSVATQLHEFLNAQKILEKYQSGFRKNHSTETALLKIVNDLRLNYDSQKLSVLVLLDLSAAFDTVDHQILLDRLRSLVGLSGNVLKWFYSYLTDRHFYVSMDTCSSGIHEISCGVPQGSILGPILFNLYMLPLGEVIRRHGVDFHSYADDTQLYIAVSPDDLEPVNTLLNCILDIKSWMAENFLQLNQDKTEVLIIGSEDKREMILPHLHNFKPSQCVRNLGVLFDSELNFIPHIKNVVKTGFYHLKNIARVRPFLSLASTEVLMHAFIFSRLDYCNALLSGLPKKSISNLQLLQNSAARVLTRTRGREHITPVLKSLHWLPVRFRIDFKILLMVYKCFYGLGPSYLNDILLKYEPSRTLRSSGAGLLVVPKVRTKTYGEASFCHYGPRLWNGLPENLRAAETVEVFKKRLKTHLFNLAFS

SEQ ID NO: 2006 - DNA, 213 bp, Oryzias latipes
  source 1..213: mol_type = unassigned DNA
tgaaaggtcctatctgcacttttctttcctttccttcctttatttttaaatcatttttcaatttttttcttttcttttaaagtaaattttacgttgattatttctatgatgtattgtgattttaatgcatttttctgttttgtgaagcaccttgaattactttgtgtacgaattgtgctatacaaataaacttgccttgccttgccttgcctt

SEQ ID NO: 2007 - protein, 844 aa, synthetic construct
  source 1..844: note = Description of Artificial Sequence: Synthetic polypeptide
MSSFEYVSFKIELKQTPPLLCIVMYKPPQHSQSFIDDFTEMLSVVCTDFDGLVITGDFNVHVDNVNDRNAKELNAVLETFDLIQHVSCPTHSRGHTLDLLITKGVNIYNVSVVDVALSDHFCVFFDLSVAPKPPPGPAVVQRRQINESTRAQFVEMINPENASGANVDEMLNSVTSSILNVLDAIAPMKVKLRKHRQKAPWRNDDLVRAQKQQCRRAERKWRKSKLQVHYGMYKGELYAYNQILCRTRERYFSEIIGSCSSNSRVLFTTVNRLTNPPTQLPIELVCTPKCNEFAVFFNDKVQGIKKAINSTTHITIERPPTHSKLTHFVPVTDQTVQETITRLSSSTCCLDVLPTRFLKSVLNSVLPSITQIVNMSLQSGIFPEALKTAVIKPLLKKSGLDPTVLNNYRPISNLPFLGKVLEKVVYQQLTDFLLLNNSFDVFQSGFRPHHSTETALIKVTNDIRLNTDDGKVSVLILLDLSAAFDTVDHGILLHRLQDWVGISGSALSWLKSYLEDRKYFVEIGSCVSDYMALTCGVPQGSILGPLLFNLYMLPLGQLIRSNNISYHNYADDTQIYVSLTTGEYGPVDSLSHCLQQISAWMQNNFLQLNSNKTEVIIFGPQKQREIVSSYLHSLSLKPSNQVRNLGVIMDSDLNFNSHIKSVTSAAFYHLKNIAKIKNIVSKPDLEILIHAFVSSRLDYCNGLLTGLSKRAVKQLQYIQNAAARVLTRTRKYDHISPVLRSLHWLPVPQRIDFKAALLVYKSLHGRAPKYISDMLVPYEPSRTLRTSGAGLLLIPRVRTKQGESAFQYSAAKIWNSLPEVVRQASSVFMFKSRLKTFLFSRVYD

SEQ ID NO: 2008 - DNA, 383 bp, Parhyale hawaiensis
  source 1..383: mol_type = unassigned DNA
gcgtggcctgcgcgttatcaggccgcccccattgtccggccaccggacgcctctttgtttgtatgagctggctttgggtttggggctctgggtagcccctgagttggaggaaatgccactctaaaggcggatgagacctcttttggtccaacggcatccctgagaggagatgaacaggctggtgccatagctgggtactcagtcttccgcagtctgctcctctctctcttccatcaggtagtaccacctgatgctcttttcctttcctttctcttcttcttcttttcggccaaagcctgtactggtgatggcagggtctggggcgcgtagatagctggccgctttcgtagctatcgttactgtcgatttgtttttgctttatt

SEQ ID NO: 2009 - DNA, 99 bp, Parhyale hawaiensis
  source 1..99: mol_type = unassigned DNA
tagcagcgttttgggcttcccggtgttgcaagatgcttcatttgggttgtattacctgtccgtgggagctcaagcgtgaagttttaataataataataa

SEQ ID NO: 2010 - protein, 979 aa, synthetic construct
  source 1..979: note = Description of Artificial Sequence: Synthetic polypeptide
MLYTIFLVYGILCFFFVYFCIYLYITVYLCFLFFLFLLLCGDVESNPGPGRARGCRLLYCNIRGLHANLAELDFVSRGVDVVCCSETLVAGRRHDAELALAGFQSPFRRLCGSGPGFRGMAVYVRSGFCAYRQSVHECACHEIIVVRVCGRLNNYYLFSLYRSPATDDSLYDCLLTAMASIQSTDPKAAFVFVGDVNAHHRDWLGSASPTDCHGVAALDFCTLSSCVQLVRGSTHIAGNCLDLVMTDVPDLMTVTVGSPIGSSDHSHLVVSLDLNQVVPVVDTRRVVFVKSRANWVAITRAVRTLPWRQIIHSEDPVSELNDLTVSILERFVPKRTILVRSRDKPWFDDQCRLAFEAKQAAYRAWRRSRDRTLWQTYVDRRAEAKRVYEEAQRRLRQRSRESLLSIDHPHRWWSELKGSVFGAEPSLPPLVGPGGGIITDPLARAELLSAHFDGKQSRDVIALPHGCHPEPRLTSLAFRSGAIKVLLEGLDPYGGVDPVGMFPLFYKQLADVLAPKLAVIFRRLIRLGNFPRCWRTGNITPIPKGPVSPYVANYRPITLTPILSKVFEKLIAGKLGRFAEVTGLLPAGQFAYRIGLGCCDALLSVSHHLQSALDCRSEARLVQLDFSAAFDRVNHRGLLYKLESFGVGGRVLSIIRDFVSERTQSVSVDGVLSASVGVVSGVPQGSVLGPLLFVLYTSDMFSSLENTLINYADDSTLMAVIPAPRLRDAVAQSLNRDLSRISAWCSAWSMKLNASKTKSMIISRSRTLVPQHPQLEIDDTLLQESSSLEILGVVFDEKLTFEPHIRRLVSRASTKIGLLRKVNSVFGDSQVARRCFYAFLLPVLEYCSPVWASAADTHLRLLDRLVSSASRLCADNDLVNLSHRRRVAELCMFYKVYNNERHWLYSSLPALKVFGRETRAACGAHSFTLEAVRCRTNQFCRCFVPWSAKVWNLLPASAFGRIGLQAFKSAVNGFLLDFL

SEQ ID NO: 2011 - DNA, 678 bp, Pelodiscus sinensis
  source 1..678: mol_type = unassigned DNA
tggtacgctaagagcacggcaagacatgaaagatgccctggtcaaccactgcgcccagcccatctccaaccgtctcgactttagtcctgccattggagtaagatggaatctgggaagagagagtgaggctgactatgcgcacctctccctcactttaatccaattcacgcgcaagtcttgacatctcgacatctcctaagtcctgtggcgacgggcgagcgacgaagcagcaggtgtggatacactgggagctgtagccgcggacctgcacacaggcggctcaggtctaatggtcgtcttcttgctggtggaagcaacagctggattcggcgtctacctgagtgactgagcagccctctttaggattgcactgctcacctccgtagtaagaggaaggggctagaaaaggtgccctaaacattgtttgcttcacagaaccctggccagcttaccgcggctggaggggatcccatctcatgcggtcgaacaataaaatttcgaacaaaatgcaaggtgacaccactcactattggcacatggaatgtacgcacgcttcaggacaacccttcagcagaccgcccagaaagaagaacagccctggtcgccagagagctcacaagatttaacatcgatattgcggcactgtgtgaaactcgtctagcaaatgaaggtcagctc

SEQ ID NO: 2012 - DNA, 46 bp, Pelodiscus sinensis
  source 1..46: mol_type = unassigned DNA
tagatgtcaaggtcctcttcgaatacgatggacgaacaacaacaac

SEQ ID NO: 2013 - protein, 1015 aa, synthetic construct
  source 1..1015: note = Description of Artificial Sequence: Synthetic polypeptide
METGGGYTFFWRGRSSDERRESGVGFAVKNHLVRKLASLPKGVNDRLMTLHLPLPRGKQATLISAYAPTMTNPDEVKDKFYEDLDALLSSVKRTDRLILLGDFNARVGSDHTAWDGVIGKNGIGKCNSNGLLLLKTCAAHDLIITNTIFRLPTRKKTSWMHPRSKHWHLIDYVIVRRKDRQDVRVTKAMPSADCWTDHRLIISKLSFRIKPKRRPQGNKAVMKKINVSRLRNPNTATLLAEDLGNQLLELQLEENAEKDWERFRDIVHSSALKVLGPSHRKQQDWFDENDEEIKAILAEKHRLHRAHQNDPSSTAKKNAFNNIRRIVQNKLRKMQDSWLSAKADEIQKFSDRNDAKRFYEALRSLYGPQPSGSSPLLDSDGATLITEKALILQRWAEHFQSVLNRPSSINNEAIDRMPQADINHSLDVSPSETETLQAISQLSSGKAPGSDAIPAEVYKGGGAVLVNKLTQLFQSFWNQGSIPQELKDASIVHLYKRKGNRQVCDNHRGISLLSIAGKILARVLLNRLINHLEQGLLPETQCGFRKERGTVDMIFAARQLQEKCQEQNRELYTTFVDLTKAFDTVSREGLWRIMSKFGCPDRFILMVRQFHDGMTARVLDDGEASEAFPVTNGVKQGCVLAPTLFSIMFSAMLSDAFQNSSLGIRLRYRTDGKLFNLRRLQAVTKIKETVLRDLLFADDCALNAGSEQEMQASMDKFAAACDNFGLLINTKKTEVMHQPAPKAQHQVPTITVKGQKLQAVDQFTYLGSTLSRSVTIDIEVNCRVAKASSAFGRLLTKVWDRRGISLATKLKVYRAVVLTTLMYASETWTVYRRHARQLNHFHTICLRRLLRIRWQDKVPDTEVLSRAGLPSVYTLLMKAQTRWAGHVARMPDHRIPKQLFYGELFQGKRSHGGQKKRYKDTLKASLKSLDIDTTSWETLAQDRSTWHTLIYQGCQTSEARRTTIAQEKRALRKARVAKAATVVPTHVCPTCGRTFRARIGLISHLRTHHEQSITC

SEQ ID NO: 2014 - DNA, 98 bp, Petromyzon marinus
  source 1..98: mol_type = unassigned DNA
atattggtcgcgaaagcctacgtgttaaactgactaacctctatggggaggatacttttcttaaaaccagaaaattggagaagcttcgcattaagcgg

SEQ ID NO: 2015 - DNA, 452 bp, Petromyzon marinus
  source 1..452: mol_type = unassigned DNA
taatacacattacattttgatttaaagaattactaatctacaactcattactaatcataaccaatgactgattactaatcgattatataattacattacccccccctccgcctctaatcactgcacctgaatgagttaagtgatgacgtcaccctgctgctctatataaaaccgggagcaagcgagggctttaccattctggcgaattgcccgatgatgctggaagtatttaccagcgaaacgtcgtactcaaactgtaaatgtggattaactcttcaacacaccggtgggctgaagtagtgaattatttgtcttttgtcaacgtgacactttttttgctgattggccgtgtcgggtggtggagggttacgacacatttataaataaacgcgatctaacccaaaaacctttattatgaataatattggtcgcgaaagcctacgtgttaaact

SEQ ID NO: 2016 - protein, 748 aa, synthetic construct
  source 1..748: note = Description of Artificial Sequence: Synthetic polypeptide
MKLISSLAFLKRCRDSKVIPNAVKITHHIKSSKANQILHKASELLLIERIQHNRSELSYISESLKQLHLDISNSVSMHYWNIIDNITQQSADNVFKLTKTNQINKFSRLHNKQIPTENQKCKNKTVLNLTNTVLTGDMVSILSKGLNFAVTPRTIPVDEIIAEVESAVRLLPHNEAEMTRHEVAKIIENSKVPKVNISSNEAKALRELRVNKDIQILAADKGRTTVVMSRADYDNKIRNLLEESTYIKIKRDPTNTLERKTTAIIANSLIPKNEQYLIKPRASKPPRLYGLPKIHKIGIPLRPIVSTIGSATYQLAKYITKQIQPYIGKTSSFIKNSEHLVNVIKDIKLTPDDILVSFDVISLFTKVPVDESLKLLDTLVKNTGLQKDIPKLAGHCLNNTYFLWRGDFFKQKEGAAMGSPLSPAIANLYMENFEIRALASSTLKPSFWFRYVDDTLVVWPHGKDTLNDFLNHLNAQNPAIQFTMEMEVNNTLPFLDILLGHGLNGKITHSVYRKQTHTDAYLNAESHHHPAQKSSLIKTLVHRAKTVSDGESLVREIKHVKDALRQNGYNNAQINRALNAKSRSQSNTTESDQIVKTIKIPYISGVTDKLARVLQKQNITVRFGTVHKIQKLVSCTKDALPKLSTEGVYRINCSCGSCYIGQTGRNISVRLKEHQRNIKLSQTQLSAVAEHACQQGHSIDFDNVAVVCKTNYYWQRLIRESIEIERNKNNFNRSDSYRLSAAWKRIIK

SEQ ID NO: 2017 - DNA, 682 bp, Petromyzon marinus
  source 1..682: mol_type = unassigned DNA
taatacacattacattttgatttaaagctttcgtgactgcagtgattcatgttcttcgctctttcggtggagtcgcgttggggggaagcaataaaataatagaatatatatgtttgttgttttgttgtttcccttcggcgtggctttgccgagggagctaagaatatgaatgcacattacaattccttataggggaaacacatactaattaacggattactaacgtagcatataatcactaacacacattacaactaattactaatctacaactcattactaatcataaccaatgactgattactaatcgattatataattacattacccccccctccgcctctaatcactgcacctgatatgagttaagtgatgacgtcaccctgctgctctatataaaaccgggagcaagcgagggctttaccattctggcgaattgcccgatgatgctggaagtatttaccagcgaaacgtcgtactcaaactgtaaatgttgtggattaactcttcaacacaccggtgggctgaagtagtgaattatttgtcttttgtcaacgtgacactttttttgctgattggccgtgtcgggtggtggagggttacgacacatttataaataacgcgatctaacccaaaaacctttattatgaataatattggtcgcgaaagcctacgtgttaaa

SEQ ID NO: 2018 - protein, 593 aa, synthetic construct
  source 1..593: note = Description of Artificial Sequence: Synthetic polypeptide
MVDEIIAEVESAVRLLPHNEAEMTRHEVAKIIENSKVPKVNISSNEAKALRELRVNKDIQILAADKGRTTVVMSRADYDNKIRNLLEESTYIKIKRDPTNTLERKTTAIIANSLIPKNEQYLIKPRASKPPRLYGLPKIHKIGIPLRPIVSTIGSATYQLAKYITKQIQPYIGKTSSFIKNSEHLVNVIKDIKLTPDDILVSFDVISLFTKVPVDESLKLLDTLVKNTGLQKDIPKLAGHCLNNTYFLWRGDFFKQKEGAAMGSPLSPAIANLYMENFEIRALASSTLKPSFWFRYVDDTLVVWPHGKDTLNDFLNHLNAQNPAIQFTMEMEVNNTLPFLDILLGHGLNGKITHSVYRKQTHTDAYLNAESHHHPAQKSSLIKTLVHRAKTVSDGESLVREIKHVKDALRQNGYNNAQINRALNAKSRSQSNTTESDQIVKTIKIPYISGVTDKLARVLQKQNITVRFGTVHKIQKLVSCTKDALPKLSTEGVYRINCSCGSCYIGQTGRNISVRLKEHQRNIKLSQTQLSAVAEHACQQGHSIDFDNVAVVCKTNYYWQRLIRESIEIERNKNNFNRSDSYRLSAAWKRIIK

SEQ ID NO: 2019 - DNA, 1143 bp, Petromyzon marinus
  source 1..1143: mol_type = unassigned DNA
agatggcgccgatgatggcagcctcggccggttggtgcgccctgttttgtccagttttgtcgttttgtcttgagaggggcctgctgttcaacacactcgtgctggtgagagaggcctgctgttcatcacacccgtgctggtgagagaggcctgctgttgaggggcctgctgttcatcacacccgtgctggtgagagaggcctgctgttcagcacacccgtgttgaggggcctgctgttcagcacacccgtgctggtgagagaggcctgctgttcaacacacccgtgctggtgagaggggcctgctgttcagcacacccgtgctggtgagaggggcctgctgttcagcacacccgtgctggtgagagaggcctgctgttcagcacacccgtgttgaggggcctgctgttcagcacacccgtgctggtgagaggggcctgctgttcatcacacccgtgttggtgagaggggcctgctgttcagcacacccgtgctggtgagagaggcctgctgttcagcacacccgtgttgaggggcctgctgttcagcacacccgtgctggtgagaggggcctgctgttgaggggcctgctgttcagcacacccgtgctggtgagagaggcctgctgttcagcacacccgtgttggtgagaggggcctgctgttcagcacacccgtgctggtgagaggggcctgctgttcaacacacccgtgctggtgagaggggcctgctgttcagcacacccgtgctggtgagaggggcctgctgttcaacacacccgtgctggtgagaggggcctgctgttcaacacacccgtgctggtgagaggggcctgctgttcaacacacccgtgctggtgagaggggcctgctgttcatcacacccgtgctggtgagagaggcctactgttcatcacacccgtgctggtgagaggggcgtgctgttcatcacacccgtgttggtgagaggggcctgctgttcatcactcccatgctggtgagagaggcctactgttcatcacacccgtgttggtgagaggggcctgctgttcaccactacccatgctggtgagaggggcctactgttcaacacaccagtgctggtgagagagtcctgctgttcagcacacccgtgctggtgcgaag

SEQ ID NO: 2020 - DNA, 303 bp, Petromyzon marinus
  source 1..303: mol_type = unassigned DNA
tgtttttaacatttgatctacataacgacaccttgccgatattaactatgttaccctatttgtattttttatttttaaattatatcttaaagctattttatattcgatatttatttaattttatatacttcagccccttggtgttagttagacttttaacccttattatagtaagacttgtttaaaacttatttaagattttagattcctatatgttgaatgtatgcaccatcctgccaaagtaaattccgtgtcggtgtgaacttacatggcgaataaaaccctttctgattctgattctga

SEQ ID NO: 2021 - protein, 977 aa, synthetic construct
  source 1..977: note = Description of Artificial Sequence: Synthetic polypeptide
MALMMVASAGRCALFCLVLSVNSVFCQDFRSSLTRDELLNIRETTPVDLIPTFLLPAAELVGILVNAALGFAQATKRRPRGKRSGALVRLRRRGIRTVLPSFFLSNVRSLYNKMDELQLLMVKNKDFLSASALCFTETWLCDLIPDTSLQLAGFHLVRSDRDIALSGKTKGGGICFYINSGWCVDVTVILQHCSPLLESIFITCKPFYSPREFASLILVGVYLPPCPQVKEAQRMLADQILSVERANPDSLVIVLGDFNKGNLSHELPKYIQFIKCPTREGNTLDHCYTTVSRAYHAVPRAALGHSDHAMVHLIPAYRQKLKLCKPAVRTSKQWTSEAVEDLRACLDCTDWDMFTTATNSLDELTEAVTSYISFCEDCCIPTRTRVNFNNNKPWFSAKLRRLRLEKEEAFRSGDRDRFKESKNRFSKAVREAKRLYSERLKHQFSTNDAASVWRGLRQITNYKPRAPHTTNDSRLANDLNEFYCRFERQLDCPEPPLPTQEAPSPTNTTETTISFQEGEVNRLFKRQNPRKAAGPDSVSPATLRHCADQLSPVFTNIFNTSLETCHVPACLKSSTIIPVPKKLRPTGLNDYRPVALTSVVMKSFERLVLAHLKAITDPLLDPLQFAYRANRSVDDAVNMALHFTLQHLDAPASYARILFVDFSSAFNTIIPALLQDKLFQLNVPYTTCKWITDFLSDRKQCVKLGTQVSGSRSISTGTPQGCVLSPLLFSLYTNSCTSNHLSVKLLKFADDTTLIGLISGGDESDYRWEADNLVTWCSQNNLELNALKTVEMVVDFRKNTAPLTPITLLDSPVKIVESFRFLGTILSRDLKWELNISSLTKKAQQRMYFLRQLKKFNLPKTMMVQFYTAIIESILTSSITVWYAAATAKDKSRLQRIIHTAEKVIACNLPTLEDLHTTRSMRRARKIMADFSHPGHSLFQLLPSGRRLRSIRTKTSRHKNSFFPSAAGLLNKAKGLH

SEQ ID NO: 2022 - DNA, 226 bp, Procavia capensis
  source 1..226: mol_type = unassigned DNA
ggtaagcagggtaacaccatcaggtaaggagggagtgagcagcccccacttgtctgtcagtggaggcttgcttgttgctgtgatgcaggaagctatgccactggtatttaggtaccagcagggtcaaccatggtagacaagtttcagctgagcttccagactaagacagactaggaagaaggacccagcagtctacttctgaaaggaattagccagggaaaacctt

SEQ ID NO: 2023 - DNA, 522 bp, Procavia capensis
  source 1..522: mol_type = unassigned DNA
tctgctgcaaaggacctcttcaaagtattcaaaagtaaggatgtcaccttgaagactaaaatgcgcctgacccaagccatggtattttcaatcacatcatatgcatgtgaaagctggaccatgaacaaagaagacagaagaagaattgatgcctttgaattgtggtgttggagaagaatgttgaatgtaccatggaccgccaaaagaacaaacagatctgttctggaagaagtacaaccagagtgctccttggaagcaaagatggcaagactgcatcttacatactttggacatgttgtcaggaaagatcagtccctggagaaggacatcatgcttggtagagtggagggtcagcgaaaaagaggaagaccctcgatgagatggattgacacagtggccgcaacaatgggcttaagcataaaaacgattgtggacatggcgcaagaccgggcagtgtttcgttctgttgttcatagggtcactatgagtcggaaccaactcgatggcacctaacaacaacaa

SEQ ID NO: 2024 - protein, 837 aa, synthetic construct
  source 1..837: note = Description of Artificial Sequence: Synthetic polypeptide
MNSSQTLSDMVPESEPPRLEGTQKTTGEELPPQSRVNLNDVDGVRPLGSSFADVARLKMRRNSCKHPLIIGTWNVRSMNLGKLEIVKNEMECINIDILGISELKWTGLGHFESDNHIVYYAGNENLKRNGVAFIIKKNISRSVLKYNAVSDRIISIHLQGRPVNTTIIQIYAPTTKAKDEEVEDFYQLLQSEIDQTCNQDALIITGDWNAKVGNKEGSVVGKYGLGDRNNAGDHMIEFCKTNDFFIANTFFNQHKWRLYTWTSPDGIHRNQIDYICGKRRWKSSISAVRTRPGADCGTDHQLLICKFKLKLKKIRTSPREPKYDLEYIPPEFKDHLKNRFDVLITNDRRPDELWNDIKDIIHEESKRSLKRQERKKRPNWMSEETLKLALECRAAKAKGRNGEVKDLNRRFQRAAREDKRKYYNDMCKELEMENQKGRTHSAFLKLKELKKKFKPRVAIVKDSTGKLLNDSESIKRRWKEYTESLYQKELVDVQPFEEVAYDQEPMVLKEEVEAALKALAKNKAPGIDGISIEIFQQTDAALEVLTHLCQEIWRTATWPTDWKRSIFMPIPKKGDPTECGNYRTISLISHASKILLKIIQKRLQQYIDKELPEIQAGFRRGHGTRDIIADVRWILAESKEYQQDVYLCFIDYAKAFDCVDHTKLWLTLQRMGIPEHLIVLLRNLYMDQEAVVRTEQGDTAWFKVRKGVHQGCILSPYLFNLYAEQIIREAGLYEEEQGIRIGGRLINNLCYADDTTLLAGNEEDLRHLLMKIKDHSLQYGLHLNIRKTKILTTGPVSNIVINGERIEVVKDFILLGSTINALGSSSQEIKRHIALGK

SEQ ID NO: 2025 - DNA, 975 bp, Salmo salar
  source 1..975: mol_type = unassigned DNA
tccaagatggcgtagcagtcagacgtctttgtcctcctcttgtcgtgtcccgtgtatatatttttatatcttttttcttcgcatatctttttaatatttttcttaacctcaacttcaaaacactctcctgcaacccgcctcacccaatgtggaatagatatgctattttatttacctcgaactggaatccacaacagaagctagccagctaactagctactagctagtagtcagctagccacggttagcggtcatcagctatcctttagctcgaaaagctatcgccagtttgtacagcgcgactcagaccagagcataccggacctatttttctccatatccccggatttctaccgcaagctctggacatttacacctggatcattgcagctagctagctgcatccgagtgactactattggctaacgtttcggtcccgaagcaagcaccaattatcctggagctagcccatgctaggcccatctcccggctagctgaagagttccatcagccactccttgggctacaatacctattttgccaactgacctggacccgttttactgccgtgcggagccccaccgagccttcacgactggactaccgacgttatctgcccgagggagttatccaactggcccctccgtcgcgacgtaacctgaacgcccatctgctggcctgctaaccgcggatcgttagctgtctagagcatatcggactgctatctgaataggtctatcggacaatttcttgggccactatacctattttgccaattggactggtcccctctaccacacggaaccctactaatccatcacgactggtctaccgacggaaacgcacgaggtggctaaaacagacttcttccgtcgcgacgtccctctaaggcccttctgccagcttgctacctatggcccgctagctgtctgaatcgccgtgtccccagccagcccaactactcactggacccct

SEQ ID NO: 2026 - DNA, 375 bp, Salmo salar
  source 1..375: mol_type = unassigned DNA
tagcccatctataattagcccaaacaactacctcatccccatactgttatttatttattttgctcctttgcaccccagtatctctacttgcacattcatcttctgcacatctaccattccagtgtttacttgctattatttcgccaccatggcctatttattgccttacccctatcttactcatttgctcacattgtatatataactttttctactgtattattgactgtatgtttgtttactccatgtgtaactctgtgttgttgtatgtgtcgaactgctttgctttatcttggccaggtcgcagttgtaaatgagaacttgttctcaacttgcctacctggttaaataaaggtgaaataaaaaataaataaa

SEQ ID NO: 2027 - protein, 1103 aa, synthetic construct
  source 1..1103: note = Description of Artificial Sequence: Synthetic polypeptide
MITRLSMPLLNVNMPCPLLFWLVFIGLFHCRASSPAHYTLSNLSVPPPTHAMTSPGFNDVSRDNISLIITQCLGLPPLYSHPTIPLSVHYTLNLFYRPQKPAPFTLCSGRARRPILIAFSRTLILLLLCSSGDVEVNPGPAVPSSTPTPQALSFDDFCNRKSLGFMHVNIRSLLPKFVLFTALAHSANPDVLAVSESWLRKTTKNSEISIPNYNIFRQDRTAKGGGVAIYCRDSLQSSVLLSRSVPKQFELLLLKIHLSKNKSLTVAACYRPPSAPSCALDTICELIAPHLSSELVLLGDLNWDMLNTPAILQSKLDALNLTQIINEPTRYNPKAVNTGTLIDIILTNLPSKYTSAVFNQDLSDHCLIACIRNGSAVKRPPLITVKRSLKHFSEQAFLIDLALVSWKDIDLIPSVEDAWLFFKSAFLTILNKHAPFKKFRTRNRYSPWFSPDLTALNQHKNILWRSALASNSPRDMQLFREVRNQYTQAVRKAKASFFKQKFASCNTNSKKFWDTVKSMENKSTSSQLPTALRIGNSVTTDKSTIIENFNKHFSTAGHAFHLATPTPVNSTAPPTATRPSLPHFSFSQIQSADVLKELQNLDPYKSAGLDNLDPFFLKLSAEIVATPITSLFNLSFVSSEIPKDWKAAAVIPLFKGGDTLDPNCYRPISILPCLSKVFESQVNKQITDHFESHRTFSAMQSGFRAGHGCTSATLKVLNDIITAIDKKQYCAAVFIDLAKAFDSVNHHILIGRLNSLGFSNDCLAWFTNYFSDRVQCVKSEGLLSGPLAVSMGVPQGSILGPTLFSVYINDVALAAGESLIHLYADDTILYTSGPSLDTVLTNLQTSFNAIQLSFRGLQLLLNTSKTKCMLFNRSLPAPARPSSITTLDGSDLEYVDNYKYLGVWLDCKLSFQTHIKHLQSKVKSRIGFLFRNKASFTHAAKHTLVKLTILPILDFGDVIYKIASNTLLNKLDAVYHSAIRFVTKAPYTTHHCDLYALVGWPSLHTRRQTHWLQVIYKTLLGKVPPYLSSLVTIAAPTCSTRSSRYISLVTPKANSSFGRLSFQFSAANDWNELQKSLKLETLISLTSFKHQLSEQLTDHCTCT

SEQ ID NO: 2028 - DNA, 18 bp, Salmo salar
  source 1..18: mol_type = unassigned DNA
cttccggcgccgacagag

SEQ ID NO: 2029 - DNA, 642 bp, Salmo salar
  source 1..642: mol_type = unassigned DNA
taacattgagtggctgctgccaacatactgactcaactccagccactttaataatggaaaaattgatgtaatcaatttatcacttagccactttatattatttatattagataatgtttacataccctacattactcatctcatatgtatatactgtacgctataccatctactgcatcttgccatcttgatgtaattagatgtatcactagccactttaaacaatgccactttatataatgttttcataccctacattactcatctcatatgtatatactgtactctataccatctactgcatcttgccatcctgatgtaatgtatcactagccaccttaaacaatgccgctttatatgttttcataccctacatactcatctcatatgtatatactgtactccataccatctactgcatcttgcctatgccgttcggccatcactcatttatatatttttatgtacatattcgtattcattcctttacacttgtgtgtataaggtagttgttgtggaattgttaggttatattacttgttagatattactgcatggtcggaactagaagcacaagcatttcgctacacttgcattaacacctgctaaccatgtgtatgtgacaaatacatttgatttgat

SEQ ID NO: 2030 - protein, 982 aa, synthetic construct
  source 1..982: note = Description of Artificial Sequence: Synthetic polypeptide
MAASLRVPRKLCSILFFYVLFLTLLPQVILGFITYSREELLDIRATSTHQHYDQEYDFPEADPLFGPPPRTMDRIPAGDPKQRRRRRRGRRSGLLVRLRRRAHRAPLPSILLANVQSLDNKVDEIRARVAFQRDIRDCNVLCFTETWLTRDTLSESVQPPGFFTHRADRNKHLSGKKKGGGVCLMINETWCDHNNIQELKSFCSPDLEFLTIKCRPHYLPREFSSIIITVVYIPPQADTSTALKELHWTLCKLETTYPEAAFIVAGDFNKANLKTRLPKFYQHIDCATRAGKTLDHCYSNFRDAYKALPRPPFGKADHDSILLLPAYRQKLKQEAPALRSVQRWSDQSDSTLQDCFDHVDWDMFRIAANNNIDEYADSVCEFINKCIGDVVPTASIKTFPNQKPWIDGSIRAKLNARTTAFNQGKVTGNMTEYKQCSYSLRKAIKQAKRQYRDKVESQFNGSDTRGMWQGLQSITDYKRKTSPVADHDALLPDRLNNFFARFEDNTVPLTRPATKTCGLSFTAANVSKTFKRVNPRKAAGPDGIPGRVLRACADQLAGVFTDIFNQSLSQSAVPTCFKRATIVPVPKKAKVTELNDYRPVALTSVIMKCFERLVKDHITSTLPDTLDPLQFAYRPNRSTDDAIAITLHTALTHLDKRNTYVRMLFIDYSSAFNTIVPSKLVIKLETLGLDPALCNWVLDFLTGRPQVVRVGNNISTPLILNTGSPQGCVLSPLLYSLFTHDCVAMHASNSIIKFADDTTVVGLITNNDETAYREEVRALGVWCQENNLTLNVNKTKEMIVDFRKQQREQPPIYIDGTVVERVESFKFLGVHITDKLKWSTHTDSVVKKAQQRLFNLRRLKKFGLSPKTLTNFYRCTIESILSGCITAWYGSCSAHNRKALQRVVRSAQRITGCKLPALQDTYTTRCHRKAKKIIKDNNHPSHCLFTPLSSRRRGQYRCIKAGTERLKNSFYLKAIRLLNSHH

SEQ ID NO: 2031 - DNA, 334 bp, Salmo salar
  source 1..334: mol_type = unassigned DNA
ctatcagttagcatgtggaacattcagggcctaaactcatcaacctttggactgaagagtttagcactggagttcaacaaaaatcttaaagatgttgacgtcatcattctgcaggagacatggtgtaaggctgacattgtcactcactgtcccacaggctacagagaggtcattgtgccatcacagaaacacagctctgtcaatagaggcagagactctggaggattgatcatttggtacaaatccgaactacaaaatctaattgatcccctcaaaattggcaaatatcacatttggttaaaactgaaaaaagaacttgtactgacagaaaaag

SEQ ID NO: 2032 - DNA, 227 bp, Salmo salar
  source 1..227: mol_type = unassigned DNA
tgacagaccaatcaacctgcacatgtcctctactgtatgcttattgttattgttgaatgtatggttattttgacccttggttattgttgttactgttgtcccgttgacaatatttgattctcatttttatttatttttatattgtaaatatccaaaataagctttggcaatatgtacattgttacgtcatgccaataaagcgaattgaattgaattgaattgagaga

SEQ ID NO: 2033 - protein, 1131 aa, synthetic construct
  source 1..1131: note = Description of Artificial Sequence: Synthetic polypeptide
MCSFAQYISPPQNPHITQRRSSPPRIPILLRGDISPPQNPHITQRRYPPLRIPILLRGDIPPSESPYYSEEIFPTLEEETCHFQAQGNVLICGDTNARTGTLPDLTSTRGDSFITGHTVSNCLHLPHRNNSDSTVNKNGRDLLQLCRSLGLYFVNGRLRGDSLGRFTYCSPLGHSTVDYMITDIDPFSLSSFTVKPLTPLSDHSQITLFLKRTDMETTTHSQPSKLYNIRNSYRWAQNSTEEYQKATWNQNIQTLLDNFLDTTFTHSKEGINLAVKNINYIFRQTAKEAQLKLIKNKTKKITDDNWFDADCKIIRKKLRTLSNQKHRDPNNGELRLHYCETLKLYKRTLRTKKAQYNSKQLTLIEESINTNNFWQNWKKLKKSKQEELAIQNGDIWTTHFKTLYNTVQIDTNAEQRQIHEKLNGLEKAIKDNQNPLDSPITDQELYKKLQALKFKKACGPDGILNEMLKLTSAKFQLAILKLFNLILSVGYFPDIWNQGLITPIFKNGDKFDPNNYRGICVNSNLGKVFCSIINVLSKSQIGFIPKHRTTDHIYTLHTLIDKHVHQNNTKIYACFIDFQKAFDSIWHTGLFYKVIESGVGGKTYDIIKSMYTGNTCSIKIGKKRTEFFNQGRGLRQGCNLSPALFNIYINELATILEKSSAPGVSLHNSEVKCLLFADDLCLLSPTAHGLQQSLDLLEQYCQTWALAVNPKNTCPREDPGPVRPVLQDLCLLSPTAHGLQQSLDLLEQYCQTWALAVNPKKTKIMIFQRRSRSQGIRPKFSIGTKYIEYCTHYNYLGLKISSTGHLNEAVNELREKARRAFYAIKKQIQIEIPIKIWLKLIEYVIEPIALYGSEVWGPLAKQDFIKWDKHPIETLHAEFCKILLHVQRKTTNNACRAELGQYPLIIKTQKRAIKFWKHLKYSDPLSYHYQALQCQELSKEKSPLIQLVLGLSSQTCSTNTLKPQDQNIQSIRINQITTQSKQNYIAYWETQAQTQSKMQCYLALNRQYTVANYLTMVTDQNLRKTLTKYRLSEHSLAIEKGRHRKTWLPVEERLCNHCTTAEPETELHFLTKCQKYKTIRECHFPKFETLIQGFKDLSDEDRLPVLLGEDAESCGLAAHYIAACHKMRDSV

SEQ ID NO: 2034 - DNA, 1074 bp, Salmo salar
  source 1..1074: mol_type = unassigned DNA
ccaagatggcgtagcagtcagacgtctttgtcctgtcgtgtcccgtgtatatatatttttacatctttttcttcgcatatctttttaaaatattttcctaaaactcaacttcaaaacactctcctgcaacccgcctcacccaatgtggcgtggatctttttttttactaaagtatttctatttacctcagatctggaatcccacaacagaagctagccagctaactagctactagctatcagtcagctaaccacggctagcggtcatcagctaacctttagctcggaaagctatcgccagtttgtacaacgcgactcagaccagagcataccggacctattattatttttattctttttctctccatatccccggatttctaccgcaagctctggacattttcacctggatcttcgcagctagctagctgctatcccgagtgactactcctggctaacgtttccgtcccggagcaagcaccaattagcctgaagctagcccggccagggctcctgagctaccaccgaagcccactcctgggctacaatatccggaccccttttactgccggtacggggcacggagccccgccgatcctccacgactggactaccgacgttatctgcccgaggattccaactggcccctccgtcgcgacgtaacctgaacgcccattctgctaaccgcggcctactagctatctagagctacttggaaccctactaattccacgactggtctatcgacgtcaccgcacgaagaggcaaaaacagacttacccccatcgcgacgtcccccaaaggctaacttgcttgccccggtctgttaactgctagcttgcttgccccggtctgctaactgctagcttgcctgccccggtctactaactgctagccccggtctgccaactgcttgcttgctaacccggtctgctaactgctagcttgccagccccggtctgctaactgctagcttgtttagccccggcctactaactgctagcttgctagcatcggcctgctagctgtctgaatcgccgtgtccccagccagcccaaccactcactggacccat

SEQ ID NO: 2035 - DNA, 391 bp, Salmo salar
  source 1..391: mol_type = unassigned DNA
tagcccatctataattagcccatctaactaactacctcatccccatactgtatttatttatttattttgctcctttgcaccccagtatctctacttgcacattcatcttctgcacatctaccattccagtgtttaattgctatattgtaattactttgccaccatggcctatttattgccttaacttacctcatttgcacacactgtatatagactttttgttttcttttgttctactgtattattgactgtatgttttgtttactccatgtgtaactctgtgttgttgtatgtgtcgaactgctttgctttatcttggccaggtcgcagttgtaaatgagaacttgttctcaacttgcctacctggttaaataaaggtgaaataaaaaaa

SEQ ID NO: 2036 - protein, 1102 aa, synthetic construct
  source 1..1102: note = Description of Artificial Sequence: Synthetic polypeptide
MITRLSMPLLNVNMPCPLLFWLVFIGLFHCRASSPAHYTLSNHLVPPPTHAMTSPGLNVSRDNISLIITQCLGLPPLYSHPTIPLSVHYTLKLFYRPQKPAPFTLCSGRHRRPILIAFSRTLILLLLCSSGDVEVNPGPAVPSSTPTPQALSFVDFCNRKSLGFMHVNIRSLLPKFVLFTALAHSANPDVLAVSESWLRKTTKNSEISIPNYNIFRQDRTAKGGGVAIYCRDSLQSSVLLSRSVPKQFELLLLKIHLSKNKSLTVAACYRPPSAPSCALDTICELIAPHLSSELVLLGDLNWDMLNTPAILQSKLDALNLTQIINEPTRYNPKSVNTGTLIDIILTNLPSKYTSAVFNQDLSDHCLIACIRNGSAVKRPPLITVKRSLKHFSEQAFLIDLAGVSWKDIDLIPSVEDAWLFFKSAFLTILNKHAPFKKFRTRNRYSPWFSPDLTALNQHKNILWRSALASNSPRDMQLFREVRNQYTQAVRKAKASFFKQKFASCSTNSKKFWDTVKSMENKSTSSQLPTALRIGNSVTTDKSTIIENFNKHFSTAGHAFHLATPTPVNSTAPPTATRPSLPHFSFSQIQSADVLKELQNLDPYKSAGLDNLDPFFLKLSAEIVATPITSLFNLSFVSSEIPKDWKAAAVIPLFKGGDTLDPNCYRPISILPCLSKVFESQVNKQITDHFESHRTFSAMQSGFRAGHGCTSATLKVLNDIITAIDKRQYCAAVFIDLAKAFDSVNHHILIGRLNSLGFSNDCLAWFTNYFSDRVQCVKSEGLLSGPLAVSMGVPQGSILGPTLFSVYINDVALAAGDSLIHLYADDTILYTSGPSLDTVLTNLQTSFNAIQLSFRGLQLLLNTSKTKCMLFNRSLPAPARPSSITTLDGSDLEYVDNYKYLGVWLDCKLSFQTHIKHLQSKVKSRIGFLFRNKASFTHAAKHTLVKLTILPILDFGDVIYKIASNTLLNKLDAVYHSAIRFVTKAPYTTHHCDLYALVGWPSLHTRRQTHWLQVIYKTLLGKVPPYLSSLVTIAAPTCSTRSSRYISLVTPKANSSFGRLSFQFSAANDWNELQKSLKLETLISLTSFKHQLSEQLTDHCTCT

SEQ ID NO: 2037 - DNA, 108 bp, Salmo salar
  source 1..108: mol_type = unassigned DNA
taatcaaatggctacccagactatttgcacccccccccccccacgctgctgctactctctgttattatctatgcatagtcactttaataactctacctacatgtacat

SEQ ID NO: 2038 - protein, 979 aa, synthetic construct
  source 1..979: note = Description of Artificial Sequence: Synthetic polypeptide
MAPEGMAAVLSALNQPCYFVCFFALFVTCFVHNVAATVSYDRKELLDIRTAITHLKLDKEFFFNESDGRDILQTPDQAQIPVIRWRRKRRFRGKRSGCLVRIRRRVANLPLPSVLLANVQSLENKWDELKARISYQRDIKNCNILCFTESWLNDDIKNIQLAGYTLYRQDRTAASGKTRGGGLCIFVNNSWCTISKEVSRFCSPEVEYLMISCRPHYLPREFSSVFFVAVYIPPQTDAGTKTALNELYTAISKQENAHPEAALLVAGDFNAGKLKSVLPNFYQHVKCATRGKKTLDHLYSTHRDAYKALPRPPFGKSDHNSILLIPAYKQKLKQEAPVTRSIKKWSDEADAKLQDCFASTDWNMFRDSSDGIEEYTTSVTGFINKCIDDVVPTVTVRTYPNQKPWITGNIRTELKGRAAAFKERDSNPEAYKKSRYALRRTIKQAKRQYRTKIESYYTGSDARRMWQGLQTITDYKGKHSRELPSDTSLPDELNNFYARFEASNTETCMRASAVPDDCVITLSAADVSKTFKQVNIHKAAGPDGLPGRVLRACADQLASVFTDIFNLSLSESVIPTCFKQTTIVPVPKNTKVTCLNDYRPVALTSVAMKCFERLVMAHINTIIPETLDPLQFAYRPNRSTDDAISIALHTALSHLDKRNTYVRMLFIDYSSAFNTIVPSKLITKLRTLGLNTSLCNWILDFLTGRPQVVRVGNNTSATLILNTGAPQGCVLSPLLYSLFTHDCTARHDSNTIIKFADDTTVVGLITDNDETAYREEVRDLTVWCKDNNLSLNVIKTKEMIVDYRKRRTEHAPILIDGAVVEQVESFKFLGVHITNKLTWSKHTKTVVKRARQNLFPLRRLKRFGMGPQILKRFYSCTIESILTGCITAWYGNCSASDRKALQRVVRTAQYITGAKLPAIQDLYTRRCQRKALKIVKDSSHPSHRLFSLLPHGKRYRSAKSRSKRLLNSFYPQAIRLLNS

SEQ ID NO: 2039 - DNA, 413 bp, Salmo salar
  source 1..413: mol_type = unassigned DNA
gttccggaactccaatttgagcagcagcagctgaaaaatgagctcctacaaatattgaaatttacatggtttttagagtgaagtacatcggaaaaaagcaaaagaaaactgcaagactgaataggagaaaaaacaagcaacaaacaaagaagataggcttttgaaaaataactatttttcataaaattgtagttatcttagctagctgaattgtttaccagttgctaagcagttgctagggactcttttggaagaagctagctagctaacgaagaacaacaaagaatatctagttaacagaagaaaagaaagagaaaatcaggacagaagaaaaaggatatcaaagtgaaacagttctctaaagacacaggagacaataatacaagaaacaacacttctgtagcttgtcaact

SEQ ID NO: 2040 - DNA, 164 bp, Salmo salar
  source 1..164: mol_type = unassigned DNA
taggataaagtaatccttctaaccccccccccccccttaaaagatttagatgcactattgtaaagtggttgttccactggatatcataaggtgaatgcaccaatttgtaagtcgctctggataagagcgtctgctaaatgacttaaatgtaaatgtaaatgtaa

SEQ ID NO: 2041 - protein, 1037 aa, synthetic construct
  source 1..1037: note = Description of Artificial Sequence: Synthetic polypeptide
MCLSIPVLSSLHRPYKRFTPRGRCHSNLVVPARTTHVEFQVSGSLWNCRSAANKAEFISAYATLQSLDFLALTETWITTDNTATPTALSSSAHVFSHTPRASSQRGGGTGILISPKWTFSLSPLTHLSISSFEFHAVTVTSPFKLNILIIYRPPGSLGEFINELDALISSFPEDGSPLTVLGDFNLPTSTFDSFLSASFFPLLSSFDLTLSPSPPTHKAGNTLDLIFTRCCSSTNLIATPLQISDHYLVSFSLLLSSNTSHSAPTRMVLRRPNLRSLSPATLSSSILSSLPSAQTFSNLSPDSASSTLLSSLSASFDFLCPLSSRPARSSPPAPWLDDSLRAHRTGLRAAERKWRKTRLPADLASFHSLLSTFSSSVSAAKATFYHSKFQASASNPRKLFATFSSLLNPPPPPPPPPSLRMTSSTILKRRLTISDPRLLSQTTPLVLLTLPYPVLEALCYLLLPPESSSPSPPSSLSADDFVNHFEKKVDDIRSSFAKSNDTAGPAHTALPCALTSFSPLSPDEISRLVTAGRPTTCPLDPIPSSLLQTISGDLLPFLTSLINSSLTAGYVPSVFKRARVAPLLKKPTLDPSDVNNYRPVSLLSFLSKTLERAVLGQLSCYLSQNDLLDPNQSGFKTGHSTETALLCVTEALRTAKANSLSSALILLDLSAAFDTVNHQILLSTLSELGISGAAHAWIASYLTGRSYQVAWRESVSAPCALTTGVPQGSVLGPLLFSLYTKSLGSVISSHGLSYHCYADDTQLIFSFPPSDNQAANRISACLSDISVWMTDHQLKLNLGKTELLFLPGKDCPFHDLAITVDNSLVSSSQSAKNLGVILDNTLSFSTNIKAVTRSCRFMLYNIRRVRPCLTQEAAQVLIQALVISRLDYCNSLLAGLPACAIKPLQLIQNAAARLVFNLPKFSHVTPLLRSLHWLPVEARIRYKTMVIAYGAVKGTAPPYLQALIRPYTQTRALRSSTSGLLAPLPLRKHSSRSAQSKLFAALAPQWWNKLPHDARTAESITTFRRHLKPHLFKEYLG

SEQ ID NO: 2042 - DNA, 692 bp, Schistosoma mansoni
  source 1..692: mol_type = unassigned DNA
cccaaatgccctggtacggccgagagtggggagagtccactctccctctcgaaatgctctcacatggccacgcgtatatagcctctgccagggaagtcctactcactgccttctcgtggcgggggtgttgtttacgaaagtgagaggacgaaaagcgaatgtccggcgctttaaccgggttggtggacacggagggtccacctaggggagttggaaaaccctgattccaaaccaatggtgcacatgggctccagtatcctgatggaacgaatggcgaatgaacctgtcattggtcaccggctaccatgggactgcatctcctcacgatgctccactgccttgtggatcagacctttaggtcaaaggctcggggtgtggccccctaagaaaaccacctgcttcggtttgggcacccgggcagtatcacagcccacacacaaataaatgaaatgatgaattctattgacgatactattctcgctcatactagaagcaagacaatttacattattattattattattaccattattattattattattattattactattatttactacgtcgctaattcaccccctttatccccaatttgtgtaaccttacttttcaacttatgcagcagctcgcccatggtggaaaatctgtcctatctaaacgatctccagtcactgtctggttgaaagtga

SEQ ID NO: 2043 - DNA, 170 bp, Schistosoma mansoni
  source 1..170: mol_type = unassigned DNA
agagtggttctaactttcttaactgaaagagtcttctggttgtacatttcagtccgccttatcttttcatcccttctcttcctactttcattattttgtgtggcgcatatgtatctggtgcccttttgtaccaatatatatgtgtttaaataaataaataaataaataaa

SEQ ID NO: 2044 - protein, 1016 aa, synthetic construct
  source 1..1016: note = Description of Artificial Sequence: Synthetic polypeptide
MLPPIMNTEAVFLKPRTPFKLASFNVRTLMQIRQQIGLAMSLEGLNVDVCCLSETRIQDSSEVLQIRSPSVASKSLFHVRLSGDPVASSSGLAGVGVALSARAEAALIDWIPINSRLCAVRLESSIKVRRNRREKRCLFVISAYAPTDCSPDAIKDEFYHQLTVLLQKARSTDIVVLAGDLNAQVGRLGTEESRLGGRWGLVGRRTDNGDRLLQLCTDHNLFLASTNFRHSHRRCATWRPPSASQAWTQIDHIAISYRWRGCVQDCRSFWSTYLESDHALVCANLTLLFSGRRIDHHQRIDVSKLAATSVASKYRAELASRLATIPPKSIDEHWLHLHDAMKMASKAACGFAKRPAYKHWVSSGSLQLMEARRSTPGDREFDHKRRLLRNEIGQSLRKDREAWWSERANEMEAAAASGNCRKLFQLIRATGSKKSGVSETIYEDDGMPITNISRRLGRWAEFFEGQFNWPAAPATSTSLSCPPWPVTTDPPNEAEVRKELQLLKRYKSPGPDDLPPALFKDGGDFLTKELTVLFAKVWEQESVPTSWNESIVVPIFKKGSRCSCNNYRGISLLPIASKLLASIILRRLFKTRERLTREEQAGFRSGRGCIDHIFTLRQMLEHRHTYRRPTIVVFLDIRAAFDSLDRTVLWDCLLKKGVPEKFINILKALYTNTSGRVRAYNHLSPLFHSSSGVRQGCPISPFLFNFAIDDILETALMDVSNGGVDMLPGERLLDLEYADDIVLLCDNAQGMQSALNQLAISVRRYGMCFAPSKCKVLLQDWQDSHPVLTLDGEQIEVVEKFVYLGSYISAGGGVSDEIDARIMKARAAYANLGHLWRLRDVSLAVKGRIYNASVRAVLLYACETWPLRVEDVRRLSVFDHRCLRRIADIQWQHHVSNAEVRHRVFGRRDDNSIGVTILKHRLRWLGHVLRMSSQRLPRRALFADSGTGWKKRRGGQCMTWCRGMKESCKGLASVGPSRLPGWGPRDGATQWLETLSDMAQNRSQWRSCCNLLLLST

SEQ ID NO: 2045 - DNA, 1340 bp, Schmidtea mediterranea
  source 1..1340: mol_type = unassigned DNA
tactaccacaagacgggtattttggtaaatcttgaaaaatttcgatttaattaatgtttgagttaaaattgccatttgacttgtgtatgtgatttattgtgttaattaatgaattccaccctcttccagggaaaggtttaactttgcataaaattaaactctctgtctacacttagtagcaaattaatctagaatgaagaagcctgatggtatttttcccaaatctgctgaaaacttagttctgaaggatggaaataaaagcagataaagattcaatattcgataaagaaatggacctcaacaatcaatgtcaattatcaataataaatctgggcagatgtcagaaggcgataatcaaatgctgaattccaatgaccgaatctactttgatgtcttagatttgtgatcagcttccactacaaaggtgctgcatcaaaagccaatggagattcaatgccggatgaaaatgccgatgaaagagaatcagagccgaggacaatttagagaaaattcgattgcaactgcgtcaagagttcctcaacaataagatgaaatatcgaaactcaattggatcttttgcttttggagagtctcagaacggcaagctccatgtagagctgtgtccgatatgaaaaattcaaaattgttatattaataaatttttactatagtactactgagtgattttgttaagtctacgacttagtcgtagacgtagttgtaggcgttgttgggcgctgatgggagctgatgggcgatgatgggtgcggatgggcgatgatgggtgctgatgggtgcggatgggtgcggatgggtgcggatcggtgcggatcggtgcggatgggtgcggatgggtatggatgtgtgtggatgggtatggataggtacggatgagtgtggttctagaatgtaggtaggtgtggaagttggtaggtgtgtggaaggttctagaaggtaggtgtgtggaaggttctagaaggtaggtgtgtggaatttggtaggtgtgttggtccacaactacgtgacataataacagttaggtaatgtgttggtccacgtgacataataaagttaggtaataagtgtgtctccgagtagtgactgaccagtaagtacgtgacataacaatggtgacataataagtgtgtctccgtgtagtgactgaccagtggtcaagtgatgtaatcatgaggtcactgaccaaaggtcaattactaggtagcaactgagtggacaaaggtcaatctccaggtagcaacagcgcgtgcagaggtcaaatgttacgtaataattacgtaagccaaggggggttgtatctgacgggctcacatcctactact

SEQ ID NO: 2046 - protein, 2266 aa, synthetic construct
  source 1..2266: note = Description of Artificial Sequence: Synthetic polypeptide
MKIEIGEFAALFQRFFEQLNAKSKQEEEFRNESVPGSRVPSEDMPVFQINERFHALERSNELLNGKMDSIVNTLNYLISGLNGNFDNNNKLNCICKTNHVKEPLSIVKTNLVSELPSALLVQNKVPCLKLSEEDLIRKIPTKIVPSKKVSKKTIEHTSRVNFSLFVRVLDSNERQQFFKLFPNLFALLKSKESEKKSEVLNIELTKISKKDNPLNIAGFKNFFFRNNNICVTIDFYNSSKVKSKITKNLKIKTSLINSKIVKNYNTNKFIPASLSIKKFLFVLSDKLAETTNISNVTVREEQINKIITLLKIKNSLPDYLVKSQIKYKDGDFLMLDLLNSCEIEGELGQKITELSRSQIKELFNSFPEIQELFFIEKKANSGTFFHRKKSIDENPEKLINLINKFKIEKTFPQQISFVGGKFVKIDKLNDSQFPQVESESDIMFNLGLFSLFGLSEYDNILNSLLCQPKSPEKLVDIIFHLNYLNLKGNFDTSTNGTYENYVQNYIVNCLLMHSILDLETCAFLNLDNIELWAPKLIELIPSSSHYSSSCKEKLLKLKQWKLSGEIDRIHNIICPETIIEINNFLGVIDQSYTTKSDQLKFLTSLGEKINNIEIDNDVDDLVKAKRMLYFIIRDKKRFLNKDNFNYRIPFNCRKICTLKMSDFITKLIQSNELFEEREAVVDNNIDVSPNENLNILIVEPVNPTPDTVIVGQMDTFPTDIDETEPVTIDKPLKKITSKQAVKPKAQKSKREVPASVSISVPISEETDADSTIINYFFPERDPKIWFTDDDIDYYLESHIGNPNFAPVKCFIVEILSSNCKDEIFPMPDNLFKAQIILCPLNINESHWILFVYCKLTKISYFVDPILRKRHNLINKSSALKITMALNNLFDLKAAVTFHPHDNLVYQDNNYDCGPYICAYAMLISQEWQTFPNNFIETIRKNVHRFQTSKFQNPPKVSGGGITTLPIFKRFQNVTRPPKVALPYKASLQNENSCVPSLIKEWFSNKNYITVLSPELTLNLIAHNNQFIRENVTFRQFTRVKYVIAVIPNNPHWCLYIFSPVFEHSYILNFQGRVLNERLVSIGESMTDYLNKFFISTAKVNFIVNHNQTHFSFRSEDPHFFASAFIEFLERFFFGNILSFTKINETLKSFKLQITNEICKNLNLINFSINDEIITKYFKNLNLPSNFIFLNSAMCTAIMDDCTRYLNDFLNYDNIIKAQVIFAIVAPPKFREILFIIDYNTDEYYLLNPTTLLGNDNYLSTCKILRNKINEIRESPNRVLNLGECPHDIRGSGLVSKILFCSYMSNYANDLPLVGLNLRQIGNVVSSFLPIVSEIKKVKSLENNIINQNHKESENLKERKNKIDQLLIKVFKMNVDEIVDVILDQISIKTVPTHKPYLGNKERVESQINKSNLIKNFNSDMKTTVNTIINDVDVDVRPKYENIITNFEHKIPLDRTWDKVFKFCNRSDKKLKLKYLSNSEVLFELKKADNTSPGVDGIKYRDLVMLDPEGKLLTFLFNKIISKKVIPDSWKSFKTLLIPKPDKGDKYDNVSSWRPIALLSVIYKLFASCLANRLTFWINKNNLLHIGQKGGSRHDGCVEHNSILSSALEHSKYSKNSPLAIAWLDIKDAFGSVPHAYMWSLLRFVGVDEEFVTILERMYSDTSTFYSCGPILTPNIAIRQGVKQGCPISMILFALAINPVLEAVSRSKCEPFMIGESAVKILAYADDIALVSKSAYDLQRVTNIAVAIASEIGFEYRPEKCGYIELPLIETESQILINDIKIKKLASSEFYQYLGVPVGEETDQSPYDILKKVVSDTRKIADSDLLGWQKLKAYKIFLHSRLVFPFRTREIKTSALAKSNANNNLTVNITSQLRNCFRKMMSLPNHSEVCYFYNSTENGGANCVDLLDEYHTQTITHFFRLFTSSCEFARKVNLDSLNFVAGPRLGIINPTLQERFDWINGKEPKPRHSGKKTRFQRARIAIAFFKKEHDINIMFIVTKGQPSLFITSEKRGTFILTPDLRKTTSKVLHMALCDSYLSKWEKSCTSNFIASAIKLSPKINKAIYRGDISEFAWHFIHRARTNTLSINAKPHNKGNKRLCRLCHTEDETMSHIIQSCKIHLTLGSERHNDCLDLISSHLSKNSNLIVVVDHVCSLVPESKERVDLMITDMVRKKIFLVDMKCPCDTINNFALVDLLNLQKYDSLKMQIQDAKPDFKVELDTCIIGSLGSFPPKTPELLLKIGVDRTHLKGLLKDCALSNISHSARRWH

SEQ ID NO: 2047 - DNA, 1814 bp, Strongylocentrotus purpuratus
  source 1..1814: mol_type = unassigned DNA
caatcccttgatatgtgtattgtggaaaagaactgttgtgagaacttttgtttttgcattaacgaattctccaaacgtcgaaaattcaggaatgtaaagtgaagaaaaaaaattccccgccatatcgtacttggaggtatagattttaagactcaagaatgtaagccttgtgacattccatgagatgtaatctggttggaagtaccatgcaatttaaagcaccagtcaaaactcatgaatgtaaagagaaaatagtacccgccaatttgtactaatataggcataggtttgccttattgcattccatgagatgtctagcttgttacttaatctttaaaatgtgtcattagaggaatgtgaacactgtacaacgcaaattatagaacgggttccttttaaagatatttacaaatggagagggggagtggtttggtgtgcatgtgtgtgtgtgtgtgtaacttacatacatacatgtacatcgcatttctctttccttttccatttggtgagcaaagtaatccaactaatcaatagccatgaacacgtgagaggcttcctcagctatgattggtccgcgagagctggagggcgaaagtgtttcttttgttcttttcgtcaccggcttctcgtggtcaccaacgccggacatgctgattggctgaatggtctttgcggcagcaggagggcgggacgtgttttgagacaagtctcgtctccagctggtcctagacatttcagttgatcgagataaatggcatctgaaatatacaacataattgtcgatttgtttctgctctccccccccccccctttaatagtaaatatccatgtaatcttacaatcttagcaggaggattaacgttagtgccttgtgaagcaagcataattagatctcgtcaccggctgcttgtggtcactgtctatgacggcaggtgggcgggacgttgttcttttatttagaaaagtctcgtccccagccagttttagacaccagcgaggtctttaaatcaactataaattttatatctagactctgttttgagagaaattaaaaggggaaaataaataatgcccttttacggttaccttaagccggtcgttaacagtgaaaaaaagaaagaaaaaaagaagaggaatagttcaaaagttaattaattcgttttcttaaaataaaaataaaataaaagatgggaggggaagaaactccttatatactgtaaagtttataatggtatcaaaagccatttggtggggtacaagctgttgaagcttaaagtatgcacggggtttatttattacgttcgtttattacgttttttttcttttaaaatattatatatagccgtttgagcctggggctaaagtatcattagttacacattatctgaatccgttaattatgaggtcaagttatatcgtctggagttatgataaattgctctgttttattttcggtgttggtttttttttttttttttttttgtcacagtaagaagactgtattaatactttgtgtaaaaggctgccacgccatgatttagaataagtgatgggaggggtttcgaacatgccagcatatattatgcttatgtgtatgaatgtggttgatagtgttgaagggtggggtgatggtatgtgtggtatgttttccggttccgatgtctgcctgtacttgtttaatttgcaatctaacttgaaagcgtttgtttttcctagagttggaaatgcatcaagcttcccatctactgtgaaactgtcaccactatgtacatttctaaaggttctttgttacaggtatagattcatagttcttg

SEQ ID NO: 2048 - DNA, 427 bp, Strongylocentrotus purpuratus
  source 1..427: mol_type = unassigned DNA
taatggatgtgggtattattattattattagtattattaattctctctcgtgtacaggtggacaaaccggaacaggttgcatgcagtgtgtgtgtcggcgtgaagggggtatgatgagatgggtgggctagggggggggggggggtaagagtttgtgtggtgtgagttgagggaacaggttgcatgcagtgtgtgtttgtgtttgtatggttgtttatgtgtgtgaaagggggtgtggtgtgggtgggctagaggggagggggggggggtgtgagagtgttgtgataggatggtaatatgtaattttaaaccttcctctactgttattttgattattcactgttacatgcaagacttttttttcccctttttttttctctatgttcattgattgatgtaacttatgaaatgtcttgtatcaaagatc

SEQ ID NO: 2049 - protein, 1251 aa, synthetic construct
  source 1..1251: note = Description of Artificial Sequence: Synthetic polypeptide
MSVNLKLLSINVRGLRDRVKRKKIFQWCKMSANMIFLQETFSTEDIEYSWKGDWEGSMFFSHGSNHSRGVIVMFKPGITFVVEKTLIDEGGRYVIIKGKCQGEKLILGSVYFPTRNKENAQCDFLSDLNKIICSVFSQEYSLIIGGDFNVIMNHNLDYMGASNISKSKYRDSLLDFLDKLDLIDVWRKRHPNKKEFTFRQKQPLVQSRLDYIFISSKVDKLIRKSEILPSITPDHAGVRIEFNNLVDSFVYGKSYWKFNSSLCNEKDFVDGVKKKISEIEETWRNQITSKIKFWDFMKMKLREYIMKFSRERAKLRRVHIAKLEKEIKDLEYRLTINIDCHKSIQDEIDMKKMELEKLFDYSRQGLKVRSRTEWSEEGEKNSKFFEQLLKSNKRKSVIKEIYNENKETVRDGKGILKIIREFYENLYACKNGEITEDIENMFLNELPKLSKENKEYCEGKITLAECYQAVKEMKWNKSPGNDGFSTEFYFTFWPILGKTIVEAFNESFETKMLSNSQRQGVITLIEKEGKDPLYMKNYRPITLLNVDYKILSKVLATRVKEVLEDIIHYDQVGYVKDRNIGEAVRLIDDTFFQSLYQPVGFLIAVDFEKAFDCISHKLLFKALEQFGFGKVLCSWVKTLYTNVSSCVMNGGHSTGYFGINRGVRQGDPLSPYLFVIVIELLARYIRKDESIKGVGFGNKEIKQVLYADDITLFLKDMDSINKVKKVFKNFEKLSGLKINMDKTNFMWLGEESDRPGLPFFGHRVQHIKILGVYFARHSKIKDDLNYKEILSKIKRLIGWWKQRDLTMFGKIKLLKIYVFSKLNYVSSLMTVPQNIFEEIEKISFNFIWGGRDRIKRKILYQDYCAGGLRVTNFKIFIKTQRIMWIKRLLYGEKYSGWKVTFDHFFRSLGGRIIFLCNYDINKMDLKGIPSFYKDMLKAWQELDKCRHFGENKNNPIIFSNKCICLSNKTFFDVELFQKGILQASDIIVRGHLKPILHFLNLGFETKSLLRIQKIFSAIRNDWIQSDFMEVDTENFEIELMIFGRLQKLCDIKSRRLYDYFIEDLQKEYTLHVTDGNCQFDLGMTELKETFTRMKCAMLCNKHREFQYKQLQGAVYTKRELFKFGFESDHFCSFCRLEVETYQHLFLDCLKVKRLWQEVIQKLHLIEIDIDDWKPIFMGISGNTARIFVINCIIFLVKYIIFISRKEGTLPSVQKTVHMLKNYRDEEYKIAFKKGKLGMHLQKWEQIDAFLL

SEQ ID NO: 2050 - DNA, 127 bp, Oryzias latipes
  source 1..127: mol_type = unassigned DNA
tgactggagtctggaaaaacaaactgcacctttgctcatcctaattgttcgctactgtcattgtcacttttgcacatttgcacttttagaactgccactcgacatcttgtgtttttgtgtgtatgtt

SEQ ID NO: 2051 - protein, 456 aa, synthetic construct
  source 1..456: note = Description of Artificial Sequence: Synthetic polypeptide
MQVNKALRRINTRKATGPDNIPGRALRACANELTDILTSIFNLSLSQRVVPSCFKTTTIVPLPKKSPPTCLNDYRPVALTPIIMKCFERVMLTHIQSSIPDTLDPLQYAYRPNRSTSDAIAAALHTSLSHLENKDSYIRMLFIDYSSAFNTVVPHKLTHKLFSLGIHPIICDWLLDFLTGRPQSVRIGNRTSASIITNTGTPQGCVLSPILYTLFTHDCVASHKDNIILKFADDTAVIGRITGGDEAAYRREVASLVTWCEDNNLTLNTDKTKEMIVDMRKERRNPHQPLLIRGLEVERVSSFRYLGVHLSQDLTWTLNTSQLVKKAHQRLYFLRRLRRFGMSPKILSNFYSCMVESILTSCITVWYGSSTAADRKRLQRVVKTASKITRTPLPSLQSIYKRRVCRRAASIIKDPTHPQRGLFTLLPSGRRYRSVKCRTTRLKNSFFPSAIRLLNS

SEQ ID NO: 2052 - DNA, 374 bp, Daucus carota
  source 1..374: mol_type = unassigned DNA
catgaggtgatagtcatgaatccaaatataatagataaataagatatttttttaaggtgcagttctgctccctaactaatagtagaaataaagtaatggttataagggttctctaaaacatgacccaagttaataaatgtctctaaccaaaaaatgtctacatttttaatgtgttttttatacgcaataaattataactaattgaacatcactaaaattatagacacaattgggataaaaagttaggcacatttgaaaactttacaaatataaggacaaatccgacagtggcttaaaaatccaaatttggaccaattctagcctaaatcttctcaacgggggcctgaattacggtccaaatttaggccacttag

SEQ ID NO: 2053 - DNA, 273 bp, Daucus carota
  source 1..273: mol_type = unassigned DNA
tgagggttatggtgtatgtttaaagggagggttcagctcagtcattaccagatgcattagcgccaatcaaaaatgtttgggtaagtcccatgtgaagaaggccatgggctaaggtattatattcttattatagcacacactattttatttgttgtgcactaagccgggggtcttcacggaaacagcctctctactttaagggtaggggcaaggctgcgtacatcttaccctcctcagacgctgctcactgagtatgtttggtttggtttggtt

SEQ ID NO: 2054 - protein, 850 aa, synthetic construct
  source 1..850: note = Description of Artificial Sequence: Synthetic polypeptide
MANTIESMTFWGCLDDLVRSITLDQFLFVGGDFNGHIGARADGYQGVHGGFGYGVRNDNGSTLLEFATAHDLVIVNSCFRKRDDNLITFRSGGHATQIDYLLIRSRDFRFCSYCKVFPVEACASQHRLLVMDLSLDGPPMEGLRVVTPRILWRNLHGSKVAEFKDMLEGFFRLEDDVDQMWIRMADLIRGVARRTLGVASGNVKEQRESWWWNDDVQAKVQFKKGCFLEFMSCPEGPDRHIKRELFKLAKRMAKQAVAEAKTKAYQDMYRRLGTKEGVNEIFKLAKARNKRSQDIGAVRYIKDEGDRVLLYDGDIIARWGRYFSELFNAARGREIVFEQENVNVSHNDVGMSQDITMAEVRVALGMMGKGKTVGLDEIPIEVWQCLGEQGVRWLTALFNVIFRTSRMPSEWRLSVVVPIYKNKGDAQSCSNYRGIKLLSHTMKLWERVIECRIRRIVTISVNQFGFMPGRSTIEAIYLIRCLMEKYRECRKDLHMVFIDLEKAYDSVPRVVLWRCLAARGVPEVYIRTIQDMYSAVGTCVRTPVGDTQYFPVEVGLHQGSVLSPLLFIIVLDVITRDIQAPVPWCMLFADDIVLIAESRSEVNVKLEQWHMSLEGYGLRLSRSKTEYLWANFSEEIHEADVAVCIAEGRVPQTNTFKYLGSIIQSNGDISADVTHRISTGWLRWWAATGVLCDKNVPLKLKGKFYRVAIRPSLLYGSECWPLRKAQERRLETAEMRMLRRICGNTMTDHIPNDTFRRLLGVESISKKIREGRLRWYGHVRRKCNSAPVRRVEHISVRGKRKRGRPRRTWADQLSLDMGALNLTGDMTLDKNDWRRRIRVVETRSRGSQRL

SEQ ID NO: 2055 - DNA, 1495 bp, Lottia gigantea
  source 1..1495: mol_type = unassigned DNA
tacgatatatagacacagctttatggaacaacaatcactggttaaagttttatgcaacgtttcgacgtgtttcccccgtcgtcctcaggcacataatgagaagaagtgatgggcaaactatatatacattaatgcttattattaagaacacacaagagataaatggtttattgatacattacattaaattttaacaggtacaataagaggtatataattcttaaaataacatacaggctgattaagtaaaataattgaaataaagtaaatgaattaaaaaagattaattgaagattaaataaacaactattgctggtattggagtcttttattaatagaaattacattgttcatataactaactatgcttaaagttggaaattgtttattaaatacatttatgaatatgatgataagtttatcatatgcatgcgataaacgaacaccttcatctctgttaaggtcaggctgatatcttctgatgtggatagcttcatgaagtctcctggttttatctatgtgcttattgattgtcagtatgttggtgttgtcaaagttgactttatgtcctgttttccttcccatagcaagatgttcagccacagcagatgttccttcattgccgggcttgtcttgatggtctttgagtcgaacatcaaggggtctctttgtttcccctatataagaacttccacaggagcactcaacttggtagacacatcccttaggtttttggttgttggagggattcaatttaccactggctctgagcaaatctttaagcgttgagttgccagagaacactgtttcaatgccgactgactttttcaggatcttcttgatttggtatgatgcctttccgatgaatgggatagctaagcgggttgatggtctgttgggattaggctgttggttggttggttttgccattaatacggatcgaaaagcttgatgtacaaaggctggagggtagttgttgtgcaagcaaaatactttcttgatgtgttgtaattcttgttgaaagtattctgggtcacaaatcctttttgctcttctgaccagcgctgtgatggctgcccttttgacatgttgaggggtgttggaatggtagttcacatactgatctgtatgtgtaggtttcctatacacgcatgtcttcaactgaccgcctaaccgcttaattctcacatccagaaagggtatagagtcatcttcttctgcttccatggtgaaattgatcctcttatgctgagcattaagatgctgaagtagagctgatgggtcatcttcagctctaagcatgacaaaggtgtcatcaactttccggaaccagcagattggtgagatcggagaggtttccatggtcttttcctcaaaggctgtcatatagatttcagtaatcaatggtgacaaggggcttcccataggtagaccgtggatttgttcatagatctcatctccccatgtgaagtaggtagaggacatacacatctga

SEQ ID NO: 2056 - DNA, 402 bp, Lottia gigantea
  source 1..402: mol_type = unassigned DNA
taattattcatattcaaacaatttccaactttaagcatagttagttatatgaacaatgtaatttctattaataaaagactccaataccagcaatagttgtttatttaatcttcaattaatcttttttaattcatttactttatttcaattattttacttaatcagcctgtatgttattttaagaattatatacctcttattgtacctgttaaaatttaatgtaatgtatcaataaaccatttatctcttgtgtgttcttaataataagcattaatgtatatatagtttgcccatcacttcttctcattatgtgcctgaggacgacgggggaaacacgtcgaaacgttgcataaaactttaaccagtgattgttgttccataaagctgtgtctatatatcgta

SEQ ID NO: 2057 - protein, 655 aa, synthetic construct
  source 1..655: note = Description of Artificial Sequence: Synthetic polypeptide
MRSTMLSNEFLTKSVINLSQKNLTDEQINLLSRGLKFSPVTKLKNHDDFIVNIERGLHQLAPGGHINYLRHQVTEILAKNKIQPNNLTKVQRDALTDLRQDNKIAILPADKGKATVIMDKKEYQETVTELLSDAKTYRRLRKNPTSIYKDRLDKKLNELESSNQITNQLKFKLRSSRHPRSPYARATIKIHKNPIKARLLICSRDSVFYNIAQHLSRILAPLGKTADSFIKDSEEFVTKLKELQITGKMYSYDVVDLFTNVPCKDVLSIIRDKISKLETPLDTTLTTDSIVDLIQMCMSSTYFTWGDEIYEQIHGLPMGSPLSPLITEIYMTAFEEKTMETSPISPICWFRKVDDTFVMLRAEDDPSALLLNAQHKRINFTMEAEEDDSIPFLDVRIKRLGGQLKTCVYRKPTHTDQYVNYHSNTPQHVKRAAITALVRRAKRICDPEYFQQELQHIKKVFCLHNNYPPAFVHQAFRSVLMAKPTNQQPNPNRPSTRLAIPFIGKASYQIKKILKKSVGIETVFSGNSTLKDLLRASGKLNPSNNQKPKGCVYQVECSCGSSYIGETKRPLDVRLKDHQDKPGNEGTSAVAEHLAMGRKTGHKVNFDNTNILTINKHIDKTRRLHEAIHIRRYQPDLNRDEGVRLSHAYDKLINL

SEQ ID NO: 2058 - DNA, 791 bp, Strongylocentrotus purpuratus
  source 1..791: mol_type = unassigned DNA
tccgtttctgcttaataaatgtgttaatatatttccagagttttgtctggggctgtcgtattatcaagcaatatgcttacaacgacagcccttcttccacatataattttataatgtgtcataatgtttgataatccatgaatgcagaagaaatcaaatcaaaatcaaatcaaaattcatgtatattgcatactttaacttctggccaatcagcgtagttggccttttattgtcaacgataacatcatccctggactacatttggcggcagatggcgtgcatcttaacaaccatggaatacgcgtaatggcgcgaaacctcatcactcgtctccgagatcagtcaagcgtcactagaagtagcccgccgtctgacccactgcccaatcagcgcccgcgatctccgaatacaatgaggaccgatccattctcgaatcggcaagactccgaaagctcctcgcacgccatggctgctgagaatgataactcagcttttcggagacgccaacatcgcaaattccgcaaaaagccgaaggggagagttttcccccgagactggctcgactgtctccagacggcccgcacgctcctgaatcgtcaagctcagcaatagatgatagcgataatttaagtcttcacgcggaggatcttaatgtaaacgctacaaatgtaataaacatcaatgagaaacaaacgcaaattgaaaaaactacagcttccaaggatgaaagtgaactaaatgaaggacacaatgtgacaaatacacaaggatattatgaacttgttgatggc

SEQ ID NO: 2059 - DNA, 852 bp, Strongylocentrotus purpuratus
  source 1..852: mol_type = unassigned DNA
gtctggaacgctcttgttcattgccgtgcaatatgaatgctgcaatctcctttaacattttattttaattagcacacgccaataatgaatcttgcttacttattttatcaatatgctaaacaacattatcattgatgtttttttttttaaacctcaatcaaggaatctttgaaattgtatttcatgtacttaagcaataccatgttatgaattgattatgatactaacatatgcatgttattatatttatgtgcataatatgtcaactatttgtttttataattaatagtttaaagtattaaatgggaaagtattaatagtatatatggtataacgtaatggtgacggcaaacttttttaacattgaaatatattgcaataatttgttttgatatttataccatactttgttttaactttaacctaatactatgtgttattgcgtacaaatgtcaactacatgtatatatatatatatttcaattgtgggtttttgttgttgtttgtttacaatagttttaattataaactgggaaagtatttaattgtatacattttataattactcaatggtgacggtaaactttttttaacattgaaatattcgcaacaattttataaatatctatagcataccttatcttaatttgaacttcgtatactatgaaatgtactatatcgcctttttattgcatgtccgaattatctctcatattataatgtgcatttattgttgttttgattgacattattattgaaccatgtatgttgtaaagggccctgatgaaaaccagctcatgctgatcgggctaccctttttaaagatgtgaaataaataaataaataaataaa

SEQ ID NO: 2060 - protein, 964 aa, synthetic construct
  source 1..964: note = Description of Artificial Sequence: Synthetic polypeptide
MIPELCSTGLKICHININSLPHKMDELKILLGNDPFDIVAISETHCDSTITDLDISLDNFCVTRKDRSRHGGGIALYVKNNISYEVISQLDNELEVIFVKVKQKQTHPLYLGVVYRPPNSPNEFFDKLSEIIHSISENAGEIIIIGDFNCDLLPEICTPFSRALLSLMDTNLLHQLISVPTRVTPHTKSLIDHVFSSIPEEHQHTGVVKTHISDHYLIFTVFGYARAKQKNDDNIIEYRCFRHFSNDNFVTMLQNLPFNENLNDKDPNHAWQCWVDLLISAVNKHAPVKSKRIRSKLCPWITGDLIEAMNRRDWLYTMATKPSNPDSSEFWSEYKSLRNEITCMIRNAKNDYINALLHENGGTPNAMWKTLKLISSSKKESNLKLEVDGEEVIDAEKIANHFNNYFVDAVDTMFNPLNFENDVNNSTIDRASEPSVHSDTVDTVPPVNSFDLPVITDEFVMKEIERIPIKKATGPDDVSIKLLKFACNSQNVIQSLTYILNSSLDQGIFFDEWKIARVQPIYKAGSKLSVENYRPVSLLSIPSKILEKAVNTEFQEYLKVNKILTERQFGFRPNHSCETALLCMVDLWAQNVDKGNLNGVAYIDMRKAFDAVNHSTLLMKLKNVGCTDRAIKWFRSYLGGRSQFVSIKGKKSSTRTINYGVPQGSVLAPLLFSIFINDLPTSIHSADMFLFADDATMSVQGKTLSEIQTKLNLALDEVYSWTQKNKLLLNTTKTKVMVIGSKQKLQTLNENNLNVRIKTTPIECVTQYKCLGVIVDSNLLFSKHVEKVALQMKQKLGILRRLKGTFNKHYLSMIYWGYILPHAMYCCTVWTNRSLHNYETINKLHKRAAYIISGCSWSTPSHEVLLQLNWSTLEALYSRAMGIMAFKCVHHLAPALLANKFILHDDVAQRMTRNSHELKLESNRCNTEFFKRSFVNSAITLWNNLPIETRFSPNLNVFKSNLSH

SEQ ID NO: 2061 - protein, 1112 aa, synthetic construct
  source 1..1112: note = Description of Artificial Sequence: Synthetic polypeptide
MATTQASVKPTAVATCVCGKICKNPRGLKIHQTKMGCLASVQPEQRARFSLSESREVPARAEPYGPQQPHSPEALGETQEERGQESPHSAQNLRAQVAQAPDNPQHHRRVKWPPASKVSEWQQLDEDLEGILESTAKGGVDRKLQTMTTLVISFATERYGTMEKRAAPEKYTKNRRAEKISQLRQELRVLKKQFKGASEDQKPGLAELRCTLRKKLLTLRRAEWHRRRAKERAKKRAAFLANPFGFTKQLLGQKRSGHLECAKEEVDSYLHDTFSDAERENSLGECRVLISPPEPACSFNTKAPTWKEIQTVVRAARNNSAPGPNGVPYLVYKRCPKLLARLWKILRVIWRRGKVAHQWRWAEGVWVPKEEKSTLIEQFRTISLLNVEGKIFFSILSHRLSDFLLKNQYIDSSVQKGGIPGVPGCLEHCGVVTQLIREAREGRGSLAVLWLDLANAYGSIPHKLVEMALARHHVPGPIKTLIMDYYDSFHLRVTSGSVTSEWHRLEKGIITGCTISVIIFALAMNMLAKSAEPECRGPITKSGIRQPPIRAFMDDLTVTTTSVPGCRWILQGLERLMTWARMRFKPGKSRSLVLKAGKVTDRFRFYLGGTQIPSVSEKPVKSLGKMFDGSLKDAASIRETNDQLGHWLTLVDKSGLPGKFKAWVYQHGILPRILWPLLVYEFPISTVEGLERRVSSCLRRWLGLPRSLSSNALYGNNNKLTLPFSSLAEEFMVTRAREVLQYRESKDPKVALAGIEVRTGRRWRAQEAVDQAESRLHHKELVGAVATGRAGLGTTPTTHLSRLKGKERRDQVQLEVRASIEEQRASQWVGLRQQGAWTRWEEAMARKISWPELWRAEPLRIRFLIQSVYDVLPSPSNLFLWGKVESPSCPLCQGRGTLEHILSSCPKALGEGRYRWRHDQVLKAIAESISSAMEYSKRLPLPGRGVRFVRAGEQPPPQPRAQPGLLATARDWQLRVDLGKQLKFPENIVETNLRPDIVLHSQSSKQVILLELTVPWEERMEEAYERKAGKYAELVEDCRRAGWRSRCLPIEVGGRGFAGKSLCKAFSLLGITGMRRRKAICAASEAAERASRWLWIQRDKPWTSASWTQAGN

SEQ ID NO: 2062 - DNA, 90 bp, Aedes aegypti
  source 1..90: mol_type = unassigned DNA
tgactgtatgtttagcttaagttatttatttatacattcattaagacaacttcgtgtcagatggattaaatcagaaatacaaatacaaat

SEQ ID NO: 2063 - protein, 1037 aa, synthetic construct
  source 1..1037: note = Description of Artificial Sequence: Synthetic polypeptide
MNDHLSANMHRTLSHSGRTTSSTMEAPTPPSTVESLQPALISRPDPVVGRGGGVFQPVLSGKYNKITDSLLPDISPPSSLRIYYQNIRGLRSKIDSFFLAISELDYDVIVLSETWLDDCILSSQLFGSNYSVFRTDRSALNSDKGRGGGVLIAVSSRISCSVDSAPVSNQLEQLWVKIVLPRNNVSIGVIYLPPDKKNDIDTIQRHIESIGAVHSHLHENDMAMLFGDYNLSDVHWTSDANDNVFVDLTRTRLNPASSTLLDGFCFHGLSQVNTIVNSGGRTLDLVLLNDVVLPNHSIHEAVEALTTVDVHHPPIELVVSCPLPVVYETVSDNTGFDFKKANFESLNVALRSMDWDRLDSIEDVNEAVAFFTNSVMQAVAEHVPPRRPPSKPPWSNSRLRLLKRRRSAALRFYRSHRSQQSKLHFNRSSSEYRSYNAYLFAQYKSRTEQNLRSNPKQFWSFVNTKRNEDGLPTSMYLDELSADSASDKCELFAMQFKRAFNDYASPASQIDRALQDTPQDVFSYDMFHVSEEEVIGAIGKLKFSYNPGPDGIPPALLKRCSSTLLAPLTKLLNHSLRQQVFPACWKKSFLFPIHKKGDKRCVSNYRGITSLCACSKVFEIIVNDSLFESCKRYISTDQHGFFPKRSVSSNLVEFSTLCIRAIDAGKQVDAVYLDLKAAFDRVDHRILLQKLRKCGVAINFVDWFRSYLTERSLCVRIGESESASFTNISGVPQGSNLGPLLFTLFINDVSLLLPTGNRIFYADDAKIYMIVESLDDCYRLQHLLNLFEAWCTRNCLTLSIEKCQVISYGRKRSPIRFPYELSGTTLERVKCVRDLGVTLDEKLTFNCHLNDVISRANKQLGFVLKVSSGFKDPLTLKALYCALVRPILEFAAIVWCPFQNYWISRIESVQRKFVRHALKNLPWRDPENLPPYHERCRLLGIDTLENRRHVAQTMFVAKVLRNEIDSPSLLADVNIYAPERTLRRRQFISLGSRNTRYGQHDPVRFMALKFNEAYHLFDFNVTITTLRNHFIQYFRRN

SEQ ID NO: 2064 - DNA, 160 bp, Drosophila ananassae
  source 1..160: mol_type = unassigned DNA
taaaattaaaataaatatactgttaacttagctaattataaaaataaataaataattaaaatacgtagtcgaaggcctcgtagctagcactacaccccaaactgttagtcatagttttgtaaactgtactatcatatccaataaataaataaataaatat

SEQ ID NO: 2065 - protein, 997 aa, synthetic construct
  source 1..997: note = Description of Artificial Sequence: Synthetic polypeptide
MKINQANWDKFATHTNNNNNLYPPSTNINKETAQINKIIMKSAHLAIPQTLPHRHTHTVPWWNKDLADLQEKKKQTWKALKRDTTQENIIKYRKTNALFKRAVKIRKKEATSKFTSTIQPNTPTTKIWNNIRRFCGLNPVKQIHCITNNNVTTNDKQKIANLLAQHWSQLSKDSNFSQEFTSHKYNTTTLNHIPSKSAMEIDKPITKLELTIALRSLKGITPGINRISYPMLKNSPLAIQNRILSHFNHIFENYIPQSYKTSLIIPILKAQKDKTDIASYRPISLNCCVGKTLDKIIANRLWWYLNSNKLLHPHQYGFKKGKSTSDNLLYADHIITKSLNTRKHTSLISLDFARAFDRVGIHSIVDQLIEWKCSHKIINYIINFTKNRKIAVRIGSSISNFYPLENGIPQGSPISVVLFLIAFNKLANILTIYKEIKFSAYADDFLLLVNLKNQKNTTINLTHIFRKIYDWGSYSGASLSQTKCQHLHICRKHRCNCTITTQNSNIKNVTSLKILGLTINNRYNWSSHINSLIPSLSNKHNIIKCLASHKFNCNTSTLLNITKSILISKIDYALHIYGYTPKNFLNKLKTTLNAALRTVLGAFRTTPTHNLLYEANIPTIEQQRDHLTTKLFTNLTRSKDTPLHKHIQPKTNNKKWTSTLERTIENCQLHNIPFKPTKLYKTKPPWQLPQNIINTSLHNYKKTNTSSDTFQKLFFEIKETYKNHTFIYTDGSKINLNTAFAVTTETDVLRYGILPPSSSILTGEMIGILEAIKISTTKRGKSVICSDSLGAIEAIQNPLNLNKYPTYIRSLLQTKQPKIKILWIPGHSNIKGNDLADRTAREATKMPLIYTPNENITDINKMLKNILIQEKETLINKCNTWYKNINTNNTHISALSKIQQEEISRIDQIKFIRLRLGHTSLTHKHLLDPNTQRNCYRCQSSTPTNMEHILDSCPAISQNKQNLLKNRPATEYLKNPTAENIKVIIKFLKETNLYNEI

SEQ ID NO: 2066 - DNA, 57 bp, Hydra vulgaris
  source 1..57: mol_type = unassigned DNA
atggcggcgtaaagatggcagcctagttgagcacgtgttttgaaataatttttaata

SEQ ID NO: 2067 - DNA, 121 bp, Hydra vulgaris
  source 1..121: mol_type = unassigned DNA
acattttaaatactaactttttttatgtttgtatgttagtgtgttacagctgttaaagttacaaactctacgtagtttggactcatcactctttaagtgtacagcactattatattatatt

SEQ ID NO: 2068 - protein, 1237 aa, synthetic construct
  source 1..1237: note = Description of Artificial Sequence: Synthetic polypeptide
MVVSKDTTQAINTAIEVLRKELIERIIKVEKENERLNTENESLKKQLAEQCNQNNNKPLFSSLIKKTSEGAPPISDSETRLLNAISAEQKEKIKKEKNVLVFGLKESKRKSKDEIKEDDDESVGEVFDAIGLDKSCIVKHFRLNSRDKNRPGPLVIELVDPSYQKQVLSVARDLNKVEAYKNKVFINPDLTYRQRASLKLLLGERNSLNKIEEGQKFDISICYQKRYAAENNRGRSKVRHFDLLSETICCRKLKSKNTKKINAPSSLISKLSEITCLYMNATSLNNKFDELIEVINSNKANVVMICETWWNNESVTNINGYTLFRRDRGVGRGGGVCIYVQNNIKAYEVSEKCLNDPNIEQIWCVIELGSEKVLCGSMYRTGISNISNCINITKSINFAHSMNLLNKYTGILICGDFNFNAIKWTEDYYGTLTSETDTPAKIFLECLNNCFMHQNVIKPTFQNNIGNETNVLDLIIAENKNRVYKLVHLPPLGGINHGHHIIKFNYSHEECIDNIVLIKEKFNFNRGKFDKLNNYFKILNWDNEFKGLEINKCYEKWLSLYEEGCKLFIPIIKSGSIQINTKPLWINRELKALSKEKRNVWFECRRQKFRDNCLLAKYKELNKVYKKKSESKNTRFIKKKVNQRIKDFEYDLALNSKFNPKKVYSYINNKSKVKDNIRAIQLKNGSIETDLKVIANTLNGYFASVFNKPQTLSAPIIDIETQKICKNPDFNASVVEEYLNKLDTNKATGMDRVHPKVLKECKSTLAKPISLLFNKSFETGKLPKLWLCANIVPLFKNGDKLNPCNYRPTCIFNICSLTHATIDLPVSLTSVVCKVMEKIIKDKMMKHLVENKLINKNQHGFVNNKSCVTNLMESLDFITSSIDNGLDVIVLFLDLAKAFDSVDHERLLLKLNALGFKSKLFDWCQGFLKNRLQRVVIGNNKSEWEEVVSGVPQGSVLGPLLFVVYINDISNKIKSSCKLFADDMKILRAIKNDNDVIELQQDIDLLMEWSNEWLMKFNQQKCKVMIIGNSQHKVLMNNTALAYTSMEKDLGVYISDDLEWKHHVNKAVNKANQKLGQIKHTFKYLDEKTMKLLFIALVRPYLEYAAPIWNPYRQYDKDKLECVQQRASRIKILKGYSYEERLKKLDLLSLENRRRRGDLIQMFKYLKGYDIINFYTKPEMLDNGYKTRGHNSKLRRQYTGNIKRHNFFTNRVVNDWNNLEQETIDAVSINQFKKKIG

SEQ ID NO: 2069 - DNA, 199 bp, Strongylocentrotus purpuratus
  source 1..199: mol_type = unassigned DNA
tattgtgaatgaatttaatgacttttttgtaaatattggaccgaatttagcagatgaattgccgaatacagatgtagcatatggtgattttttggggcagaatatagagcaatctttattttggaaaccaataactgcagttgaagttaagagtcaagttctgctacttgataccaaaaaggcttgtggtcacgataac

SEQ ID NO: 2070 - DNA, 298 bp, Strongylocentrotus purpuratus
  source 1..298: mol_type = unassigned DNA
ataaatataattcataattcatattttacattattagtttgtatattgtaagacattgttgagtactgattcttgttttttttaaagtatcgattgtaaaagtaaattcattattttttgttttgttacgttctctaaactgatttgtaccaaaatactttgtttagctgtttaaggggttaggctcgactagcacatgtgctattatctggccccttttaccaaccaatagtttctcttcctgtatatgtaattattgtataaaatgtatgaaatgtattgctgttggtaaataaaa

SEQ ID NO: 2071 - protein, 489 aa, synthetic construct
  source 1..489: note = Description of Artificial Sequence: Synthetic polypeptide
MIPVQLIRDSAPYISHPLAYIFNLSLETGKVPDEIKIAKVTPLHKKGPREDPGNYRPISVLPVIGKVLEKLINIRLIQFLEKNDIFYYHQYGFRKKYSTKLSLINLINSTLKSIDQGKVTLGMFIDFKKAFDTINHNILLGKLSSYGIRGLPLEWVKDYLSNRFQFVQCGQTLSERKKIRCGVPQGSVLGPTLFLIYINDLPTVTDYFNFRLFADDSNLFHTFSADQGEIDVNEVNNNIQKIHKWCTANKLTINSMKTNFMLICSRRKKIGINGKLKIAGEEIKEVDVATFVGVHIDRHLSWKSHIRFVNQCIRKKVGVLFRLRHFVPSRTLILLYKAFIQPHISYGIEVWGSTYKTSLRSILYSQKMAVRAITFSEWRTPSDPLFKRLRILNVYNLHDLSISTFMFDLVNGNLPHILIEYCDIIEHSYSTRQKEDGQLRLPKLRTTQGQFSLSFVGSEFWNRLPVDVRLTRSRNRFRNSVTSHLLNKS

SEQ ID NO: 2072 - DNA, 109 bp, Strongylocentrotus purpuratus
  source 1..109: mol_type = unassigned DNA
tccatttaagttcttctttacattttgtacatagttgttgttgttgtttgctttttactactttgttttaagtgtagaattcatattcctttgcttttttggttttcaa

SEQ ID NO: 2073 - DNA, 318 bp, Strongylocentrotus purpuratus
  source 1..318: mol_type = unassigned DNA
tgatattagctacagattttaacggttgttaaattcattatattttacatgtaattgttgtttgtttcactttttattacagcttaactttttatatttgattaattggtcagccgcatacaaggaccacctcctttctggctgctaccagcattagcaatttcctttgtattattcatgtttgtaaattgattctgtgtatttctgtgtttatctatgttagtaattgtaattgtgtgaaactttgtatactgcttttgttttaccctgtatgttttgtattgcttggcaaaataaattgaattgaattgaattgaa

SEQ ID NO: 2074 - protein, 1004 aa, synthetic construct
  source 1..1004: note = Description of Artificial Sequence: Synthetic polypeptide
MLCRARFVQCLNEKHVSVSTLREFLSPSDPQSTNNFTQSHYTPDEFNTFVTQKSLDKDVNNKLSFININCRSLQHNFDALSVLMMSLRMQVSIIGVSETWLRDENSQYSLCNLDNYVFVGNNRRLGRGGGVGIFIRKDINFKRRTDLDINESFLESIFIEIERFNSSILICVMYRPPSQPVDDFLMSLVNVFDVVNVEKKLFYLMGDFNIDLLNVGKVQSVNDFLNILMLHSMIPLINEPTRVTDRSSSLLDNIFTNDSCYIYSGILFTDISDHFPVYCICDTDIPKSSCETDFYKRHLNENNIRMYFLQLLYSTEWYLSSDVNSSYNNFVFKFMKVYNLCFPVKLVRMKYKRKNKPWITNEIIKLSKKKCRLYKLLIKNPNVYRKEVYRKIRNELNNKIKIEKKNYLKKSFKDSTGNMKKTWDIINKAMGKKCKMTNIKEINNNDTVITDKNDISNNFNEYFVDVGYNLNCKFDCFDDSECIKYIGMNDKSMFFKLVTSSEIEDIVKKIKNNTSAGYDDVDVKIVKKCIYLLSSHLCTIFNQCLEQGVFPDKMKIAKVIPVFKNGVSETMSNYRPISVLTVFSKILEKCMYNRLYAFLTKCNIINDNQYGFRAGHSTSCAIIDFIHKVASAIDNNEVMLGLFLDLSKAFDTLDHHILLVKLYQYGIRGIGLDLFKSYLLHRHQIVSIANVKSNYQEIKCGVPQGSILGPLLFILYINDLPSVSRILKSILFADDTSIFLSHQNIQSLQDIFNQEIKLINTWFSVNKLSINISKTHYMIFTNKKCDTDSIIIRLCNTEIKQVSSLKFLGITIDNKLKWTDHINAVCNVLSKNIGVMYKLKSFPKCILKMIYNSLILPFLYYGILAWGNAHETHIRKVILLQKRAIRTICHTSYLAHSHPLFKEMKILNFTDMYNYQCAIFMFQCYLQILPKSLLKLFILNCNIHHYSTRNAENFHLPLVHTTSYKRTVIFNGPCLWSTIPRNIRELKFVNTFKRKYKKYLMDVY

SEQ ID NO: 2075 - DNA, 910 bp, Schmidtea mediterranea
  source 1..910: mol_type = unassigned DNA
cctttttacggtataattataaacatttatcataacatactttctgtatcaactatatatatgagtataaatctggatcttctgagaaggactcatatatataagataatctataaaactggaaggtaatgacgatgattcagaggtccagtgactattcctcgagagaggaactagttacgcagttctgaatcggcaatcactaactcaacaggctgatgtcaggatatggaaaggggtctaatagtggtcttaaaactctcttttgaaagtgacttcttattggacacctttttattgtataattataaacattaattataaatcatatcatactttctgtatcaactatatatatgagtataaatctggatcttctgagaaggactcatatatataggataatctataaatctggcaggtagtgacgatgattcaaaggtccagtgactattcctcgagagaggaactagttacgcagtgctgaatcggaaatcactaactcaacagtctgatgtcaggatatagaaaggggtctaatagtagtcttaaacctctcttttgagagtgacttcttattagacacctttttattgtataattataaccatttatcatatcatactttctgtatcaactatatatatgagtataaatctggatcttctgagaaggactcatatatataggataatctataaaactggcaggtagtgacgatgattcaaaggtccagtgattattcctcgagagaggaactagttacgcagtgctgaatcggcaatcactaactcaacagtctgatgtcaggatatggaaaggggtttaatagtggtcttaaaactctcttttgagagtgacttcttattaaacacctttttaatgtataattataattaaatataagcag

SEQ ID NO: 2076 - DNA, 1884 bp, Schmidtea mediterranea
  source 1..1884: mol_type = unassigned DNA
tgagtagtggtatatttataaatataagtagcgaatttataatatttatctatactatctttatatatttcaagtggatcttttatgactaattaaaaatacttttttatatttttaacttttattactttattttctatttttatattctatgattcttataatgtaattttattgggaaagagagtaaacggggggcaatggggttagtctcagtatggatccggaccctccggaatcgggattcaatgactggggcagtagatgcgggatggaaattaagagtactttggcattagggtttctgggactgtgagtggtgaaaccgtaaaaagggagtaagaatccgggctattacctgtacggctagagaaatctagttcagccttgatgccgtatttttttgggaagtttattcgcactgccgtggtttgcgaccaagtttgatgggaagacacaaatagatttagttttggttcttttgccattactgaaatctacaacgaagccaccggctataaagagtggtactcttgtggtataccttttaagcacggtaaggaagtggaatggatgggttgctcattccggactgcgcgttggagcaattatattgatcgggtgatactaaaaagccgggaaatatcaattactagttttctggaatactgctgctcacttacagtttctggattacaaatttacccataggtaattgatatatagctggctgtaaggggtatgggacccttacaggtatcattattaaaggcttggatgatcagatgggtatataagggagggctatcaagttactggttttctgaatgatatttggattacatttctatcaaggtaacagcgacgtctataacttatatatccatacgaaatggaacgatcagatggataaacaagggatggattatcaagttactgggttttctggatgatattcggattacatttatcttaaaggtaacagcgaagtcttgaacttaactttccatacgtctagggaaattcgctaatagaaatattagtgattaataaccacacgggctaacaacctctaaggttgggcaagtgagttggattcatccagcttgcgcgtattatattttcgatccgatgtcacctgaggttacggggaattaaaccacagcttttcttatattactgaatcaggatataaggattgcatattaaaacgttggtgggttaatgaactataactgaggagtaatcaaatagtaatgatttgaatgcaaaaggtttcatttgttactgattaacttgcgggtttcatttaaatatcttattttatacatgggcaagaataacaatgtgaagtaattcagctctagtaatctaatgataaagcaattaccaaggtataacgccctattttgtagggttggccaaatataacttgataataaatgctgattattgatctactaggtatcagggtgcaatgccttacgaaggtaaggttggacaaatgtaacttggtaacatgtataactataagacccccgttcaggatagtggtgattgatagtggtgatgtagttaatacaggcgtgtatgaatctggtgaaggtgggaaaaacttcataactccggttatgatttgaaggtcaggtttggattgggtctgatcggctaatcaaggtagtgatgaactcaaagtaggggtctatggagagggagcacttgataagataattcacgataagatggttagtaaaaactcgcgatccctgcgttggaaagttttgaagtgctgaaggttggttagcaataatcaacaatgctcgttagcgaagggagaataattccgggctatcattcaaaactgtattttatcaatgaattatt

SEQ ID NO: 2077 - protein, 1033 aa, synthetic construct
  source 1..1033: note = Description of Artificial Sequence: Synthetic polypeptide
MAIITGEGDCHLLKKSLLKLKTMKNKTNKLNVNKGNDLDVTFPCDFCGLSFPTKIGRGVHISKAHRVERDAKLSGHASAKKAYYWSTEEETRMAKIHLQEESRGDSNHVLRAMHSACSTGRTLESIRLHMKAKRYVKIYTELRNEKQIQSSGVENILNNISDASPLTLPSETETLTSYLLNLPLKKGVSKWREQDLDFIIHSVSDSEEQKRLLDVYCKTVTEGYRKGKTGPLKKSTKVSPHHATTTKSKKFLKKKLKRELYGKVQQLWIKDRCEAAKLVLSGKVSTLICEEDRSARQGEYWKKIFERESEPDIRPVPEVYADPMLVRPISEDEIKKVVKDIKLKTSSGPDNISTEVLREIPVLVLVKLFNLIILLSHLPSEFKSSRTTLIPKVETPKDPGDYRPISVSSVFVRALNKILASRVSNGNKGAHAQKGFKALDGCLENTVLLNCILGDAKINNKSIALSFIDMKKAFDSVNHDSILRAATIAGYPKLLLGYIKESYNGADTEVEKIKATFKRGVKQGDPLSPVLFNNIVELAIKKAYESGIGYRMNGTVFPIMAYADDIILLSESKEGLQDLLDIVLTELRHNGLEANADKCASIIAKKDGKQKKWVISSDSVLAAGKTMPCMNANSMYKYLGIYFGPLGITTERLTKIYSNQLYNIGIAPLKPQQRLEMINDFLLPGILHEAVLGNTNVGELKDLDKMTRVAIRKWLHLPKDTCSSFIYTGVKQGGLGVRSILAEVQFGKISRLESLNKSKDTRIQALTTCEVVKKAFRQWSKPIRVGDSIATSKVQFYEANRELLLSKCDGKGLREAGKIPFAHDWLRAKGKLMKGRSFINSIKVRGNLFGTPVRLNRLNKSGIPLIKCKMGCLMPCSLNHIAQTCPKVHGLRVERHNKVMNYIADVARKGEWKTLVEPIIPYGATIRKPDLVVIKDKKAMVLDIQVVSDVGNLNERNTLKSEVYNDKIIADWVKNAGADSVEFGAITLNWRGLWASDSWETVSKIGVNKSDAMIISLKVLNWTARMYCAWNKG

SEQ ID NO: 2078 - DNA, 499 bp, Strongylocentrotus purpuratus
  source 1..499: mol_type = unassigned DNA
aggctctgtataagcttggcttgttagagctcttgtgagttgtgtgccgcggggtttcatatccttaaactgctggcgaacagagcaacaagaccaagctctgtaattgttaggtttctccaatggtaggtttgtccaataatgccgagtttgtgccacggaacctagtcggacatttcgattatattctttttatgtcatacgtctttatcttttttttttttaaatattttttatagtttagtctaccttgctgatacctcctcaaaatatatacgatagactatcattaattctgctgcattaccatatagcttacttagaggttactgcagatcaatcacctgtactgtatctagagtatagttaagtgtaggagaacagtaaaaacagtggggccattgaaggagcgttcacgtcgcggtccgtcagatgaaaatctgcgaatccttcaaccacactactcaagtttcttttagtaactaccacaaccaacacc

SEQ ID NO: 2079 - DNA, 23 bp, Strongylocentrotus purpuratus
  source 1..23: mol_type = unassigned DNA
tagtgactcgataagaagaagaa

SEQ ID NO: 2080 - protein, 1002 aa, synthetic construct
  source 1..1002: note = Description of Artificial Sequence: Synthetic polypeptide
MATNDNDDQFVAEAQGRTHGSLSGPALSIISSNIEGLSGAKQELLADLCITTNCDILCLQETHRGPTRVRPRISGMTLIAERPHDQYGSAIFARNGLAVDKSYLSDINNIEVLSIDLMGITVSSVYKPPQEPFDLPGRATDGRMNVVIGDFNSHSISWGYREMNEDGELVETWADANQLSLIHDAKLPASFNSARWRRGYNPDLIFTSTRIANQCEKVILDPIPHSQHRPIGLKVNAVITPRAVPFRRRFNLRKANWEKFAKDFDSYIQDLPATPQNYDTFVELMKKSSRRNIPRGCRTSYIQGLTDHSKVMYEDYIEHFQMDPFSEETLESGENLTKEIGESRRRKWQEFIQSTDMTHSSRKAWKTIRILGNDYTKAQPRSEVTADQVAHQLLLNGRGNPDHHPRRARLPKVPDALSSQDDPGFTRPFTMDDLLAAIKAMKNNKAAGLDDILCEQIKQLRPGALNWLLKMFNECLGTNNIPKLWRKSKVIALLKPGKDAASPKSYRPISLLCHTYKLFERLILNRIAPFVDEHLIPEQAGFRPGKSCTGQLLNLTQFIEDGYESKLITGAAFVDLSAAYDTVNHRILTRKIFELTKDVRLTGLIQTLLSNRRYFVVLNGNRSRWRRQKNGLPQGSVLAPLLFNVYTNDQPIHPNTRSFLYADDLCIATQNQSFVKLEESLSDALAGLIPYYATNHLRANPDKTQISAFHLKNRDANHQLRISWYGKRLKHTPNPVYLGVTLDRSLTYKNHIANTKAKVGARNSILKKLANTNWGTDARTIRTTALALCFSAAEYASPVWSRSAHAPKIDPALNSSCRAITGCLRPTKVEDIYLLCGIAPPHVRRLVLSQKEKDKQENNPLHPLFEQQPVGKRLKSRHSFLHSVEPLNTSPHNQRMTLWSNHLQTTPHKLSLSPKESLATGSSETWPTWLSLNRLRTGYGRCRVLMQRWGLGDEQTACECGQEQTMEHLLVCPLLPEPCTQDDLEAVNCRAKACVDHWTGLV

SEQ ID NO: 2081 - DNA, 297 bp, Drosophila persimilis
  source 1..297: mol_type = unassigned DNA
actctgatatcgactcagaaatagacagtaaacaccctatcaaattcccataaaaacagcacaacctctaacattgtaaaaattctaccactaactacctctaagcgcagactagcagcaattaaggctgcggacaaattaaaaagctcaagcagcaaaaaaacaagacagaagaaccccaatactgacgccttgagtagcaacaactgctcaatggaaatagaatccgactaaaactaacagatcaagtaaaaacaacccaaataaccagcactcaagagataaaaactcaaaaaa

SEQ ID NO: 2082 - DNA, 164 bp, Drosophila persimilis
  source 1..164: mol_type = unassigned DNA
taactctaatataaaacctatggaatacatctcacatataataaacataatataataagcataacataataacaacatagccgaaggtcgtagtaaccagtgctatcattaataagctaggttaatagttttaactctaacctcgctgtaaataaataaataaa

SEQ ID NO: 2083 - protein, 1235 aa, synthetic construct
  source 1..1235: note = Description of Artificial Sequence: Synthetic polypeptide
MTLTIIQWNLRGYINNYNELQIIIKQYQPHIIALQETHLFNIHNIPIPINFSLYAKNYSPNFGGAAVLIHNSIESKEIHLQTDFDATAIEVESKKKFKIISAYISPSQNFNESNLHNVLSNNSSSLILGDFNSWSKLWGSPKNNARGNTVAKFLNNTNFILLNDKSPTHFTTHNTYTHIDLSFCSPDLFQYANWKIIDDLHGSDHFPILITLFNNNKQNKTQNNPIFKINSANWDAFKDKTDYFNTKNSPSNNINKESSCLNKILLQSAHLTIPQTSIKNHPRNVPWWNNGLQTLNNERKQAWNKLKKHITTTNIIRFRKAAAKFKKEIKSAKNKSLSSFTSEIQPQTKTSQTWSNIRRFCGLNNMKNIHTIIHPTTLQPTSDNPSIANSFAEYWSDQSKDSNFSSMFTNNKYSISTYQSSPPSQSAQKIESDITSIELSSALSSLKGHTPGIDRISYPMIANTSPAVKDRILKHYNNILNNYIPQAYKIGLVIPIAKPGYIKTSITSYRPISLNSCFAKVLDKIIAKRLWWFVTTNKHIHTNQVGFKRGKSVTDNLAYLDHLITDALSHKQHLSIVSLDFNKAFDKIGLHAITKQLQEWNIGPKILNYIINFMSKRKIKCRVANNLSSTFPLHNGIPQGSPISVIIFLIAYNKLANLITIQRNLTFTAYADDFHIIVKFKKNQTQENFNLDDLFQKIDEWCSFSGSSLSFDKCKHLHICRKHNCKCTITTRNLNIPSVDHLKILGLTFDSKYRWTRHIEDLASSLSNKINIIKCLSSNKFNCNTHTLISITKAIIVSKIDYGLVFYGNSSITWLKKIQTILNCAVRIALGAFRTTPITNLLMEANINTVADRRDFLQAKLIKNLYFPNNSPLHKISKSLQSRIHFNNKIPSAITYSLQHCKKQNISLLIKPEIKTKLPFWKFQPNTINTELEKLDKNNTHDSIYQQHFLTIKNQFNDHTFLFTDGSKTISTTSFAITTEKNTLKVGLLQNFSSIYSAEIIAIFEAIQIVKSMRGKYMICSDSLSSLQAIGNPDNFNYYESKIRSLLMQLHPKIKLLWIPGHKNIKGNELADQKAKSASTMPLTYTHNNNISDINKHLKTKMLKDKLIKLEQTSNWYQFINPNQITADKFTKRLDQNTTSRIKQTKIIRLRLGHTRITHQHYLDPTKINTCTHCLNNVPVTIEHLLKDCPSSQLTDIRFKIFANNNPLTFLSNPTKTEIDLIIKYLKETNLYPLI

SEQ ID NO: 2084 - DNA, 1128 bp, Drosophila serrata
  source 1..1128: mol_type = unassigned DNA
tggctggcaaaaatcctccagctgaaccctccacgagggagccggctaggcaatgggcactgtattaccgcgtacaatggtaatgcagtggcgcatgctctgtccggggtaatgcagtgtctagctaaggcttcgattcaatttctcccgcctaaacgccatggttggaggtgcctggcggcaggcataaaacgcaagtgggtggttccccggaaataaaccaatttttcacaggatggagacaggagaggcaaccggggctgggatgtcagcccaaacgtcggtggaaggcgtgactgctaccaccggcgggcacgaaggggagcaatcctctctgcgtgtcaccagcggtcacacctctgatttgacgggagcaggtcaagtcagttgtagcgctaatgccaaataacgacgaaaagaaggctaagccgcacgggtgccgttgtctatacagactcggacctggagagcgtgcagctttcgaaagaagaggaagaaagccttcttcgctcgccagaaccaggcaccagctccccgcgaatagacgggccgaagcgttcaagcgaggggaagaaggctaaggcgtagtataaagctgccctccgaatccagagccggctccggacaaaagctgccctaaccgaagaggagaacgtaaaggtcaactgacaggatcgatgagagcaggctgcacttcgccaagcttcctagcttggcatcaacggccgggttcgccaacaaagtgtaggtgatgcttgccaccaagcggcaacgctcggccgagagtgccataaaggacattccggcgagcaagcggggactcgtgcgcaaggaagcaggccccccctggaaggcgaaaaccaaatccagattaacaagaaggcagaggacatcctgtatcccagacacgggaagatggcatgggtagcgtctacctgcgcctcaaaaagcgccatcctggggataaggatgaccacaccctgaaggcaggcgagatggaaaaggacctaggtctggaaaccatttttgacgccgcccaggaactaacgctggatgagtccgaagaggaggaagacggtgacctgacgatagtagtcaacccgtcgagtggagttgagcccagtaccc

SEQ ID NO: 2085 - protein, 1734 aa, Murine leukemia virus
MGQTVTTPLSLTLEHWGDVQRIASNQSVGVKKRRWVTFCSAEWPTFGVGWPQDGTFNLDIILQVKSKVFSPGPHGHPDQVPYIVTWEAIAYEPPPWVKPFVSPKLSLSPTAPILPSGPSTQPPPRSALYPAFTPSIKPRPSKPQVLSDDGGPLIDLLTEDPPPYGEQGPSSPDGDGDREEATSTSEIPAPSPMVSRLRGKRDPPAADSTTSRAFPLRLGGNGQLQYWPFSSSDLYNWKNNNPSFSEDPGKLTALIESVLTTHQPTWDDCQQLLGTLLTGEEKQRVLLEARKAVRGNDGRPTQLPNEVNSAFPLERPDWDYTTPEGRNHLVLYRQLLLAGLQNAGRSPTNLAKVKGITQGPNESPSAFLERLKEAYRRYTPYDPEDPGQETNVSMSFIWQSAPAIGRKLERLEDLKSKTLGDLVREAEKIFNKRETPEEREERIRRETEEKEERRRAGDEQREKERDRRRQREMSKLLATVVTGQRQDRQGGERRRPQLDKDQCAYCKEKGHWAKDCPKKPRGPRGPRPQTSLLTLDDQGGQGQEPPPEPRITLTVGGQPVTFLVDTGAQHSVLTQNPGPLSDRSAWVQGATGGKRYRWTTDRKVHLATGKVTHSFLHVPDCPYPLLGRDLLTKLKAQIHFEGSGAQVVGPKGQPLQVLTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFDEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKTGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGLLTSEGREIKNKSEILALLKALFLPKRLSIIHCLGHQKGDSAEARGNRLADQAAREAAIKTPPDTSTLLIEDSTPYTPAYFHYTETDLKKLRDLGATYNQSKGYWVFQGKPVMPDQFVFELLDSLHRLTHLGYQKMKALLDRGESPYYMLNRDKTLQYVADSCTVCAQVNASKAKIGAGVRVRGHRPGTHWEIDFTEVKPGLYGYKYLLVFVDTFSGWVEAFPTKRETARVVSKKLLEEIFPRFGMPQVLGSDNGPAFTSQVSQSVADLLGIDWKLHCAYRPQSSGQVERINRTIKETLTKLTLAAGTRDWVLLLPLALYRARNTPGPHGLTPYEILYGAPPPLVNFHDPDMSELTNSPSLQAHLQALQTVQREIWKPLAEAYRDRLDQPVIPHPFRIGDSVWVRRHQTKNLEPRWKGPYTVLLTTPTALKVDGISAWIHAAHVKAATTPPIKPSWRVQRSQNPLKIRLTRGAP

SEQ ID NO: 2086 - DNA, 41 bp, synthetic construct
  source 1..41: mol_type = other DNA; note = Description of Artificial Sequence: Synthetic oligonucleotide
aataataataataataataatcaataaaaataataataata

SEQ ID NO: 2087 - protein, 14 aa, synthetic construct
  source 1..14: note = Description of Artificial Sequence: Synthetic peptide
  VARIANT 2: note = Any amino acid
  VARIANT 3: note = Any amino acid
  VARIANT 5: note = Any amino acid
  VARIANT 6: note = Any amino acid
  VARIANT 7: note = Any amino acid
  VARIANT 8: note = Any amino acid
  VARIANT 10: note = Any amino acid
  VARIANT 11: note = Any amino acid
  VARIANT 12: note = Any amino acid
  VARIANT 13: note = Any amino acid
CXXCXXXXHXXXXC

SEQ ID NO: 2088 - protein, 11 aa, synthetic construct
  source 1..11: note = Description of Artificial Sequence: Synthetic peptide
TPKRPRGRPKK

SEQ ID NO: 2089 - protein, 55 aa, synthetic construct
  source 1..55: note = Description of Artificial Sequence: Synthetic polypeptide
  VARIANT 2: note = Any amino acid
  VARIANT 3: note = Any amino acid
  VARIANT 4: note = Any amino acid
  VARIANT 5: note = Any amino acid
  VARIANT 6: note = Any amino acid
  VARIANT 7: note = Any amino acid
  VARIANT 8: note = Any amino acid
  VARIANT 10: note = Any amino acid
  VARIANT 11: note = Any amino acid
  VARIANT 12: note = Any amino acid
  VARIANT 13: note = Any amino acid
  VARIANT 14: note = Any amino acid
  VARIANT 15: note = Any amino acid
  VARIANT 16: note = Any amino acid
  VARIANT 17: note = Any amino acid
  VARIANT 18: note = Any amino acid
  VARIANT 19: note = Any amino acid
  VARIANT 20: note = Any amino acid
  VARIANT 21: note = Any amino acid
  VARIANT 22: note = Any amino acid
  VARIANT 23: note = Any amino acid
  VARIANT 24: note = Any amino acid
  VARIANT 25: note = Any amino acid
  VARIANT 26: note = Any amino acid
  VARIANT 27: note = Any amino acid
  VARIANT 28: note = Any amino acid
  VARIANT 29: note = Any amino acid
  VARIANT 30: note = Any amino acid
  VARIANT 31: note = Any amino acid
  VARIANT 32: note = Any amino acid
  VARIANT 33: note = Any amino acid
  VARIANT 34: note = Any amino acid
  VARIANT 35: note = Any amino acid
  VARIANT 36: note = Any amino acid
  VARIANT 37: note = Any amino acid
  VARIANT 38: note = Any amino acid
  VARIANT 39: note = Any amino acid
  VARIANT 40: note = Any amino acid
  VARIANT 41: note = Any amino acid
  VARIANT 42: note = Any amino acid
  VARIANT 43: note = Any amino acid
  VARIANT 44: note = Any amino acid
  VARIANT 45: note = Any amino acid
  VARIANT 46: note = Any amino acid
  VARIANT 47: note = Any amino acid
  VARIANT 48: note = Any amino acid
  VARIANT 50: note = Any amino acid
  VARIANT 51: note = Any amino acid
  VARIANT 52: note = Any amino acid
  VARIANT 53: note = Any amino acid
  VARIANT 54: note = Any amino acid
  VARIANT 2..8: note = This region may encompass 2-7 residues
  VARIANT 10..48: note = This region may encompass 33-39 residues
  VARIANT 50..54: note = This region may encompass 3-5 residues
CXXXXXXXCXXXXXXXXXXXXXXXXXXXXXXXXXXXXXXXXXXXXXXXHXXXXXH

SEQ ID NO: 2090 - skipped

SEQ ID NO: 2091 - protein, 4 aa, synthetic construct
  source 1..4: note = Description of Artificial Sequence: Synthetic peptide
GDSL

SEQ ID NO: 2092 - DNA, 15 bp, synthetic construct
  source 1..15: mol_type = other DNA; note = Description of Artificial Sequence: Synthetic oligonucleotide
  misc_difference 3: note = a, c, t, g, unknown or other
  misc_difference 7: note = a, c, t, g, unknown, other, or absent
  misc_difference 8: note = a, c, t, g, unknown, other, or absent
  misc_difference 9: note = a, c, t, g, unknown, other, or absent
  misc_difference 7..9: note = This region may encompass 0-3 nucleotides
gtnrccnnnrgyaac

SEQ ID NO: 2093 - protein, 20 aa, synthetic construct
  source 1..20: note = Description of Artificial Sequence: Synthetic peptide
  VARIANT 2: note = Any amino acid
  VARIANT 3: note = Any amino acid
  VARIANT 4: note = Any amino acid
  VARIANT 5: note = Any amino acid
  VARIANT 6: note = Any amino acid
  VARIANT 7: note = Any amino acid
  VARIANT 8: note = Any amino acid
  VARIANT 9: note = Any amino acid
  VARIANT 11: note = Any amino acid
  VARIANT 12: note = Any amino acid
  VARIANT 13: note = Any amino acid
  VARIANT 14: note = Any amino acid
  VARIANT 15: note = Any amino acid
  VARIANT 17: note = Any amino acid
  VARIANT 18: note = Any amino acid
  VARIANT 19: note = Any amino acid
CXXXXXXXXCXXXXXCXXXH

SEQ ID NO: 2094 - protein, 5 aa, synthetic construct
  source 1..5: note = Description of Artificial Sequence: Synthetic peptide
GGATY

SEQ ID NO: 2095 - protein, 8 aa, synthetic construct
  source 1..8: note = Description of Artificial Sequence: Synthetic peptide
  VARIANT 2: note = Any amino acid
  VARIANT 3: note = Any amino acid
  VARIANT 5: note = Any amino acid
  VARIANT 7: note = Any amino acid
CXXCXGXG

SEQ ID NO: 2096 - protein, 11 aa, synthetic construct
  source 1..11: note = Description of Artificial Sequence: Synthetic peptide
  VARIANT 2: note = Any amino acid
  VARIANT 3: note = Any amino acid
  VARIANT 5: note = Any amino acid
  VARIANT 7: note = Any amino acid
  VARIANT 8: note = Any amino acid
  VARIANT 9: note = Asn or Cys
  VARIANT 10: note = Any amino acid
LXXLXLXXXXL

SEQ ID NO: 2097 - protein, 11 aa, synthetic construct
  source 1..11: note = Description of Artificial Sequence: Synthetic peptide
  VARIANT 2: note = Any amino acid
  VARIANT 3: note = Any amino acid
  VARIANT 5: note = Any amino acid
  VARIANT 7: note = Any amino acid
  VARIANT 8: note = Any amino acid
  VARIANT 10: note = Any amino acid
LXXLXLXXNXL

SEQ ID NO: 2098 - protein, 12 aa, synthetic construct
  source 1..12: note = Description of Artificial Sequence: Synthetic peptide
  VARIANT 2: note = Any amino acid
  VARIANT 3: note = Any amino acid
  VARIANT 5: note = Any amino acid
  VARIANT 7: note = Any amino acid
  VARIANT 8: note = Any amino acid
  VARIANT 10: note = Any amino acid
  VARIANT 11: note = Any amino acid
LXXLXLXXCXXL

SEQ ID NO: 2099 - protein, 17 aa, synthetic construct
  source 1..17: note = Description of Artificial Sequence: Synthetic peptide
  VARIANT 3: note = Any amino acid
  VARIANT 4: note = Any amino acid
  VARIANT 6: note = Any amino acid
  VARIANT 7: note = Any amino acid
  VARIANT 8: note = Any amino acid
  VARIANT 9: note = Any amino acid
  VARIANT 10: note = Any amino acid
  VARIANT 12: note = Any amino acid
  VARIANT 13: note = Any amino acid
  VARIANT 15: note = Any amino acid
  VARIANT 16: note = Any amino acid
QGXXEXXXXXFXXLXXH

SEQ ID NO: 2100 - protein, 7 aa, synthetic construct
  source 1..7: note = Description of Artificial Sequence: Synthetic peptide
  VARIANT 3: note = A hydrophobic residue
  VARIANT 4: note = A hydrophobic residue
  VARIANT 7: note = A hydrophobic residue
GNXXDRX

SEQ ID NO: 2101 - protein, 5 aa, synthetic construct
  source 1..5: note = Description of Artificial Sequence: Synthetic peptide
  VARIANT 3: note = A hydrophobic residue
FNXAD

SEQ ID NO: 2102 - protein, 18 aa, synthetic construct
  source 1..18: note = Description of Artificial Sequence: Synthetic peptide
  VARIANT 2: note = Any amino acid
  VARIANT 4: note = Any amino acid
  VARIANT 5: note = Any amino acid
  VARIANT 6: note = Any amino acid
  VARIANT 7: note = Any amino acid
  VARIANT 9: note = Any amino acid
  VARIANT 10: note = Any amino acid
  VARIANT 11: note = Any amino acid
  VARIANT 12: note = Any amino acid
  VARIANT 13: note = Any amino acid
  VARIANT 14: note = Any amino acid
  VARIANT 17: note = Any amino acid
HXKXXXXDXXXXXXGSXN

SEQ ID NO: 2103 - skipped

SEQ ID NO: 2104 - protein, 4 aa, synthetic construct
  source 1..4: note = Description of Artificial Sequence: Synthetic peptide
PPLP

SEQ ID NO: 2105 - protein, 38 aa, synthetic construct
  source 1..38: note = Description of Artificial Sequence: Synthetic polypeptide
  VARIANT 1: note = Any amino acid
  VARIANT 3: note = Any amino acid
  VARIANT 4: note = Any amino acid
  VARIANT 5: note = Any amino acid
  VARIANT 6: note = Any amino acid
  VARIANT 7: note = Any amino acid
  VARIANT 8: note = Any amino acid
  VARIANT 9: note = Any amino acid
  VARIANT 10: note = Any amino acid
  VARIANT 11: note = Any amino acid
  VARIANT 12: note = Any amino acid
  VARIANT 13: note = Any amino acid
  VARIANT 14: note = Any amino acid
  VARIANT 15: note = Any amino acid
  VARIANT 17: note = Any amino acid
  VARIANT 19: note = Any amino acid
  VARIANT 20: note = Any amino acid
  VARIANT 22: note = Any amino acid
  VARIANT 23: note = Any amino acid
  VARIANT 24: note = Any amino acid
  VARIANT 25: note = Any amino acid
  VARIANT 26: note = Any amino acid
  VARIANT 27: note = Any amino acid
  VARIANT 28: note = Any amino acid
  VARIANT 29: note = Any amino acid
  VARIANT 30: note = Any amino acid
  VARIANT 32: note = Any amino acid
  VARIANT 33: note = Any amino acid
  VARIANT 34: note = Any amino acid
  VARIANT 35: note = Any amino acid
  VARIANT 37: note = Any amino acid
  VARIANT 38: note = Any amino acid
XCXXXXXXXXXXXXXCXCXXCXXXXXXXXXCXXXXCXX

SEQ ID NO: 2106 - protein, 10 aa, synthetic construct
  source 1..10: note = Description of Artificial Sequence: Synthetic peptide
  VARIANT 5: note = Leu or Cys
  VARIANT 10: note = Gln or Val
HWDYXEEEMX

SEQ ID NO: 2107 - protein, 10 aa, synthetic construct
  source 1..10: note = Description of Artificial Sequence: Synthetic peptide
  VARIANT 4: note = Tyr or Phe
HQEXLNSILQ

SEQ ID NO: 2108 - skipped

SEQ ID NO: 2109 - protein, 6 aa, synthetic construct
  source 1..6: note = Description of Artificial Sequence: Synthetic peptide
GGSGGS

SEQ ID NO: 2110 - protein, 9 aa, synthetic construct
  source 1..9: note = Description of Artificial Sequence: Synthetic peptide
GGSGGSGGS

SEQ ID NO: 2111 - protein, 12 aa, synthetic construct
  source 1..12: note = Description of Artificial Sequence: Synthetic peptide
GGSGGSGGSGGS

SEQ ID NO: 2112 - protein, 15 aa, synthetic construct
  source 1..15: note = Description of Artificial Sequence: Synthetic peptide
GGSGGSGGSGGSGGS

SEQ ID NO: 2113 - protein, 18 aa, synthetic construct
  source 1..18: note = Description of Artificial Sequence: Synthetic peptide
GGSGGSGGSGGSGGSGGS

SEQ ID NO: 2114 - protein, 5 aa, synthetic construct
  source 1..5: note = Description of Artificial Sequence: Synthetic peptide
GGGGS

SEQ ID NO: 2115 - protein, 10 aa, synthetic construct
  source 1..10: note = Description of Artificial Sequence: Synthetic peptide
GGGGSGGGGS

SEQ ID NO: 2116 - protein, 15 aa, synthetic construct
  source 1..15: note = Description of Artificial Sequence: Synthetic peptide
GGGGSGGGGSGGGGS

SEQ ID NO: 2117 - protein, 20 aa, synthetic construct
  source 1..20: note = Description of Artificial Sequence: Synthetic peptide
GGGGSGGGGSGGGGSGGGGS

SEQ ID NO: 2118 - protein, 25 aa, synthetic construct
  source 1..25: note = Description of Artificial Sequence: Synthetic peptide
GGGGSGGGGSGGGGSGGGGSGGGGS

SEQ ID NO: 2119 - protein, 30 aa, synthetic construct
  source 1..30: note = Description of Artificial Sequence: Synthetic polypeptide
GGGGSGGGGSGGGGSGGGGSGGGGSGGGGS

SEQ ID NO: 2120 - protein, 4 aa, synthetic construct
  source 1..4: note = Description of Artificial Sequence: Synthetic peptide
GGGG

SEQ ID NO: 2121 - protein, 5 aa, synthetic construct
  source 1..5: note = Description of Artificial Sequence: Synthetic peptide
GGGGG

SEQ ID NO: 2122 - protein, 6 aa, synthetic construct
  source 1..6: note = Description of Artificial Sequence: Synthetic peptide
GGGGGG

SEQ ID NO: 2123 - protein, 7 aa, synthetic construct
  source 1..7: note = Description of Artificial Sequence: Synthetic peptide
GGGGGGG

SEQ ID NO: 2124 - protein, 8 aa, synthetic construct
  source 1..8: note = Description of Artificial Sequence: Synthetic peptide
GGGGGGGG

SEQ ID NO: 2125 - protein, 6 aa, synthetic construct
  source 1..6: note = Description of Artificial Sequence: Synthetic peptide
GSSGSS

SEQ ID NO: 2126 - protein, 9 aa, synthetic construct
  source 1..9: note = Description of Artificial Sequence: Synthetic peptide
GSSGSSGSS

SEQ ID NO: 2127 - protein, 12 aa, synthetic construct
  source 1..12: note = Description of Artificial Sequence: Synthetic peptide
GSSGSSGSSGSS

SEQ ID NO: 2128 - protein, 15 aa, synthetic construct
  source 1..15: note = Description of Artificial Sequence: Synthetic peptide
GSSGSSGSSGSSGSS

SEQ ID NO: 2129 - protein, 18 aa, synthetic construct
  source 1..18: note = Description of Artificial Sequence: Synthetic peptide
GSSGSSGSSGSSGSSGSS

SEQ ID NO: 2130 - protein, 5 aa, synthetic construct
  source 1..5: note = Description of Artificial Sequence: Synthetic peptide
EAAAK

SEQ ID NO: 2131 - protein, 10 aa, synthetic construct
  source 1..10: note = Description of Artificial Sequence: Synthetic peptide
EAAAKEAAAK

SEQ ID NO: 2132 - protein, 15 aa, synthetic construct
  source 1..15: note = Description of Artificial Sequence: Synthetic peptide
EAAAKEAAAKEAAAK

SEQ ID NO: 2133 - protein, 20 aa, synthetic construct
  source 1..20: note = Description of Artificial Sequence: Synthetic peptide
EAAAKEAAAKEAAAKEAAAK

SEQ ID NO: 2134 - protein, 25 aa, synthetic construct
  source 1..25: note = Description of Artificial Sequence: Synthetic peptide
EAAAKEAAAKEAAAKEAAAKEAAAK

SEQ ID NO: 2135 - protein, 30 aa, synthetic construct
  source 1..30: note = Description of Artificial Sequence: Synthetic polypeptide
EAAAKEAAAKEAAAKEAAAKEAAAKEAAAK

SEQ ID NO: 2136 - protein, 5 aa, synthetic construct
  source 1..5: note = Description of Artificial Sequence: Synthetic peptide
PAPAP

SEQ ID NO: 2137 - protein, 7 aa, synthetic construct
  source 1..7: note = Description of Artificial Sequence: Synthetic peptide
PAPAPAP

SEQ ID NO: 2138 - protein, 9 aa, synthetic construct
  source 1..9: note = Description of Artificial Sequence: Synthetic peptide
PAPAPAPAP

SEQ ID NO: 2139 - protein, 11 aa, synthetic construct
  source 1..11: note = Description of Artificial Sequence: Synthetic peptide
PAPAPAPAPAP

SEQ ID NO: 2140 - protein, 13 aa, synthetic construct
  source 1..13: note = Description of Artificial Sequence: Synthetic peptide
PAPAPAPAPAPAP

SEQ ID NO: 2141 - protein, 6 aa, synthetic construct
  source 1..6: note = Description of Artificial Sequence: Synthetic peptide
GGSGGG

SEQ ID NO: 2142 - protein, 6 aa, synthetic construct
  source 1..6: note = Description of Artificial Sequence: Synthetic peptide
GGGGGS

SEQ ID NO: 2143 - protein, 6 aa, synthetic construct
  source 1..6: note = Description of Artificial Sequence: Synthetic peptide
GGSGSS

SEQ ID NO: 2144 - protein, 6 aa, synthetic construct
  source 1..6: note = Description of Artificial Sequence: Synthetic peptide
GSSGGS

SEQ ID NO: 2145 - protein, 8 aa, synthetic construct
  source 1..8: note = Description of Artificial Sequence: Synthetic peptide
GGSEAAAK

SEQ ID NO: 2146 - protein, 8 aa, synthetic construct
  source 1..8: note = Description of Artificial Sequence: Synthetic peptide
EAAAKGGS

SEQ ID NO: 2147 - protein, 6 aa, synthetic construct
  source 1..6: note = Description of Artificial Sequence: Synthetic peptide
GGSPAP

SEQ ID NO: 2148 - protein, 6 aa, synthetic construct
  source 1..6: note = Description of Artificial Sequence: Synthetic peptide
PAPGGS

SEQ ID NO: 2149 - protein, 6 aa, synthetic construct
  source 1..6: note = Description of Artificial Sequence: Synthetic peptide
GGGGSS

SEQ ID NO: 2150 - protein, 6 aa, synthetic construct
  source 1..6: note = Description of Artificial Sequence: Synthetic peptide
GSSGGG

SEQ ID NO: 2151 - protein, 8 aa, synthetic construct
  source 1..8: note = Description of Artificial Sequence: Synthetic peptide
GGGEAAAK

SEQ ID NO: 2152 - protein, 8 aa, synthetic construct
  source 1..8: note = Description of Artificial Sequence: Synthetic peptide
EAAAKGGG

SEQ ID NO: 2153 - protein, 6 aa, synthetic construct
  source 1..6: note = Description of Artificial Sequence: Synthetic peptide
GGGPAP

SEQ ID NO: 2154 - protein, 6 aa, synthetic construct
  source 1..6: note = Description of Artificial Sequence: Synthetic peptide
PAPGGG

SEQ ID NO: 2155 - protein, 8 aa, synthetic construct
  source 1..8: note = Description of Artificial Sequence: Synthetic peptide
GSSEAAAK

SEQ ID NO: 2156 - protein, 8 aa, synthetic construct
  source 1..8: note = Description of Artificial Sequence: Synthetic peptide
EAAAKGSS

SEQ ID NO: 2157 - protein, 6 aa, synthetic construct
  source 1..6: note = Description of Artificial Sequence: Synthetic peptide
GSSPAP

SEQ ID NO: 2158 - protein, 6 aa, synthetic construct
  source 1..6: note = Description of Artificial Sequence: Synthetic peptide
PAPGSS

SEQ ID NO: 2159 - protein, 8 aa, synthetic construct
  source 1..8: note = Description of Artificial Sequence: Synthetic peptide
EAAAKPAP

SEQ ID NO: 2160 - protein, 8 aa, synthetic construct
  source 1..8: note = Description of Artificial Sequence: Synthetic peptide
PAPEAAAK

SEQ ID NO: 2161 - protein, 9 aa, synthetic construct
  source 1..9: note = Description of Artificial Sequence: Synthetic peptide
GGSGGGGSS

SEQ ID NO: 2162 - protein, 9 aa, synthetic construct
  source 1..9: note = Description of Artificial Sequence: Synthetic peptide
GGSGSSGGG

SEQ ID NO: 2163 - protein, 9 aa, synthetic construct
  source 1..9: note = Description of Artificial Sequence: Synthetic peptide
GGGGGSGSS

SEQ ID NO: 2164 - protein, 9 aa, synthetic construct
  source 1..9: note = Description of Artificial Sequence: Synthetic peptide
GGGGSSGGS

SEQ ID NO: 2165 - protein, 9 aa, synthetic construct
  source 1..9: note = Description of Artificial Sequence: Synthetic peptide
GSSGGSGGG

SEQ ID NO: 2166 - protein, 9 aa, synthetic construct
  source 1..9: note = Description of Artificial Sequence: Synthetic peptide
GSSGGGGGS

SEQ ID NO: 2167 - protein, 11 aa, synthetic construct
  source 1..11: note = Description of Artificial Sequence: Synthetic peptide
GGSGGGEAAAK

SEQ ID NO: 2168 - protein, 11 aa, synthetic construct
  source 1..11: note = Description of Artificial Sequence: Synthetic peptide
GGSEAAAKGGG

SEQ ID NO: 2169 - protein, 11 aa, synthetic construct
  source 1..11: note = Description of Artificial Sequence: Synthetic peptide
GGGGGSEAAAK

SEQ ID NO: 2170 - protein, 11 aa, synthetic construct
  source 1..11: note = Description of Artificial Sequence: Synthetic peptide
GGGEAAAKGGS

SEQ ID NO: 2171 - protein, 11 aa, synthetic construct
  source 1..11: note = Description of Artificial Sequence: Synthetic peptide
EAAAKGGSGGG

SEQ ID NO: 2172 - protein, 11 aa, synthetic construct
  source 1..11: note = Description of Artificial Sequence: Synthetic peptide
EAAAKGGGGGS

SEQ ID NO: 2173 - protein, 9 aa, synthetic construct
  source 1..9: note = Description of Artificial Sequence: Synthetic peptide
GGSGGGPAP

SEQ ID NO: 2174 - protein, 9 aa, synthetic construct
  source 1..9: note = Description of Artificial Sequence: Synthetic peptide
GGSPAPGGG

SEQ ID NO: 2175 - protein, 9 aa, synthetic construct
  source 1..9: note = Description of Artificial Sequence: Synthetic peptide
GGGGGSPAP

SEQ ID NO: 2176 - protein, 9 aa, synthetic construct
  source 1..9: note = Description of Artificial Sequence: Synthetic peptide
GGGPAPGGS

SEQ ID NO: 2177 - protein, 9 aa, synthetic construct
  source 1..9: note = Description of Artificial Sequence: Synthetic peptide
PAPGGSGGG

SEQ ID NO: 2178 - protein, 9 aa, synthetic construct
  source 1..9: note = Description of Artificial Sequence: Synthetic peptide
PAPGGGGGS

SEQ ID NO: 2179 - protein, 11 aa, synthetic construct
  source 1..11: note = Description of Artificial Sequence: Synthetic peptide
GGSGSSEAAAK

SEQ ID NO: 2180 - protein, 11 aa, synthetic construct
  source 1..11: note = Description of Artificial Sequence: Synthetic peptide
GGSEAAAKGSS

SEQ ID NO: 2181 - protein, 11 aa, synthetic construct
  source 1..11: note = Description of Artificial Sequence: Synthetic peptide
GSSGGSEAAAK

SEQ ID NO: 2182 - protein, 11 aa, synthetic construct
  source 1..11: note = Description of Artificial Sequence: Synthetic peptide
GSSEAAAKGGS

SEQ ID NO: 2183 - protein, 11 aa, synthetic construct
  source 1..11: note = Description of Artificial Sequence: Synthetic peptide
EAAAKGGSGSS

SEQ ID NO: 2184 - protein, 11 aa, synthetic construct
  source 1..11: note = Description of Artificial Sequence: Synthetic peptide
EAAAKGSSGGS

SEQ ID NO: 2185 - protein, 9 aa, synthetic construct
  source 1..9: note = Description of Artificial Sequence: Synthetic peptide
GGSGSSPAP

SEQ ID NO: 2186 - protein, 9 aa, synthetic construct
  source 1..9: note = Description of Artificial Sequence: Synthetic peptide
GGSPAPGSS

SEQ ID NO: 2187 - protein, 9 aa, synthetic construct
  source 1..9: note = Description of Artificial Sequence: Synthetic peptide
GSSGGSPAP

SEQ ID NO: 2188 - protein, 9 aa, synthetic construct
  source 1..9: note = Description of Artificial Sequence: Synthetic peptide
GSSPAPGGS

SEQ ID NO: 2189 - protein, 9 aa, synthetic construct
  source 1..9: note = Description of Artificial Sequence: Synthetic peptide
PAPGGSGSS

SEQ ID NO: 2190 - protein, 9 aa, synthetic construct
  source 1..9: note = Description of Artificial Sequence: Synthetic peptide
PAPGSSGGS

SEQ ID NO: 2191 - protein, 11 aa, synthetic construct
  source 1..11: note = Description of Artificial Sequence: Synthetic peptide
GGSEAAAKPAP

SEQ ID NO: 2192 - protein, 11 aa, synthetic construct
  source 1..11: note = Description of Artificial Sequence: Synthetic peptide
GGSPAPEAAAK

SEQ ID NO: 2193 - protein, 11 aa, synthetic construct
  source 1..11: note = Description of Artificial Sequence: Synthetic peptide
EAAAKGGSPAP

SEQ ID NO: 2194 - protein, 11 aa, synthetic construct
  source 1..11: note = Description of Artificial Sequence: Synthetic peptide
EAAAKPAPGGS

SEQ ID NO: 2195 - protein, 11 aa, synthetic construct
  source 1..11: note = Description of Artificial Sequence: Synthetic peptide
PAPGGSEAAAK

SEQ ID NO: 2196 - protein, 11 aa, synthetic construct
  source 1..11: note = Description of Artificial Sequence: Synthetic peptide
PAPEAAAKGGS

SEQ ID NO: 2197 - protein, 11 aa, synthetic construct
  source 1..11: note = Description of Artificial Sequence: Synthetic peptide
GGGGSSEAAAK

SEQ ID NO: 2198 - protein, 11 aa, synthetic construct
  source 1..11: note = Description of Artificial Sequence: Synthetic peptide
GGGEAAAKGSS

SEQ ID NO: 2199 - protein, 11 aa, synthetic construct
  source 1..11: note = Description of Artificial Sequence: Synthetic peptide
GSSGGGEAAAK

SEQ ID NO: 2200 - protein, 11 aa, synthetic construct
  source 1..11: note = Description of Artificial Sequence: Synthetic peptide
GSSEAAAKGGG

SEQ ID NO: 2201 - protein, 11 aa, synthetic construct
  source 1..11: note = Description of Artificial Sequence: Synthetic peptide
EAAAKGGGGSS

SEQ ID NO: 2202 - protein, 11 aa, synthetic construct
  source 1..11: note = Description of Artificial Sequence: Synthetic peptide
EAAAKGSSGGG

SEQ ID NO: 2203 - protein, 9 aa, synthetic construct
  source 1..9: note = Description of Artificial Sequence: Synthetic peptide
GGGGSSPAP

SEQ ID NO: 2204 - protein, 9 aa, synthetic construct
  source 1..9: note = Description of Artificial Sequence: Synthetic peptide
GGGPAPGSS

SEQ ID NO: 2205 - protein, 9 aa, synthetic construct
  source 1..9: note = Description of Artificial Sequence: Synthetic peptide
GSSGGGPAP

SEQ ID NO: 2206 - protein, 9 aa, synthetic construct
  source 1..9: note = Description of Artificial Sequence: Synthetic peptide
GSSPAPGGG

SEQ ID NO: 2207 - protein, 9 aa, synthetic construct
  source 1..9: note = Description of Artificial Sequence: Synthetic peptide
PAPGGGGSS

SEQ ID NO: 2208 - protein, 9 aa, synthetic construct
  source 1..9: note = Description of Artificial Sequence: Synthetic peptide
PAPGSSGGG

SEQ ID NO: 2209 - protein, 11 aa, synthetic construct
  source 1..11: note = Description of Artificial Sequence: Synthetic peptide
GGGEAAAKPAP

SEQ ID NO: 2210 - protein, 11 aa, synthetic construct
  source 1..11: note = Description of Artificial Sequence: Synthetic peptide
GGGPAPEAAAK

SEQ ID NO: 2211 - protein, 11 aa, synthetic construct
  source 1..11: note = Description of Artificial Sequence: Synthetic peptide
EAAAKGGGPAP

SEQ ID NO: 2212 - protein, 11 aa, synthetic construct
  source 1..11: note = Description of Artificial Sequence: Synthetic peptide
EAAAKPAPGGG

SEQ ID NO: 2213 - protein, 11 aa, synthetic construct
  source 1..11: note = Description of Artificial Sequence: Synthetic peptide
PAPGGGEAAAK

SEQ ID NO: 2214 - protein, 11 aa, synthetic construct
  source 1..11: note = Description of Artificial Sequence: Synthetic peptide
PAPEAAAKGGG

SEQ ID NO: 2215 - protein, 11 aa, synthetic construct
  source 1..11: note = Description of Artificial Sequence: Synthetic peptide
GSSEAAAKPAP

SEQ ID NO: 2216 - protein, 11 aa, synthetic construct
  source 1..11: note = Description of Artificial Sequence: Synthetic peptide
GSSPAPEAAAK

SEQ ID NO: 2217 - protein, 11 aa, synthetic construct
  source 1..11: note = Description of Artificial Sequence: Synthetic peptide
EAAAKGSSPAP

SEQ ID NO: 2218 - protein, 11 aa, synthetic construct
  source 1..11: note = Description of Artificial Sequence: Synthetic peptide
EAAAKPAPGSS

SEQ ID NO: 2219 - protein, 11 aa, synthetic construct
  source 1..11: note = Description of Artificial Sequence: Synthetic peptide
PAPGSSEAAAK

SEQ ID NO: 2220 - protein, 11 aa, synthetic construct
  source 1..11: note = Description of Artificial Sequence: Synthetic peptide
PAPEAAAKGSS

SEQ ID NO: 2221 - protein, 46 aa, synthetic construct
  source 1..46: note = Description of Artificial Sequence: Synthetic polypeptide
AEAAAKEAAAKEAAAKEAAAKALEAEAAAKEAAAKEAAAKEAAAKA

SEQ ID NO: 2222 - protein, 15 aa, synthetic construct
  source 1..15: note = Description of Artificial Sequence: Synthetic peptide
GGGGSEAAAKGGGGS

SEQ ID NO: 2223 - protein, 15 aa, synthetic construct
  source 1..15: note = Description of Artificial Sequence: Synthetic peptide
EAAAKGGGGSEAAAK

SEQ ID NO: 2224 - protein, 12 aa, synthetic construct
  source 1..12: note = Description of Artificial Sequence: Synthetic peptide
GSAGSAAGSGEF

SEQ ID NO: 2225 - protein, 1082 aa, synthetic construct
  source 1..1082: note = Description of Artificial Sequence: Synthetic polypeptide
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 2226 - protein, 1055 aa, synthetic construct
  source 1..1055: note = Description of Artificial Sequence: Synthetic polypeptide
MQNNPLNYILGLDLGIASIGWAVVEIDEESSPIRLIDVGVRTFERAEVAKTGESLALSRRLARSSRRLIKRRAERLKKAKRLLKAEKILHSIDEKLPINVWQLRVKGLKEKLERQEWAAVLLHLSKHRGYLSQRKNEGKSDNKELGALLSGIASNHQMLQSSEYRTPAEIAVKKFQVEEGHIRNQRGSYTHTFSRLDLLAEMELLFQRQAELGNSYTSTTLLENLTALLMWQKPALAGDAILKMLGKCTFEPSEYKAAKNSYSAERFVWLTKLNNLRILENGTERALNDNERFALLEQPYEKSKLTYAQVRAMLALSDNAIFKGVRYLGEDKKTVESKTTLIEMKFYHQIRKTLGSAELKKEWNELKGNSDLLDEIGTAFSLYKTDDDICRYLEGKLPERVLNALLENLNFDKFIQLSLKALHQILPLMLQGQRYDEAVSAIYGDHYGKKSTETTRLLPTIPADEIRNPVVLRTLTQARKVINAVVRLYGSPARIHIETAREVGKSYQDRKKLEKQQEDNRKQRESAVKKFKEMFPHFVGEPKGKDILKMRLYELQQAKCLYSGKSLELHRLLEKGYVEVDHALPFSRTWDDSFNNKVLVLANENQNKGNLTPYEWLDGKNNSERWQHFVVRVQTSGFSYAKKQRILNHKLDEKGFIERNLNDTRYVARFLCNFIADNMLLVGKGKRNVFASNGQITALLRHRWGLQKVREQNDRHHALDAVVVACSTVAMQQKITRFVRYNEGNVFSGERIDRETGEIIPLHFPSPWAFFKENVEIRIFSENPKLELENRLPDYPQYNHEWVQPLFVSRMPTRKMTGQGHMETVKSAKRLNEGLSVLKVPLTQLKLSDLERMVNRDREIALYESLKARLEQFGNDPAKAFAEPFYKKGGALVKAVRLEQTQKSGVLVRDGNGVADNASMVRVDVFTKGGKYFLVPIYTWQVAKGILPNRAATQGKDENDWDIMDEMATFQFSLCQNDLIKLVTKKKTIFGYFNGLNRATSNINIKEHDLDKSKGKLGIYLEVGVKLAISLEKYQVDELGKNIRPCRPTKRQHVR

SEQ ID NO: 2227 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 2228 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 2229 - protein, 1061 aa, synthetic construct
  source 1..1061: note = Description of Artificial Sequence: Synthetic polypeptide
MQENQQKQNYILGLDIGITSVGYGLIDSKTREVIDAGVRLFPEADSENNSNRRSKRGARRLKRRRIHRLNRVKDLLADYQMIDLNNVPKSTDPYTIRVKGLREPLTKEEFAIALLHIAKRRGLHNISVSMGDEEQDNELSTKQQLQKNAQQLQDKYVCELQLERLTNINKVRGEKNRFKTEDFVKEVKQLCETQRQYHNIDDQFIQQYIDLVSTRREYFEGPGNGSPYGWDGDLLKWYEKLMGRCTYFPEELRSVKYAYSADLFNALNDLNNLVVTRDDNPKLEYYEKYHIIENVFKQKKNPTLKQIAKEIGVQDYDIRGYRITKSGKPQFTSFKLYHDLKNIFEQAKYLEDVEMLDEIAKILTIYQDEISIKKALDQLPELLTESEKSQIAQLTGYTGTHRLSLKCIHIVIDELWESPENQMEIFTRLNLKPKKVEMSEIDSIPTTLVDEFILSPVVKRAFIQSIKVINAVINRFGLPEDIIIELAREKNSKDRRKFINKLQKQNEATRKKIEQLLAKYGNTNAKYMIEKIKLHDMQEGKCLYSLEAIPLEDLLSNPTHYEVDHIIPRSVSFDNSLNNKVLVKQSENSKKGNRTPYQYLSSNESKISYNQFKQHILNLSKAKDRISKKKRDMLLEERDINKFEVQKEFINRNLVDTRYATRELSNLLKTYFSTHDYAVKVKTINGGFTNHLRKVWDFKKHRNHGYKHHAEDALVIANADFLFKTHKALRRTDKILEQPGLEVNDTTVKVDTEEKYQELFETPKQVKNIKQFRDFKYSHRVDKKPNRQLINDTLYSTREIDGETYVVQTLKDLYAKDNEKVKKLFTERPQKILMYQHDPKTFEKLMTILNQYAEAKNPLAAYYEDKGEYVTKYAKKGNGPAIHKIKYIDKKLGSYLDVSNKYPETQNKLVKLSLKSFRFDIYKCEQGYKMVSIGYLDVLKKDNYYYIPKDKYEAEKQKKKIKESDLFVGSFYYNDLIMYEDELFRVIGVNSDINNLVELNMVDITYKDFCEVNNVTGEKRIKKTIGKRVVLIEKYTTDILGNLYKTPLPKKPQLIFKRGEL

SEQ ID NO: 2230 - protein, 1061 aa, synthetic construct
  source 1..1061: note = Description of Artificial Sequence: Synthetic polypeptide
MQENQQKQNYILGLDIGITSVGYGLIDSKTREVIDAGVRLFPEADSENNSNRRSKRGARRLKRRRIHRLNRVKDLLADYQMIDLNNVPKSTDPYTIRVKGLREPLTKEEFAIALLHIAKRRGLHNISVSMGDEEQDNELSTKQQLQKNAQQLQDKYVCELQLERLTNINKVRGEKNRFKTEDFVKEVKQLCETQRQYHNIDDQFIQQYIDLVSTRREYFEGPGNGSPYGWDGDLLKWYEKLMGRCTYFPEELRSVKYAYSADLFNALNDLNNLVVTRDDNPKLEYYEKYHIIENVFKQKKNPTLKQIAKEIGVQDYDIRGYRITKSGKPQFTSFKLYHDLKNIFEQAKYLEDVEMLDEIAKILTIYQDEISIKKALDQLPELLTESEKSQIAQLTGYTGTHRLSLKCIHIVIDELWESPENQMEIFTRLNLKPKKVEMSEIDSIPTTLVDEFILSPVVKRAFIQSIKVINAVINRFGLPEDIIIELAREKNSKDRRKFINKLQKQNEATRKKIEQLLAKYGNTNAKYMIEKIKLHDMQEGKCLYSLEAIPLEDLLSNPTHYEVDHIIPRSVSFDNSLNNKVLVKQSENSKKGNRTPYQYLSSNESKISYNQFKQHILNLSKAKDRISKKKRDMLLEERDINKFEVQKEFINRNLVDTRYATRELSNLLKTYFSTHDYAVKVKTINGGFTNHLRKVWDFKKHRNHGYKHHAEDALVIANADFLFKTHKALRRTDKILEQPGLEVNDTTVKVDTEEKYQELFETPKQVKNIKQFRDFKYSHRVDKKPNRKLINDTLYSTREIDGETYVVQTLKDLYAKDNEKVKKLFTERPQKILMYQHDPKTFEKLMTILNQYAEAKNPLAAYYEDKGEYVTKYAKKGNGPAIHKIKYIDKKLGSYLDVSNKYPETQNKLVKLSLKSFRFDIYKCEQGYKMVSIGYLDVLKKDNYYYIPKDKYEAEKQKKKIKESDLFVGSFYKNDLIMYEDELFRVIGVNSDINNLVELNMVDITYKDFCEVNNVTGEKHIKKTIGKRVVLIEKYTTDILGNLYKTPLPKKPQLIFKRGEL

SEQ ID NO: 2231 - protein, 1375 aa, synthetic construct
  source 1..1375: note = Description of Artificial Sequence: Synthetic polypeptide
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGADKKLRKRSGKLATEEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASAKELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 2232 - protein, 1368 aa, synthetic construct [sequence omitted]

SEQ ID NO: 2233 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGD

SEQ ID NO: 2234 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAERTRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFLWPTVAYSVLVVAKVEKGKSKKLKSVKELLGITIMERSSFEKNPIDFLEAKGYKEVKKDLIIKLPKYSLFELENGRKRMLASAKQLQKGNELALPSKYVNFLYLASHYEKLKGSPEDNEQKQLFVEQHKHYLDEIIEQISEFSKRVILADANLDKVLSAYNKHRDKPIREQAENIIHLFTLTRLGAPRAFKYFDTTIDPKQYRSTKEVLDATLIHQSITGLYETRIDLSQLGGD

SEQ ID NO: 2235 - protein, 1121 aa, synthetic construct
  source 1..1121: note = Description of Artificial Sequence: Synthetic polypeptide
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 2236 - protein, 1092 aa, synthetic construct
  source 1..1092: note = Description of Artificial Sequence: Synthetic polypeptide
MAYTMGIDVGIASCGWAIVDLERQRIIDIGVRTFEKAENPKNGEALAVPRREARSSRRRLRRKKHRIERLKHMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRSSLLVEIHTLFETQRQHHNSLASKDFELEYVNIWSAQRPVATKDQIEKMIGTCTFLPKEKRAPKASWHFQYFMLLQTINHIRITNVQGTRSLNKEEIEQVVNMALTKSKVSYHDTRKILDLSEEYQFVGLDYGKEDEKKKVESKETIIKLDDYHKLNKIFNEVELAKGETWEADDYDTVAYALTFFKDDEDIRDYLQNKYKDSKNRLVKNLANKEYTNELIGKVSTLSFRKVGHLSLKALRKIIPFLEQGMTYDKACQAAGFDFQGISKKKRSVVLPVIDQISNPVVNRALTQTRKVINALIKKYGSPETIHIETARELSKTFDERKNITKDYKENRDKNEHAKKHLSELGIINPTGLDIVKYKLWCEQQGRCMYSNQPISFERLKESGYTEVDHIIPYSRSMNDSYNNRVLVMTRENREKGNQTPFEYMGNDTQRWYEFEQRVTTNPQIKKEKRQNLLLKGFTNRRELEMLERNLNDTRYITKYLSHFISTNLEFSPSDKKKKVVNTSGRITSHLRSRWGLEKNRGQNDLHHAMDAIVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNVKKAFSTDLHKPKKDGTKGPLIKSVRIMENKTLVHPVNKGKGVVYNSSIVRTDVFQRKEKYYLLPVYVTDVTKGKLPNKVIVAKKGYHDWIEVDDSFTFLFSLYPNDLIFIRQNPKKKISLKKRIESHSISDSKEVQEIHAYYKGVDSSTAAIEFIIHDGSYYAKGVGVQNLDCFEKYQVDILGNYFKVKGEKRLELETSDSNHKGKDVNSIKSTSR

SEQ ID NO: 2237 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNSDKNNLIEVNMIDITYREYLENMNDKRPPHIIKTIASKTQSIKKYSTDILGNLYEVKSKKHPQIIKKG

SEQ ID NO: 2238 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNSTRNIVELNMIDITYREYLENMNDKRPPHIIKTIASKTQSIKKYSTDILGNLYEVKSKKHPQIIKKG

SEQ ID NO: 2239 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNSDDRNIIELNMIDITYREYLENMNDKRPPHIIKTIASKTQSIKKYSTDILGNLYEVKSKKHPQIIKKG

SEQ ID NO: 2240 - protein, 1053 aa, synthetic construct
  source 1..1053: note = Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNNRLNKIELNMIDITYREYLENMNDKRPPHIIKTIASKTQSIKKYSTDILGNLYEVKSKKHPQIIKKG

SEQ ID NO: 2241 - protein, 1084 aa, synthetic construct
  source 1..1084: note = Description of Artificial Sequence: Synthetic polypeptide
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 2242 - protein, 984 aa, synthetic construct
  source 1..984: note = Description of Artificial Sequence: Synthetic polypeptide
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 2243 - protein, 1087 aa, synthetic construct
  source 1..1087: note = Description of Artificial Sequence: Synthetic polypeptide
MRYKIGLDIGITSVGWAVMNLDIPRIEDLGVRIFDRAENPQTGESLALPRRLARSARRRLRRRKHRLERIRRLVIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYITIWASQRPVASKDDIEKKVGFCTFEPKEKRAPKATYTFQSFIAWEHINKLRLISPSGARGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIHSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYVEVDHVIPYSRSLDDSYTNKVLVLTRENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAVIVACTTPSDIAKVTAFYQRREQNKELAKKTEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKTVKTAAGEEINVKDVFVYYKTIDSANGGLELISHDHRFSLRGVGSRTLKRFEKYQVDVLGNIYKVRGEKRVGLASSAHSKPGKTIRPLQSTRD

SEQ ID NO: 2244 - protein, 1378 aa, synthetic construct
  source 1..1378: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRKLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLKREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGEDSGGSGGSKRTADGSEFES

SEQ ID NO: 2245 - protein, 1082 aa, synthetic construct
  source 1..1082: note = Description of Artificial Sequence: Synthetic polypeptide
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 2246 - protein, 1375 aa, synthetic construct
  source 1..1375: note = Description of Artificial Sequence: Synthetic polypeptide
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 2247 - protein, 1375 aa, synthetic construct
  source 1..1375: note = Description of Artificial Sequence: Synthetic polypeptide
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGADKKLRKRSGKLATEEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNANFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASAKELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 2248 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTAAYSVLVVAKVEKGKSKKLKSVKELLGITIMERSSFEKNPIGFLEAKGYKEVKKDLIIKLPKYSLFELENGRKRMLASAGVLHKGNELALPSKYVNFLYLASHYEKLKGSPEDNEQKQLFVEQHKHYLDEIIEQISEFSKRVILADANLDKVLSAYNKHRDKPIREQAENIIHLFTLTNLGVPAAFKYFDTTIDKKRYTSTKEVLDATLIHQSITGLYETRIDLSQLGGD

SEQ ID NO: 2249 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTVAYSVLVVAKVEKGKSKKLKSVKELLGITIMERSSFEKNPIGFLEAKGYKEVKKDLIIKLPKYSLFELENGRKRMLASASVLHKGNELALPSKYVNFLYLASHYEKLKGSSEDNKQKQLFVEQHKHYLDEIIEQISEFSKRVILADANLDKVLSAYNKHRDKPIREQAENIIHLFTLTNLGASAAFKYFDTTIGRKLYTSTKEVLDATLIHQSITGLYETRIDLSQLGGD

SEQ ID NO: 2250 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTINRKQYNTTKEVLDATLIRQSITGLYETRIDLSQLGGD

SEQ ID NO: 2251 - DNA, 10 bp, synthetic construct
  source 1..10: mol_type = other DNA; note = Description of Artificial Sequence: Synthetic oligonucleotide
taataataat

SEQ ID NO: 2252 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADAQLDKVLSAYNKHRDKPIREQAENIIHLFTLTNLGAPAAFKYFDTTFKQKQYRSTKEVLDATLIHQSITGLYETRIDLSQLGGD

SEQ ID NO: 2253 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFLWPTVAYSVLVVAKVEKGKSKKLKSVKELLGITIMERSSFEKNPIDFLEAKGYKEVKKDLIIKLPKYSLFELENGRKRMLASAKQLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 2254 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 2255 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 2256 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNTEITKAPLSASMIKLYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQEDFYPFLKDNREKIEKILTFRIPYYVGPLARGNSRFAWMTRKSEETITPWNFEKVVDKGASAQSFIERMTNFDKNLPNEKVLPKHSLLYEYFTVYNELTKVKYVTEGMRKPAFLSGDQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFIQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 2257 - protein, 1368 aa, synthetic construct
  source 1..1368: note = Description of Artificial Sequence: Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNTEITKAPLSASMIKLYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQEDFYPFLKDNREKIEKILTFRIPYYVGPLARGNSRFAWMTRKSEETITPWNFEKVVDKGASAQSFIERMTNFDKNLPNEKVLPKHSLLYEYFTVYNELTKVKYVTEGMRKPAFLSGDQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFIQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGD

SEQ ID NO: 2258 - protein, 1122 aa, synthetic construct
  source 1..1122: note = Description of Artificial Sequence: Synthetic polypeptide
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKATGKYEILGLKYADLQFEKGTGTYKISQEKYNDIKKKEGVDSDSEFKFTLYKNDLLLVKDTETKEQQLFRFLSRTLPKQKHYVELKPYDKQKFEGGEALIKVLGNVANGGQCIKGLAKSNISIYKVRTDVLGNQHIIKNEGDKPKLDF

SEQ ID NO: 2259 - protein, 1122 aa, synthetic construct
  source 1..1122: note = Description of Artificial Sequence: Synthetic polypeptide
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 2260 - protein, 1120 aa, synthetic construct
  source 1..1120: note = Description of Artificial Sequence: Synthetic polypeptide
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSLKPWRTDVYFNKNTGKYEILGLKYSDMQFEKGTGKYSISKEQYENIKVREGVDENSEFKFTLYKNDLLLLKDSENGEQILLRFTSRNDTSKHYVELKPYNRQKFEGSEYLIKSLGTVAKGGQCIKGLGKSNISIYKVRTDVLGNQHIIKNEGDKPKLDF

SEQ ID NO: 2261 - protein, 1120 aa, synthetic construct
  source 1..1120: note = Description of Artificial Sequence: Synthetic polypeptide
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSLKPWRTDVYFNKNTGKYEILGLKYSDMQFEKGTGKYSISKEQYENIKVREGVDENSEFKFTLYKNDLLLLKDSENGEQILLRFTSRNDTSKHYVELKPYNRQKFEGSEYLIKSLGTVVKGGRCIKGLGKSNISIYKVRTDVLGNQHIIKNEGDKPKLDF

SEQ ID NO: 2262 - DNA, 24 bp, synthetic construct
  source 1..24: mol_type = other DNA; note = Description of Artificial Sequence: Synthetic oligonucleotide
gttgtagctccctttctcatttcg

SEQ ID NO: 2263 - DNA, 25 bp, synthetic construct
  source 1..25: mol_type = other DNA; note = Description of Artificial Sequence: Synthetic oligonucleotide
gttgtagctccctttttcatttcgc

SEQ ID NO: 2264 - DNA, 14 bp, synthetic construct
  source 1..14: mol_type = other DNA; note = Description of Artificial Sequence: Synthetic oligonucleotide
gttttagtactctg

SEQ ID NO: 2265 - DNA, 18 bp, synthetic construct
  source 1..18: mol_type = other DNA; note = Description of Artificial Sequence: Synthetic oligonucleotide
gttttagtactctgtaat

SEQ ID NO: 2266 - DNA, 12 bp, synthetic construct
  source 1..12: mol_type = other DNA; note = Description of Artificial Sequence: Synthetic oligonucleotide
gttttagagcta

SEQ ID NO: 2267 - DNA, 17 bp, synthetic construct
  source 1..17: mol_type = other DNA; note = Description of Artificial Sequence: Synthetic oligonucleotide
gtttaagagctatgctg

SEQ ID NO: 2268 - DNA, 14 bp, synthetic construct
  source 1..14: mol_type = other DNA; note = Description of Artificial Sequence: Synthetic oligonucleotide
gtctttgtactctg

SEQ ID NO: 2269 - DNA, 16 bp, synthetic construct
  source 1..16: mol_type = other DNA; note = Description of Artificial Sequence: Synthetic oligonucleotide
gctatagttccttact

SEQ ID NO: 2270 - RNA, 14 nt, synthetic construct
  source 1..14: mol_type = other RNA; note = Description of Artificial Sequence: Synthetic oligonucleotide
gtcttagtactctg

SEQ ID NO: 2271 - RNA, 12 nt, synthetic construct
  source 1..12: mol_type = other RNA; note = Description of Artificial Sequence: Synthetic oligonucleotide
actggggttcag

SEQ ID NO: 2272 - DNA, 12 bp, synthetic construct
  source 1..12: mol_type = other DNA; note = Description of Artificial Sequence: Synthetic oligonucleotide
gttttagtccct

SEQ ID NO: 2273 - RNA, 16 nt, synthetic construct
  source 1..16: mol_type = other RNA; note = Description of Artificial Sequence: Synthetic oligonucleotide
gtcatagttcccctga

SEQ ID NO: 2274 - DNA, 93 bp, synthetic construct
  source 1..93: mol_type = other DNA; note = Description of Artificial Sequence: Synthetic oligonucleotide
cgaaatgagaaccgttgctacaataaggccgtctgaaaagatgtgccgcaacgctctgccccttaaagcttctgctttaaggggcatcgttta

SEQ ID NO: 2275 - DNA, 87 bp, synthetic construct
  source 1..87: mol_type = other DNA; note = Description of Artificial Sequence: Synthetic oligonucleotide
gcgaaatgaaaaacgttgttacaataagagatgaatttctcgcaaagctctgcctcttgaaatttcggtttcaagaggcatcttttt

SEQ ID NO: 2276 - DNA, 58 bp, synthetic construct
  source 1..58: mol_type = other DNA; note = Description of Artificial Sequence: Synthetic oligonucleotide
cagaatctactaaaacaaggcaaaatgccgtgtttatctcgtcaacttgttggcgaga

SEQ ID NO: 2277 - DNA, 62 bp, synthetic construct
  source 1..62: mol_type = other DNA; note = Description of Artificial Sequence: Synthetic oligonucleotide
attacagaatctactaaaacaaggcaaaatgccgtgtttatctcgtcaacttgttggcgaga

SEQ ID NO: 2278 - DNA, 63 bp, synthetic construct
  source 1..63: mol_type = other DNA; note = Description of Artificial Sequence: Synthetic oligonucleotide
cagaatctactaaaacaaggcaaaatgccgtgtttatctcgtcaacttgttggcgagattttt

SEQ ID NO: 2279 - DNA, 60 bp, synthetic construct
  source 1..60: mol_type = other DNA; note = Description of Artificial Sequence: Synthetic oligonucleotide
tagcaagttaaaataaggctagtccgttatcaacttgaaaaagtggcaccgagtcggtgc

SEQ ID NO: 2280 - DNA, 65 bp, synthetic construct
  source 1..65: mol_type = other DNA; note = Description of Artificial Sequence: Synthetic oligonucleotide
cagcatagcaagtttaaataaggctagtccgttatcaacttgaaaaagtggcaccgagtcggtgc

SEQ ID NO: 2281 - DNA, 66 bp, synthetic construct
  source 1..66: mol_type = other DNA; note = Description of Artificial Sequence: Synthetic oligonucleotide
cagaagctacaaagataaggcttcatgccgaaatcaacaccctgtcattttatggcagggtgtttt

SEQ ID NO: 2282 - DNA, 127 bp, synthetic construct
  source 1..127: mol_type = other DNA; note = Description of Artificial Sequence: Synthetic polynucleotide
ggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 2283 - RNA, 65 nt, synthetic construct
  source 1..65: mol_type = other RNA; note = Description of Artificial Sequence: Synthetic oligonucleotide
cagaatctactaagacaaggcaaaatgccgtgtttatctcgtcaacttgttggcgagattttttt

SEQ ID NO: 2284 - RNA, 76 nt, synthetic construct
  source 1..76: mol_type = other RNA; note = Description of Artificial Sequence: Synthetic oligonucleotide
ctgaacctcagtaagcattggctcgtttccaatgttgattgctccgccggtgctccttatttttaagggcgccggc

SEQ ID NO: 2285 - DNA, 63 bp, synthetic construct
  source 1..63: mol_type = other DNA; note = Description of Artificial Sequence: Synthetic oligonucleotide
agggactaaaataaagagtttgcgggactctgcggggttacaatcccctaaaaccgctttttt

SEQ ID NO: 2286 - RNA, 98 nt, synthetic construct
  source 1..98: mol_type = other RNA; note = Description of Artificial Sequence: Synthetic oligonucleotide
tcagggttactatgataagggctttctgcctaaggcagactgacccgcggcgttggggatcgcctgtcgcccgcttttggcgggcattccccatcctt

SEQ ID NO: 2287 - protein, 30 aa, Rattus norvegicus
AHFKISGEKRPSTDPGKKAKNPKKKKKKDP

SEQ ID NO: 2288 - protein, 12 aa, Saccharomyces cerevisiae
AHRAKKMSKTHA

SEQ ID NO: 2289 - protein, 14 aa, unidentified
  source 1..14: note = Description of Unknown:NLS sequence
ASPEYVNLPINGNG

SEQ ID NO: 2290 - protein, 7 aa, unidentified
  source 1..7: note = Description of Unknown:NLS sequence
CTKRPRW

SEQ ID NO: 2291 - protein, 16 aa, unidentified
  source 1..16: note = Description of Unknown:NLS sequence
DKAKRVSRNKSEKKRR

SEQ ID NO: 2292 - protein, 15 aa, unidentified
  source 1..15: note = Description of Unknown:NLS sequence
EELRLKEELLKGIYA

SEQ ID NO: 2293 - protein, 16 aa, Caenorhabditis elegans
EEQLRRRKNSRLNNTG

SEQ ID NO: 2294 - protein, 24 aa, unidentified
  source 1..24: note = Description of Unknown:NLS sequence
EVLKVIRTGKRKKKAWKRMVTKVC

SEQ ID NO: 2295 - protein, 15 aa, unidentified
  source 1..15: note = Description of Unknown:NLS sequence
HHHHHHHHHHHHQPH

SEQ ID NO: 2296 - protein, 17 aa, unidentified
  source 1..17: note = Description of Unknown:NLS sequence
HKKKHPDASVNFSEFSK

SEQ ID NO: 2297 - protein, 6 aa, Oryza sativa
HKRTKK

SEQ ID NO: 2298 - protein, 29 aa, unidentified
  source 1..29: note = Description of Unknown:NLS sequence
IINGRKLKLKKSRRRSSQTSNNSFTSRRS

SEQ ID NO: 2299 - protein, 8 aa, Oryza sativa
KAEQERRK

SEQ ID NO: 2300 - protein, 18 aa, unidentified
  source 1..18: note = Description of Unknown:NLS sequence
KEKRKRREELFIEQKKRK

SEQ ID NO: 2301 - protein, 14 aa, Mus musculus
KKGKDEWFSRGKKP

SEQ ID NO: 2302 - protein, 12 aa, Homo sapiens
KKGPSVQKRKKT

SEQ ID NO: 2303 - protein, 16 aa, unidentified
  source 1..16: note = Description of Unknown:NLS sequence
KKKTVINDLLHYKKEK

SEQ ID NO: 2304 - protein, 17 aa, unidentified
  source 1..17: note = Description of Unknown:NLS sequence
KKNGGKGKNKPSAKIKK

SEQ ID NO: 2305 - protein, 13 aa, unidentified
  source 1..13: note = Description of Unknown:NLS sequence
KKPKWDDFKKKKK

SEQ ID NO: 2306 - protein, 6 aa, unidentified
  source 1..6: note = Description of Unknown:NLS sequence
KKRKKD

SEQ ID NO: 2307 - protein, 9 aa, unidentified
  source 1..9: note = Description of Unknown:NLS sequence
KKRRKRRRK

SEQ ID NO: 2308 - protein, 9 aa, unidentified
  source 1..9: note = Description of Unknown:NLS sequence
KKRRRRARK

SEQ ID NO: 2309 - protein, 7 aa, Homo sapiens
KKSKRGR

SEQ ID NO: 2310 - protein, 8 aa, Zea mays
KKSRKRGS

SEQ ID NO: 2311 - protein, 17 aa, unidentified
  source 1..17: note = Description of Unknown:NLS sequence
KKSTALSRELGKIMRRR

SEQ ID NO: 2312 - protein, 17 aa, Dictyostelium discoideum
KKSYQDPEIIAHSRPRK

SEQ ID NO: 2313 - protein, 17 aa, unidentified
  source 1..17: note = Description of Unknown:NLS sequence
KKTGKNRKLKSKRVKTR

SEQ ID NO: 2314 - protein, 17 aa, Oryza sativa
KKVSIAGQSGKLWRWKR

SEQ ID NO: 2315 - protein, 20 aa, unidentified
  source 1..20: note = Description of Unknown:NLS sequence
KKYENVVIKRSPRKRGRPRK

SEQ ID NO: 2316 - protein, 6 aa, unidentified
  source 1..6: note = Description of Unknown:NLS sequence
KNKKRK

SEQ ID NO: 2317 - protein, 6 aa, unidentified
  source 1..6: note = Description of Unknown:NLS sequence
KPKKKR

SEQ ID NO: 2318 - protein, 19 aa, Danio rerio
KRAMKDDSHGNSTSPKRRK

SEQ ID NO: 2319 - protein, 17 aa, Homo sapiens
KRANSNLVAAYEKAKKK

SEQ ID NO: 2320 - protein, 22 aa, unidentified
  source 1..22: note = Description of Unknown:NLS sequence
KRASEDTTSGSPPKKSSAGPKR

SEQ ID NO: 2321 - protein, 16 aa, unidentified
  source 1..16: note = Description of Unknown:NLS sequence
KRFKRRWMVRKMKTKK

SEQ ID NO: 2322 - protein, 16 aa, Homo sapiens
KRGLNSSFETSPKKVK

SEQ ID NO: 2323 - protein, 20 aa, unidentified
  source 1..20: note = Description of Unknown:NLS sequence
KRGNSSIGPNDLSKRKQRKK

SEQ ID NO: 2324 - protein, 23 aa, unidentified
  source 1..23: note = Description of Unknown:NLS sequence
KRIHSVSLSQSQIDPSKKVKRAK

SEQ ID NO: 2325 - protein, 15 aa, Homo sapiens
KRKGKLKNKGSKRKK

SEQ ID NO: 2326 - protein, 13 aa, Homo sapiens
KRRRRRRREKRKR

SEQ ID NO: 2327 - protein, 18 aa, Mus musculus
KRSNDRTYSPEEEKQRRA

SEQ ID NO: 2328 - protein, 21 aa, unidentified
  source 1..21: note = Description of Unknown:NLS sequence
KRTVATNGDASGAHRAKKMSK

SEQ ID NO: 2329 - protein, 20 aa, unidentified
  source 1..20: note = Description of Unknown:NLS sequence
KRVYNKGEDEQEHLPKGKKR

SEQ ID NO: 2330 - protein, 18 aa, unidentified
  source 1..18: note = Description of Unknown:NLS sequence
KSGKAPRRRAVSMDNSNK

SEQ ID NO: 2331 - protein, 19 aa, Homo sapiens
KVNFLDMSLDDIIIYKELE

SEQ ID NO: 2332 - protein, 15 aa, Tomato yellow leaf curl China virus
KVQHRIAKKTTRRRR

SEQ ID NO: 2333 - protein, 8 aa, unidentified
  source 1..8: note = Description of Unknown:NLS sequence
LSPSLSPL

SEQ ID NO: 2334 - protein, 30 aa, Homo sapiens; identical to SEQ ID NO: 1581

SEQ ID NO: 2335 - protein, 52 aa, unidentified
  source 1..52: note = Description of Unknown:NLS sequence
MPQNEYIELHRKRYGYRLDYHEKKRKKESREAHERSKKAKKMIGLKAKLYHK

SEQ ID NO: 2336 - protein, 10 aa, unidentified
  source 1..10: note = Description of Unknown:NLS sequence
MVQLRPRASR

SEQ ID NO: 2337 - protein, 24 aa, Caenorhabditis elegans
NNKLLAKRRKGGASPKDDPMDDIK

SEQ ID NO: 2338 - protein, 20 aa, unidentified
  source 1..20: note = Description of Unknown:NLS sequence
NYKRPMDGTYGPPAKRHEGE

SEQ ID NO: 2339 - protein, 19 aa, unidentified
  source 1..19: note = Description of Unknown:NLS sequence
PDTKRAKLDSSETTMVKKK

SEQ ID NO: 2340 - protein, 7 aa, unidentified
  source 1..7: note = Description of Unknown:NLS sequence
PEKRTKI

SEQ ID NO: 2341 - protein, 8 aa, unidentified
  source 1..8: note = Description of Unknown:NLS sequence
PGGRGKKK

SEQ ID NO: 2342 - protein, 18 aa, unidentified
  source 1..18: note = Description of Unknown:NLS sequence
PGKMDKGEHRQERRDRPY

SEQ ID NO: 2343 - protein, 11 aa, Physarum polycephalum
PKKGDKYDKTD

SEQ ID NO: 2344 - protein, 7 aa, unidentified
  source 1..7: note = Description of Unknown:NLS sequence
PKKKSRK

SEQ ID NO: 2345 - protein, 7 aa, Caenorhabditis elegans
PKKNKPE

SEQ ID NO: 2346 - protein, 7 aa, unidentified
  source 1..7: note = Description of Unknown:NLS sequence
PKKRAKV

SEQ ID NO: 2347 - protein, 9 aa, unidentified
  source 1..9: note = Description of Unknown:NLS sequence
PKPKKLKVE

SEQ ID NO: 2348 - protein, 7 aa, unidentified
  source 1..7: note = Description of Unknown:NLS sequence
PKRGRGR

SEQ ID NO: 2349 - protein, 9 aa, Mammalian 1 orthobornavirus
PKRRLVDDA

SEQ ID NO: 2350 - protein, 7 aa, unidentified
  source 1..7: note = Description of Unknown:NLS sequence
PKRRRTY

SEQ ID NO: 2351 - protein, 6 aa, unidentified
  source 1..6: note = Description of Unknown:NLS sequence
PLFKRR

SEQ ID NO: 2352 - protein, 7 aa, unidentified
  source 1..7: note = Description of Unknown:NLS sequence
PLRKAKR

SEQ ID NO: 2353 - protein, 9 aa, unidentified
  source 1..9: note = Description of Unknown:NLS sequence
PPAKRKCIF

SEQ ID NO: 2354 - protein, 8 aa, Homo sapiens
PPARRRRL

SEQ ID NO: 2355 - protein, 8 aa, unidentified
  source 1..8: note = Description of Unknown:NLS sequence
PPKKKRKV

SEQ ID NO: 2356 - protein, 10 aa, Mus musculus
PPNKRMKVKH

SEQ ID NO: 2357 - protein, 13 aa, Mammalian 1 orthobornavirus
PPRIYPQLPSAPT

SEQ ID NO: 2358 - protein, 13 aa, unidentified
  source 1..13: note = Description of Unknown:NLS sequence
PQRSPFPKSSVKR

SEQ ID NO: 2359 - protein, 8 aa, Mammalian 1 orthobornavirus
PRPRKVPR

SEQ ID NO: 2360 - protein, 9 aa, unidentified
  source 1..9: note = Description of Unknown:NLS sequence
PRRRVQRKR

SEQ ID NO: 2361 - protein, 7 aa, unidentified
  source 1..7: note = Description of Unknown:NLS sequence
PRRVRLK

SEQ ID NO: 2362 - protein, 7 aa, unidentified
  source 1..7: note = Description of Unknown:NLS sequence
PSRKRPR

SEQ ID NO: 2363 - protein, 8 aa, unidentified
  source 1..8: note = Description of Unknown:NLS sequence
PSSKKRKV

SEQ ID NO: 2364 - protein, 7 aa, Drosophila melanogaster
PTKKRVK

SEQ ID NO: 2365 - protein, 9 aa, unidentified
  source 1..9: note = Description of Unknown:NLS sequence
QRPGPYDRP

SEQ ID NO: 2366 - protein, 18 aa, unidentified
  source 1..18: note = Description of Unknown:NLS sequence
RGKGGKGLGKGGAKRHRK

SEQ ID NO: 2367 - protein, 24 aa, Zea mays
RKAGKGGGGHKTTKKRSAKDEKVP

SEQ ID NO: 2368 - protein, 9 aa, Xenopus laevis
RKIKLKRAK

SEQ ID NO: 2369 - protein, 9 aa, Xenopus laevis
RKIKRKRAK

SEQ ID NO: 2370 - protein, 17 aa, unidentified
  source 1..17: note = Description of Unknown:NLS sequence
RKKEAPGPREELRSRGR

SEQ ID NO: 2371 - protein, 7 aa, unidentified
  source 1..7: note = Description of Unknown:NLS sequence
RKKRKGK

SEQ ID NO: 2372 - protein, 9 aa, unidentified
  source 1..9: note = Description of Unknown:NLS sequence
RKKRRQRRR

SEQ ID NO: 2373 - protein, 25 aa, Homo sapiens
RKKSIPLSIKNLKRKHKRKKNKITR

SEQ ID NO: 2374 - protein, 20 aa, Homo sapiens
RKLVKPKNTKMKTKLRTNPY

SEQ ID NO: 2375 - protein, 16 aa, unidentified
  source 1..16: note = Description of Unknown:NLS sequence
RKRLILSDKGQLDWKK

SEQ ID NO: 2376 - protein, 7 aa, Homo sapiens
RKRLKSK

SEQ ID NO: 2377 - protein, 9 aa, unidentified
  source 1..9: note = Description of Unknown:NLS sequence
RKRRVRDNM

SEQ ID NO: 2378 - protein, 22 aa, Homo sapiens
RKRSPKDKKEKDLDGAGKRRKT

SEQ ID NO: 2379 - protein, 22 aa, Homo sapiens
RKRTPRVDGQTGENDMNKRRRK

SEQ ID NO: 2380 - protein, 10 aa, unidentified
  source 1..10: note = Description of Unknown:NLS sequence
RLPVRRRRRR

SEQ ID NO: 2381 - protein, 10 aa, Feline immunodeficiency virus
RLRFRKPKSK

SEQ ID NO: 2382 - protein, 6 aa, Homo sapiens
RQQRKR

SEQ ID NO: 2383 - protein, 16 aa, Mus musculus
RRDLNSSFETSPKKVK

SEQ ID NO: 2384 - protein, 8 aa, Arabidopsis thaliana
RRDRAKLR

SEQ ID NO: 2385 - protein, 8 aa, unidentified
  source 1..8: note = Description of Unknown:NLS sequence
RRGDGRRR

SEQ ID NO: 2386 - protein, 11 aa, unidentified
  source 1..11: note = Description of Unknown:NLS sequence
RRGRKRKAEKQ

SEQ ID NO: 2387 - protein, 6 aa, unidentified
  source 1..6: note = Description of Unknown:NLS sequence
RRKKRR

SEQ ID NO: 2388 - protein, 19 aa, Mus musculus
RRKRSKSEDMDSVESKRRR

SEQ ID NO: 2389 - protein, 6 aa, unidentified
  source 1..6: note = Description of Unknown:NLS sequence
RRKRSR

SEQ ID NO: 2390 - protein, 14 aa, Homo sapiens
RRPKGKTLQKRKPK

SEQ ID NO: 2391 - protein, 18 aa, unidentified
  source 1..18: note = Description of Unknown:NLS sequence
RRRGFERFGPDNMGRKRK

SEQ ID NO: 2392 - protein, 15 aa, unidentified
  source 1..15: note = Description of Unknown:NLS sequence
RRRGKNKVAAQNCRK

SEQ ID NO: 2393 - protein, 6 aa, unidentified
  source 1..6: note = Description of Unknown:NLS sequence
RRRKRR

SEQ ID NO: 2394 - protein, 14 aa, unidentified
  source 1..14: note = Description of Unknown:NLS sequence
RRRQKQKGGASRRR

SEQ ID NO: 2395 - protein, 13 aa, unidentified
  source 1..13: note = Description of Unknown:NLS sequence
RRRREGPRARRRR

SEQ ID NO: 2396 - protein, 61 aa, unidentified
  source 1..61: note = Description of Unknown:NLS sequence
RRTIRLKLVYDKCDRSCKIQKKNRNKCQYCRFHKCLSVGMSHNAIRFGRMPRSEKAKLKAE

SEQ ID NO: 2397 - protein, 17 aa, unidentified
  source 1..17: note = Description of Unknown:NLS sequence
RRVPQRKEVSRCRKCRK

SEQ ID NO: 2398 - protein, 32 aa, Human mastadenovirus C
RVGGRRQAVECIEDLLNEPGQPLDLSCKRPRP

SEQ ID NO: 2399 - protein, 9 aa, unidentified
  source 1..9: note = Description of Unknown:NLS sequence
RVVKLRIAP

SEQ ID NO: 2400 - protein, 6 aa, Mus musculus
RVVRRR

SEQ ID NO: 2401 - protein, 12 aa, unidentified
  source 1..12: note = Description of Unknown:NLS sequence
SKRKTKISRKTR

SEQ ID NO: 2402 - protein, 16 aa, Squash leaf curl virus
SYVKTVPNRTRTYIKL

SEQ ID NO: 2403 - protein, 12 aa, unidentified
  source 1..12: note = Description of Unknown:NLS sequence
TGKNEAKKRKIA

SEQ ID NO: 2404 - protein, 30 aa, unidentified
  source 1..30: note = Description of Unknown:NLS sequence
TLSPASSPSSVSCPVIPASTDESPGSALNI

SEQ ID NO: 2405 - protein, 12 aa, unidentified
  source 1..12: note = Description of Unknown:NLS sequence
VSKKQRTGKKIH

SEQ ID NO: 2406 - protein, 9 aa, unidentified
  source 1..9: note = Description of Unknown:NLS sequence
SPKKKRKVE

SEQ ID NO: 2407 - protein, 19 aa, unidentified
  source 1..19: note = Description of Unknown:NLS sequence
KRTADGSEFESPKKKRKVE

SEQ ID NO: 2408 - protein, 9 aa, unidentified
  source 1..9: note = Description of Unknown:NLS sequence
PAAKRVKLD

SEQ ID NO: 2409 - protein, 7 aa, unidentified
  source 1..7: note = Description of Unknown:NLS sequence
PKKKRKV

SEQ ID NO: 2410 - protein, 30 aa, unidentified; identical to SEQ ID NO: 1581
  source 1..30: note = Description of Unknown:NLS sequence

SEQ ID NO: 2411 - protein, 11 aa, unidentified
  source 1..11: note = Description of Unknown:NLS sequence
SPKKKRKVEAS

SEQ ID NO: 2412 - protein, 16 aa, unidentified
  source 1..16: note = Description of Unknown:NLS sequence
MAPKKKRKVGIHRGVP

SEQ ID NO: 2413 - RNA, 21 nt, Homo sapiens
  source 1..21: mol_type = unassigned RNA
cataaagtagaaagcactact

SEQ ID NO: 2414 - RNA, 23 nt, Homo sapiens
  source 1..23: mol_type = unassigned RNA
tgtagtgtttcctactttatgga

SEQ ID NO: 2415 - RNA, 24 nt, Homo sapiens
  source 1..24: mol_type = unassigned RNA
tttggcaatggtagaactcacact

SEQ ID NO: 2416 - RNA, 21 nt, Homo sapiens
  source 1..21: mol_type = unassigned RNA
tggttctagacttgccaacta

SEQ ID NO: 2417 - RNA, 22 nt, Homo sapiens
  source 1..22: mol_type = unassigned RNA
tatggcactggtagaattcact

SEQ ID NO: 2418 - RNA, 22 nt, Homo sapiens
  source 1..22: mol_type = unassigned RNA
gtgaattaccgaagggccataa

SEQ ID NO: 2419 - RNA, 22 nt, Homo sapiens
  source 1..22: mol_type = unassigned RNA
tggagtgtgacaatggtgtttg

SEQ ID NO: 2420 - RNA, 22 nt, Homo sapiens
  source 1..22: mol_type = unassigned RNA
aacgccattatcacactaaata

SEQ ID NO: 2421 - DNA, 114 bp, Acropora digitifera
  source 1..114: mol_type = unassigned DNA
tttcatctctcccaccgacgcagcaccacagtttctttagaaactagaaattcatttactacttaaccgctgcgacctcattcattcctcgctaccgcgacgctgaaactcacg

SEQ ID NO: 2422 - DNA, 372 bp, Acropora digitifera
  source 1..372: mol_type = unassigned DNA
  misc_difference 86: note = a, c, t, g, unknown or other
gcctcttcgcttgaatctctgctggcccacagacgtgcaaaaaaagccgctcgttcccgcggtattattaaccacaatctcaccgncgataacctcaatcaacacatcaataacactaatgccagtactaatgacatactatctaatgttacacataacgcctctacctcaactgtcacacgcaaacgctctcgccgcgaaaccaaacatgccaacattcatttggatcattcttctgttatcaacctatccagttgctctttatctaccgacgagatatctatcctttcacgtggactcactttctgccctactccacgacatatcaactggccggaagtttcagccgacatttacgacttttctcggcgc

SEQ ID NO: 2423 - DNA, 3199 bp, Aedes aegypti
  source 1..3199: mol_type = unassigned DNA
cagttgacagccgaccgccgtcgcgtacagtcgcctttcgcattgttccgtactgttaatatcaattaacagcgcatcagccaactcgatcgttgtctgacggggtgctccacagcggggcgagtgtgcattgttttattccggatcagtgcagcacccagtggtgtggtgagaagtgaggttaaatagactcggtagcgtggttcgagtactgtataktattatttcgggcgcgagtgtatgtgttagtaacttgtgagtggtataaataaaattatcttcaaattaaaaagcggttcagtggttttcaactgtagtgtgactgaccaaccaaaacaggtgagtcttccacgagtgcctccttccggcccgccggcgccatgctggcgaacggccatcccctccacccaggggacccagggggccccggaggaggatttggcaaagtaggcaacagagttctcggcgactacaccggtgcattgctaccggagtttatggaccgtgaaggtactgcaggacaactgcagtatctaagaatggaagcgactgctggaaccatgccccaggatccgtttcttcttcggctatccgtcgaaaaggccattggaggtcccattttcggggccttcaaggaaaataaaggcatgtcctacgtgttgaaggtgcgcagtcaagaccaggtmaataagctcctccgcatgagccaactgcaagataamaccccaatccggatcgctgagcacccgcggctmaatcaaagggaatgtgtggtgaccaaccatgacacaatcggactatcggatgactacctgcttcaacagctctcctcccagggaatcaagggmstgcgaaggatcacgcgacgcggaccggcatggccaaagccgtggtaaacaccgccaccatcgtactcaccatcaagggcaccgttattccggagcatgtcgttttcggttggtcacggtgcaagacgacgtcttttctacccatctcccatgctatgcttccgctgctgggagtatgggcataccggtaagcgttgcacaagcccccagcagcatctgcggacgctgctgcgaggtacacccggaagaacaaacccccgatcctacaaacacccaggaaggagccgccagtgcccacgttgcgtcgaaaacgcggtaccagtgcaccgcagagccgttgctgcaagaccagtgcaaaacaggagacagcactcagtctcaagccgcaagtgtccggtgtacwwgaaggaacaggccatacaacaccttcgcgtcgacgtggacattccgtatccgcaggctcgacgtgaatacgaagcccaacaagcgagcaagtcgaagtggtgccaacttctgccggtgtggtcagtgccagcaaggacgctgaaatcgacagtctgaaggccatggtggctgcaaaactccgcggacggagaagaaaagaggatggctgaaatggaacgggctctgcagagccgcaccgtcagcgaccgcctcgaggcggttaaagaacacggcaccatcggagagctggtcaagcaagtggcaaccctaactgaaacggttcagaacctccaaaatgctctagcagtaaggacaaacaaatcccggatcaaagtcgcaccatcgctgagcttctaggcaggcaatcagctgccgtccaacgacaaacccgcgacaagctttggcttaccgcgcaagasgatcaaacgcaaaccgccccaagtcgccagaggttcccgtcatgaaaccgcccagtctgaaccccaaagtggacgtacaggtgtccaaatggatttcaaatataacaccggacctcaagaaactctcacaggcgatgaaaccaacgatggaaatgcgtctgatcatagcatgatgtcagccacatccgaagccactggaatctccaacacgtctcacgtttcgaaccctacgaaaagaatgcactcaacctcggatcacagttgcccatccggcgattcaaatgcctcatccaccaactcgaagcggaaaaacaagcaccgcaaaagaggtggtagaaccaaacagtaaaacagtaatttacgctcagtcctcttcaagcacatggtctaaacaattcgacaatattttcttcccgtcatcttcactccgcaaattagcgttgagacagtcaaatcacaagagtcgactgagcaaataccgatgaacacactacagcctccgaacgaagtactcacggacaactcagcgacaacaggggtcacggacagccggggccccgtcagtgcggacgctacaccccaaccggaactggcggacaacccccggcatccgggcgtaactgttgttatcgggacgcaaaagggacacagtgcctatcccccgaaagtcccaactagctgtatgggtacgccagggccccgtcggtgcggaagttttggaagaaccggaaccggcggacaacctctggcgcccatatacggtctggaagagggacgcaaaagggatcaacatcctattcccctkaggacagcgtgggaagcaagccacaggaaaccttttttctgcccctgccaacacacagagggtgaaggtcgggacgcccaataccccgaaggacaacgagggaagcaagcctccgtcgagtcgaaacccccccggaasagaaaaccgccggaccactacacctccaactggcacaaccaccccggtcagcgacaagctgaatcccccgacttcccgggcagccttgggacccggaagcaagcgacgccaggttgtatgacctgttacacaacgctcgttacaatcgctcagcccgccgacttcagcccgggtattccggaaccgtttccagacttcaactccaaacgcggaagcatacgaaaaccgatcgccatccgcgataatkatagctcaacccgctgctggcccctcaagccaaacagcctccccagatccctatcaggatcgccctgggcacctcggactcaacaatccgagcggtaaggccgaccctttcccgctgggcctccacccggtgaatcttcgtccgccacaacaacctatgtcaacccatttttcgacgcggctcccagtcttcttcgctctcaaactcacagcagcactccttgataaggtttcctagcagccctgttggaaacgactgtcttgccgcagctcccgaagttccggcagtagtaggtccc

SEQ ID NO: 2424 - DNA, 482 bp, Aedes aegypti
  source 1..482: mol_type = unassigned DNA
gggctgcaaaatggtgagtcgacggagtcctcacaagttcctacctcatgcttccacgggtcgacggatgacaaatgaccgccagctaagagttgcgtgcttagctggtagtgcagcctgggtcctgtagtccttctgacttcagctagattgaggaggtacgtccaccgagcgtctgttcaccaaggaggtgcggctcaaacagcgtctgtctggcatccagcggctgaataagaaatgctcttccccggaagctacacctaagatggcagccccatcacggcggatagggaaccttaggctaacaacctactgtccccgaaacatcaaaaaatgttcaagaaaccgatagagaaagattacgaactgatttaacggcaacgacttttagcgcgaaacaacggacacgaattggaacatggaacgtactaaccctagcccagcagggtaaactggcacaactcgccaacgaggcgtgtcgc

SEQ ID NO: 2425 - DNA, 332 bp, Aedes aegypti
  source 1..332: mol_type = unassigned DNA
agttagggatttgtataattattattatcccccttttcaatttttgaccaagacatgacaggtatactcctgtcgaaattttttcctaggtagtttgattgtgtaggtacttatctggtgttagtatttaaggtagagagatgcgacgatttcttcagtggatacgagtaactgacactgaagaagactgcaagtggtagtcgaaatacgcgtatctgtcaaagataagcatttaggagcggaattaaaaggtacacggtactccatctactttaaagtttctctatttgagattctgctcagaggattcgaacattcattaaagagttgta

SEQ ID NO: 2426 - DNA, 467 bp, Aedes aegypti
  source 1..467: mol_type = unassigned DNA
atgaactgttccactcctaaaagttatattgggaagctactgtttccccttctgctgctgttgttgctgtgtgctgttgatgctactgctgttgctgctgggaggcgttgctgtcgaataagatttttctgctgctctcgattgtggtgaattagatcaaattagactttttcgttttcggcatattagcagacattatttagctgttttttctttgtaatgtgcttttctctaatgtcaaatgaacttcagactaaaagttaatcacaatgaacatattagtagttagtagttttgcttttcctgatttctacactgcatgttgcttgggttcgatgggtagactgcttttgaagcctatactgttcaacatttagatatggatgacttttcccttgataatgcttctccgaacaatgtaattccacgtgttgttcttaatgctgcattaaaacatgactgtttga

SEQ ID NO: 2427 - DNA, 103 bp, Aedes aegypti
  source 1..103: mol_type = unassigned DNA
ctcccagcctgcacttccaggcaagtatgcgtgttataccagacgttctttscgtgatgaattgccaaatttcagctctctatccgccgctgatgtaacatca

SEQ ID NO: 2428 - DNA, 1656 bp, Aedes aegypti
  source 1..1656: mol_type = unassigned DNA
  misc_difference 321: note = a, c, t, g, unknown or other
aattctggcaccactgcgtgttttcgtttgtgttgtttataacgtcgccctaaaatcctgtgaatattcgtgcaatcaactctataaatcagggtttattgctaaactgcctcgttccgcttctgttagccgcaagcatcaggttttcgcatcacttttggcaaggtaggacagtgatttgtgatctaaatccgagcaggctagagagtggaagcatccgccatcgcccgataacatatttcccacctcgccgctctccaccttccaaccgatcgaaagctgcaacaagatcaaaaatcaacccgcccccatttgccccancgccccaccaacgccctactaytgtttgctgcaccgaacgaaatcaaaacaagaaatcgtcctgtaatactccgcttcatattggaaataaactacttacgctgcctcgtctttcattccaacgctccgaaagggaccaacgaacgatcatcatacagcctcaatcgccgtccaaagccaacccgttgctaccaaggattaatcgccaaactctgcatccgtagtatcatccattcacgtaaggaaattctgttttggttctgcactttgtttatgtattgaactgtgaagctcaccgttgacaagccaccgtttgtgacagagaacacacgcgcagctcgtggtcattccgagaatcaatagttcacagtatatcaccccttcgtaactgggagcttgtttctcgcagctaaaatgcagggtgtttgtgaaaaatgcgcttccgaactatccgctgatttttggagctgtggtggattttgttctggtcgcttttgcttcaggtgtaccggaatgagtcctgatatccaagctgccgttgcgaataacgggtgccttcactggatgtgtaacgcctgtagcggaataatgattaaagctcgctttactaaggcaatcacatcagtgaatgctgcctatgaaggcataatcgaatcaatgaaaatccgaaattcgagacaacattttgtccgaaatccgctcggaattgcagaataaccttaaacgaattccggagattgttgcaaacacaccgattcgaaatattcaacgtcgcacatttgattcggctgtccgtaatcctgcaaaacgtcttcgtgcaaatgatgatgtgcctctcgacccgcctaaaaaactggtctgtggcactgatggccacagtactagttcttcagacgtcatcgcagttcctgaacgaacggatgaaaacacgttttggctttacttatcaggagtgtccccgaaagcgcctgatgagaaggttatcgaaatggtcaagaataggctcgmaacagacgacttaactgtcgttaaacttgttcctcgtggaaaggatacaaacaatctcacgtttgtatccttcaaaataggaatgaagcttgatcttagggcaaaagcaatgacttcatcaacctggccagttggaattcgttttcgcgaattcgagaaccacagttcctcaagggcggggttctggaatccctcggagaaccagcccgaaccacagatcgtaacagtattgaactagtatccccatcgtgtcccatagatcttcattctcctcgtgatgagaccgttttaagccatttgacaatctactaccaaaacgtgcggggt

SEQ ID NO: 2429 - DNA, 82 bp, Alligator mississippiensis
  source 1..82: mol_type = unassigned DNA
tcagaacaagacacatgctcgggtgggatgggcttcacctctcccccaaaggtaagcatgtgttctctttcaggttggctga

SEQ ID NO: 2430 - DNA, 200 bp, unidentified
  source 1..200: mol_type = unassigned DNA; note = Description of Unknown:Amborella trichopoda sequence
taattagtgcttatgcaccacaagtaggattagatgatagaattaagagacaattttgggaggacatagatggaatagtccaagacataccaaatggagagaggacctttttaggaggggacttaaatggtcatgtagggaaggatagtagaggatatgaaggggtacatgggggatatgggtttggggaaagaaatgag

SEQ ID NO: 2431 - DNA, 399 bp, Anguilla japonica
  source 1..399: mol_type = unassigned DNA
cagtgtgcatctgattgtgtcgtcgcttctgccgtcccccgcgattcagataagcgtatcttaacttgatttgtctctgctgttgctagttagagaacatagttgtgcgtaatttagataatcttttttaaacgtgtctttactgttgctagtcagcgaacttagttgtgcgttagctgagaatctctgtagttgactcactgttgttagttagttaaacgcgttagtgaaactgtgtgtgggggttggtgtttaactgcccggtattgttgagctaatttcaagtagcttcacctggtgcttatctgccttaatgaaggtgatgcaagcacgtaattgtcacccggtatttatagctccagcggaggctgccataggcagcctcgtcgtcagtttgtg

SEQ ID NO: 2432 - DNA, 108 bp, Anolis carolinensis
  source 1..108: mol_type = unassigned DNA
atgmtgttgagagctgtgctggcggtagtgtaaactaccagcaggttcaaccaagccagagtggtctcaactgagaagtagaactaagtgcacccaacccatttaaat

SEQ ID NO: 2433 - DNA, 165 bp, Anolis carolinensis
  source 1..165: mol_type = unassigned DNA
atgcattacagaaacctggatacgagaaggagataatattcccttgcatgaactaacaccgtcaggtttccagatgtttcaaagatctcgaaaggggggtcgaggggggtgggaatagtggctcgcgatcatttctccattagaactattcctacccctgatatt

SEQ ID NO: 2434 - DNA, 159 bp, Anolis carolinensis
  source 1..159: mol_type = unassigned DNA
gggggacatgagagaagcctccacgcaggatcgtgacacatccgggcgtcccctgggcaacgtctttgtagacggcagattctctcacaaccagaagcgacgtgcaacttgcaacatgcaagcaaacaaaccaaccaacggaccttttcaggaccaact

SEQ ID NO: 2435 - DNA, 229 bp, Anopheles gambiae
  source 1..229: mol_type = unassigned DNA
ttgacagttgacagctgacgacwgagtgtgttttctcactgtgctccgcgtaaatccgtgaattattttgtcgtttcggcctwattttcgtcaaactgccgcttagctgtgacttaagctgtccctggtagtcctgccttcaatcgttcgtcacaaccattcctgactttgctgtatttcctgcgtttgttcctgagtcctgtggcatctatctgcaacggcaactaaa

SEQ ID NO: 2436 - DNA, 128 bp, Anopheles gambiae
  source 1..128: mol_type = unassigned DNA
tatatatcttcaatcgaaaggcatccccgaaaattttggcgcttcatggacagcagacgacgctccaagcacaatcatgggcacgtcacccgaagatatttgcaacattttcgctgaacgattttccg

SEQ ID NO: 2437 - DNA, 243 bp, Aplysia californica
  source 1..243: mol_type = unassigned DNA
ttagccgtgcagtctcggcattgagaagaataggactgacgtggtgctagcgtgtcgtacgaggcgactaaatggcgaaccaggtagtgactcctgaaacagagtcatcctgcctccaggtcgggggttgagtcacgaggctaacaacctctctcgtaaaaagaacctgttacagaaacacatacaagcaaaaaccattatctctgcttggctgatcgtggatcttctccaaatggagagttt

SEQ ID NO: 2438 - DNA, 662 bp, Aplysia californica
  source 1..662: mol_type = unassigned DNA
aattgaacaaattatggaggaactgggagtgactcgcaaaccctttgatatcaggagattatttggtaggaacagaacagaggatagcagagacagcggtaatgaccggggaagcgagaaaaggccaagacctacactactgaaatttgaaactgaagaagcaagtgctaatacgatgaggaaatttattgaggcaagaaaagacgcagcaaaggacaaaaatgaaggagaagaggacaagttatacttgactattgggatgcgaagagatatkacaaagcaggagagagaggaggactatgccctctaccaggagttgaaggctaagaaagagaggtaaaaaaacttgggggacaatttcgctcactgggtgaggagagacggcaaaattcggaacattgggaaatacccaacggaacgtcagaaagagagggagacaatacaagaataaagccaaagacagcaaagaatgtaaatagttttggccattgttcgcctttttcatattttaattattgctcatctcgttcctgacgtwcagaatagaagtttcacttcattttcttctttttcacctacatttcattccaatcggaatgcacatactttagagaattgtacttgcttgtatacaaatgcagatcaattgttgaacaaaagaa

SEQ ID NO: 2439 - DNA, 433 bp, Aplysia californica
  source 1..433: mol_type = unassigned DNA
  misc_difference 233: note = a, c, t, g, unknown or other
tcaagcgacaatccgtgaggctaacgctgacacacaggcggagacacaggcagagacacacaccctgcgtgccgtaaggcaaacaaatatggactcttttttcccgcagcctgaccgctcccgccccccagtacgctcaccccgaagccaggacacaaggtctccaagtgtcaagacgaggagacataaaagacaggtgagcgacgagccagctcggtcaccgagcgtgaaanctcgaaaacaggaggtgagtggcacgagaagaaggcaagacacggtagattattttgattatgaggagccagtgactaccgaaacgtgtgagcacgaagaggtcggtgcgtgagtggtgtgtacacgtttcggtagccattggtaacgacttggactggtaaaaggactttgagtttggttttgcgtctgactgttttgg

SEQ ID NO: 2440 - DNA, 341 bp, Aplysia californica
  source 1..341: mol_type = unassigned DNA
  misc_difference 257: note = a, c, t, g, unknown or other
  misc_difference 274: note = a, c, t, g, unknown or other
gtagagaggaagagcccgaaacagcgacgcattctctcctgatgatctccatgctagagtccgggatacggagcgttcggcggtgagcagtgcatacggctgtttagactacgtacctaccagtagcaggtgtatgctacggacatcctggaaagacagcacgacaacccggagtgacgggtggacatcgggaaagaccgaggacgtcgggaaagaccgacggtggcaggggctaactacccaggtcactgcaaatntaagttacgtcaaccantagaaaagacagccccgggatcccccgagaggggggagtagaggatggatccacaaggacggattca

SEQ ID NO: 2441 - DNA, 776 bp, Aplysia californica
  source 1..776: mol_type = unassigned DNA
ccccccccaaatagacccacctcttcgtggtggggggggggattagtactcttcgaataggaaaagaaaaagaggaagctaacgggtcaaggggtgaccccgaaaagagacatattactttactatgtttcttactctttctatttattgtttttattgttttactttattacatttattaacttttcttttctcctctctccatcgacaacctttctttgacctggagttgggacgggtattggtggggtggaaagcagaggttcattgtcagcactgtactggatgtgactttacgtagggaatacccagctacatacatgtattaagcatgcacttatcggagagccctatgactgcggagaaggtgcagagaccatttgcgtcttgcttgttgacaacattaaccctctgggatctgccatgccttcccctgcccccatctctcggatgagaggacttggttgctctgggagggggggggggggaatctagcttccaattggtattattattactattagtattattattattatattataatttttgtatttcagcaacacacagcaactatgctcttaatagcgtctttctcttctttatctcctcaaacaacttctcaatataatacaacagacaccaacatacccattcatttttcttacaatctctctgtgatggagttgggtttttgtttgtggcattgcacctacagccactgctttatctcctaccccgggatggaaggaaaatcacagaaccaccagttttag

SEQ ID NO: 2442 - DNA, 346 bp, Aplysia californica
  source 1..346: mol_type = unassigned DNA
gtaaagctggggcgaccatccccgacccaccgcgtccacaggtggcggatagtggaacggcctacattatgtagggtagctgcgaataaccaataagcagtcgcggaccaactggcgacagtcttggagagcgaggtgggacagggtggtggcaaccctgtctctataaaatacctcatgtgctcagtaaagagactgtcaggcgagagggaggcgccgaaacctgccacctgcccccactgccttgtgggttagtccttttggacaaaggctagcggagtaaaccgtacaaaaatccagcagaaggcaaggggaaaccactgctgtattctttccctagaacatt

SEQ ID NO: 2443 - DNA, 873 bp, Aplysia californica
  source 1..873: mol_type = unassigned DNA
  misc_difference 170: note = a, c, t, g, unknown or other
gggctgtaagggttgagggtgaaaccccagacgctctctggcaagccagcctcaaccaagtcaactccccgtccttgtcgagcagcctggggacccctgctctgtgcataggagcaggggttgcagacggagctctggccaggaggtaccatagccctgtgaggtgcgangtgagcaacgacccttcggctcgtagaagggtccgtacacatccaccattatggtaggtctggcgtcacagcaggccgacctgttcattcaggaactcactgtcgacatcttcttccctccctctcgtgggagctctacagacggggcatggtacccacagactgccagatgactcatcgtgagatgtctccgcggacccagaaggccttgtagctgtaaggaataggctgcctggaaacagatgacgtccctacagatatcctggcaaatgctcgctgacccatgacgtgacgatcctctgtctgagtagatttggccacccctcggattattctgccccatgaacggaaatgttaatagcagatagccaggagacagcaggtggcggggattgggcaaacgcaagctacgcttggtgatgtagacgactcactgtggaaggaacgcgttaccccttactcaatgggaccccttactggactgctcagacgatcacttgtcattggttgcactttgtggctcccatctctcagaactagagtgtgcctacaccccctatggttgtctactgtctaagaaatccccgtgaaggttgatggaaaacaggacagcgaacattgcacctttgttctcttgtggcaagatgtttgggcacaagccagtgtcaggacaagactaccacctacctgagatcctacaggg

SEQ ID NO: 2444 - DNA, 243 bp, Aplysia californica
  source 1..243: mol_type = unassigned DNA
ctcccctgctggtggggggccccgtagttttactatgggggagcaaagaatacacctgccgtgatactgcgtgtcgtaagaggcgactaaaagtgcataggtctggtcgcccgaaaagtgccagtttgcggagggccaactacccaacccagtaaaaaacagtaagttacagaaacacggacaaacacagctttttatttttcgatcttgggagacggaggagcttctgcatcagcaggaaca

SEQ ID NO: 2445 - DNA, 513 bp, Aplysia californica
  source 1..513: mol_type = unassigned DNA
gtcaggtcagccttagtgctgctaccataatgacagtagatggtactacctgcagctgttcctactgccttgtaggtgcatacgggagtatgaaaggttaagggagtaaaccctaaacaaatccggagggagggcccctaaggcagtcgacagggaggaacgatccgaactatcttctggcagcccctgcaactttactggttccaaatgtattgacctcgtctctcctttggactaaatcagctaagtcgagagggggttcgtgcaaattgggcaaggcacgttctccatatagtcaggcccaggcatttagcttagtcaagatttcaagatttctgggaggacgctgcaaaagagcaaatacagcggatcagacccacagctcaaccacagctacaacagcatttatatgattatggagaggacacttcatccttgttgtgacgagcaagggaaaaaacacgggaggtggcagtttacgggttataagacatccttatttggcgaaacagg

SEQ ID NO: 2446 - DNA, 109 bp, Aplysia californica
  source 1..109: mol_type = unassigned DNA
ggtgtatgcaccgtgcaacgactcctactcagacgaagaaaaggactctttcttcgaacaactctcggacttaattagcaacatcccagacgaggaagacctttatgta

SEQ ID NO: 2447 - DNA, 1958 bp, unidentified
  source 1..1958: mol_type = unassigned DNA; note = Description of Unknown:Blumeria graminis sequence
acatccacattccgaaaagtcgaccccatagatttttatccataaagttgacagcaaatcgtaatcgtgatgacgagtattcctacgagaggaattaatggtggaacgccttgcgcgggctctagaggtggtagcgtcgcgtcaaaggcgccacaagacacagacgcgtccctgaaaagattcaaggacgcaactaaaggcgaagagctctccagtagagcgtacaggagaatgattgaagaggccattcaggttatcgaaggccttcagaaagcgaaagtcaccccccccatccccgcccagacaggccatagtgatgataattctgcaatggctaagatcctacaggagataaaggacatcaaagcctccatagcccaaaatagcccaccaatgcaagccccaggccgctcctgggcaaaagtcgcaagcaagggagagtcgtacggaactactatccgaatacaggatgaacaggaaaagagagaatagccaagctctcgagcgaagagttagtcaaaaaaatcggagtacagcaaatagtaggtgctagacaaatgacaaatggtcaagtgaaggtctacttcgccggtgaaggaacgaaagaattatggagcgtcacaaggactggacaacgaagctggctgcttctgcgaaagttgccggccctgtttaccaagttctagtgcatgacatgccgctctcctttgagccacaaaatgcagaacatctgaagctgctacaaaaagccaaccatgttatatacaaggcatggtaatmcaaagagccgcatggcttaagaaatctcagcagccagggaaaaagtctggatcttaatcctgtggattgatcaggccgtacacgcagatatggcgataaaaaagggcttgatgtggcaatatgagctcaagtcaacagaaatattcaggagtggcttccgcatgatgcaatgcttcaattgccaaaagtacggacatattgcgaaaatctgctccgcagactcgaagtgtggccactgtgcaggagagcacaacactcgaaactgtacaggaaaacaagacgtcagatgcagcaactgtggaaaaggccacaaaacatgggaccagagctgtccagttagggcagctgcaaaaaatagggctgtccaaaacaggacccaagacccaggaatgttcttgaccgacgaaaaatcgacaagaaatcaagatggcgaatggcagattgcaggaagcaggaaaagaagagcagtaatgactgcaccacttgttggggccgatggtagtatagatggtcgtaggcgtccaggcagaccaccaaagatcccatcagctgtccccacagtcgcagggctcttcgcaaatctcagcgaggtgccatcaaaaatgacaccccggcctgtgacacggggaaatcaagcagatgagactgagagcgaaatggattcatgaaggacaaatcaatcctttcaatcatacagtacaacgtcaacaggagtaagaataaagtgcagcacgatttcctccaagctttgaatccactgaagcaccacatagtggccctgcaagaaccatggcgtcaccccacmgaacaacacgaccgtcacccaccctgcctaccacctggtcttcccaagtggccacaaaggcaggacatgcatctatatcagcaaaagtctggctattagcaaatggagaagagaaagagtgccagaggaatcgcaaggagacatcacatckgtcagcctcgataccgaccttggtaaaatttggatacatagcgtgtacaatccacccccattacaccacagcagcctagaagaaggaacactcaagtggctcccgcaaatcctatctcaagagggggaacacattctagtcggagactttaatgtgcaccatccgcattgggggggacagtcagtacttaggcaccataagatcgcagacagcttcatcgaa

SEQ ID NO: 2448 - DNA, 186 bp, Caenorhabditis elegans
  source 1..186: mol_type = unassigned DNA
ctctttctgtactaagccttttcgtggcgaaagggatcaacagataaccacttcaacaaactcgatgatttcgtcacatcgagagtggcttggtttggaaccaagtgcaaattatctggccaagaagtacaccgtctcacgcaggccagaggtagtgtcgaatactctctgtccgggcggctctag

SEQ ID NO: 2449 - DNA, 401 bp, Caenorhabditis elegans
  source 1..401: mol_type = unassigned DNA
agtgacgggtctcagtaatcaatactctgtcttccgtacggatcgtgctaaaggtaaacgaggtggaggtgtttgtaatgtggtaaaagtagaaatcccatgtgaaacagtagtttcagttgaaaacgcttaacgcttatgaaattctcgtaaatgacctgaacattgacgtagttccctttagaatcataaacatatatcgtgctccttcttgcacttatcaaaatactgttagattaattagtaaaattgaagaccttgtggaacatcaaggcaaagttgtagttgtgggagatcttaatattggaggtatcgactggggcctcaacgactctaaaactaaattaggttctttattagtagatctgtgcaaaaactataatctggaacaatatgtcaaa

SEQ ID NO: 2450 - DNA, 277 bp, Caenorhabditis sp.
  source 1..277: mol_type = unassigned DNA
tgcttgctggatacctcctcgcggtgcaaactgggcaatgctgtgctcctacgacaggggaaattggacaccactgttaggcacagtagccaaaatccactctttgccacggtagtgtccgatactcgtgaagaaggggcttcacgccggcctagtaagcctgctgaagtacaaacctaaacttactaaaaagctgaatcaaaagaatgtaaaggacccgtccaggaattcaccagctcggccacggtgctcgccgagttgtcttggtcggaagaaa

SEQ ID NO: 2451 - DNA, 79 bp, Caenorhabditis sp.
  source 1..79: mol_type = unassigned DNA
ggcggtcggcctatttttctccgaccgtccatgtcgcgtgaagaattggtgcaataccacgacaaccgccgcaagaact

SEQ ID NO: 2452 - DNA, 47 bp, Caenorhabditis sp.
  source 1..47: mol_type = unassigned DNA
tgcctctcagactttagaacttttcaaatcccttaccgcacttctag

SEQ ID NO: 2453 - DNA, 265 bp, Caenorhabditis sp.
  source 1..265: mol_type = unassigned DNA
cactaaaataaaggacctgaacgtgtacattaaaacgaaacaaacacacacttgcacgaaatgcgaccaagtcactaaccgccaccgccacaccwctagcaagaccaaagaccagcaawgggacgwgcagactcaggccaatcccaccacgwcgcgctcaatacacaatcaaacgtgtgaagattctgacatggaacgtaaatggctgggccagaagaaacagtgwgctcggtgctatcattagcaaggagaagccggacgttkt

SEQ ID NO: 2454 - DNA, 500 bp, Caenorhabditis sp.
  source 1..500: mol_type = unassigned DNA
cttctacacgtaatgagcctctccgtggcgtagaagatcaacacctggatcttttcttcaactccggcggatttcgtcaccccggcaaagattcaagtggctaatcattacacactgcctcgctcaggtcggatgtagtgtcgaatacttcctccctgcgcacattcctcggtttagcaggccgttgaagagtaggcatacccgctacgaacagcaccaacaactgcctcagtcctccgcatccggcctctactcttgttacggcagattcaagagtatgtcggaagaggcgatctaatcacggagtatcgaacgtctgccacactggacggaacaagaacacccggccaaaaacaagaagaatcgactacagagtgtgtacgttcaactgcagatcggttgccaccgatgaccgacttgcagagctgctagaggagacaaaaacgatcaagtacgacattatcggactgtcggaaacgaagagagcagctgaaacacac

SEQ ID NO: 2455 - DNA, 797 bp, Calypte anna
  source 1..797: mol_type = unassigned DNA
ccctccacgggcacccccttgtcgtgggggaggagcttgcgtgcccttgtgaggttgggagctctgctggcggtggcatatgcctccagtagggtctcccatgccagacaggtcacaactgaagggtcagacaaagtgtgtccatgggcaggatgggctcagtagccttcaggcaaccatcctaggagaaggacaactctaactccaaacccgggcagatggagctcgtttagccctgtaaggccatccatctaagagaaggatactctaactaaacctacgtcctgaggacttcgctgtcactgtccaagcttgctgggccctggcagatgaaccttaggagtaaagggtggggccagttccgtgcacgctgcgcctcacctaaaaaagccacagcgcaggctcgaagggtgaacccacacttgtaaagcccctgcagcgacaggcgagggwcgaaacggcaggggaaaggtgcactggaagccgcagacccaaccctgcatgcaggcggctcaggacattggtcgctcgagactgacccaggagatgacagtcttgttcggcagcatcctgagtgaccaagcagcctttttcaaggagagcactgcttgctccacatggagaggggcctagaaaaggtggcctaaccaaagctcatctccaccccccacccggttggctasccacggtcaacgggcatcttctgatgcagtcgaacaaagacaaagagacaaaggcatacacctgcctctaaaggtgtgttcagattgacactcgcatgttggaacatcagaacc

SEQ ID NO: 2456 - DNA, 36 bp, Capitella sp.
  source 1..36: mol_type = unassigned DNA
cacgcggcggtgcaaccgcaccagcgaaagacgacg

SEQ ID NO: 2457 - DNA, 687 bp, Capitella sp.
  source 1..687: mol_type = unassigned DNA
  misc_difference 173: note = a, c, t, g, unknown or other
gaacaggagaaagatgccatgagaaagagaaatgtcatcatacacggactgccagaaaagaagaccaacaacagagaggagagaaagaaagaagatgagcaacacaatcgagaggattatggacgcattggaactgaacctagaaattgaaaacttctaccgactgggaaaantacccaatgaagacgccgacagggaacatactactagcagacccctgaagttgtgcttcaatagtgaagacaaggtgaagatgttcatggggaggctgaacaaattaagagatgcagaggaagatatcaaacgaattagagttcaacacgacatgaatttacaagaaagagcagagattagagaactggtacaggaagcaaaaaacttaacattaacagagagtggagactttgtacacgtcgtgagaggaaaaaagataatcagagtgaaagccagaaagaacggtcagagcaggagagagacccaagaggactcaacatctggatcacgaacatagacacccttacaatagcaaaatttaacgaattaaaaaccataataaaggaatcgccaccggatatcatagccctacaagaagttaaaccgaaaaacgcacgtacaaactgggaggcaaagaattatataataccaggatacaatatagaagaaaggataagagaagatggaagagga

SEQ ID NO: 2458 - DNA, 171 bp, Capitella sp.
  source 1..171: mol_type = unassigned DNA
gcggcggagattaaatagatatggtgtcttagatcccgatgccattgatccttctcttgaggaggacatggccgtggatgtgcctccttccacttccctgacgagcccagggaagatgcaatccacaaaggagggacccagccctgaaaagggcccctcctaatagacaag

SEQ ID NO: 2459 - DNA, 103 bp, Capitella sp.
  source 1..103: mol_type = unassigned DNA
agatcaggtagcaccctccggtagcacctaaaatttgctccgaccattttgctgttttccgatatcttccactccgcggattgcagcgaatcttggtcaagac

SEQ ID NO: 2460 - DNA, 383 bp, Capitella sp.
  source 1..383: mol_type = unassigned DNA
ggtgtacaaacttcgtcatcaaacacacttcgtgcacagctgatgttgagatcctatgtgtgcagtgtcgaccattttatctaccgcgtgagatcagctgtgtcgtcttcatcgtgatctacatccctcccagtggcgatgccaacagagccacggaagcgatagcgtctgttgctttggacatacaacaaacaaagccagaggcagctatcgtcatcacaggagactttaatggagcttcgttacatgacgccctcccgacctacgtacaatacgtaaatttcaacacaagaggtcgcagctgtctcgatctactgtacagcaacataaaagatgcctacaagaccacaagcctgccacccatcggcagatctgaccacacg

SEQ ID NO: 2461 - DNA, 66 bp, Capitella sp.
  source 1..66: mol_type = unassigned DNA
gacttcaattttcaacaacatgtgactgatgcaacacatgtcaatggtcacacaatcgacctaatc

SEQ ID NO: 2462 - DNA, 278 bp, Capitella sp.
  source 1..278: mol_type = unassigned DNA
gcatcaaggaaggtgtgcaagggaggacgaatattgttgatggtcgagtaggggaatctgagatctgtgatgtgttccatgatggctatgagcatctgtatcagtctgtgccttctgatcagagtgaactcgaggaactccagcgcgaactttctgcgggagtagatcgcacatgtaaagtaggcttatgttactgtgatcacgtgatcagcccacgtgatattgagtttgccgttcgtaaactgaaaccaggtaaatctgatgcctgtccgcagtta

SEQ ID NO: 2463 - DNA, 171 bp, Capitella sp.
  source 1..171: mol_type = unassigned DNA
agcacatatctgttgcgacccatcactccggacacactcttgacctggtcattacgcgagagaatgaccttgtattgaactcaactgtcaaggattccctgatctcagaccataaggtgatccagctcagcattaacattgctcgtccccgagcagaacagaagagaatga

SEQ ID NO: 2464 - DNA, 315 bp, Capitella sp.
  source 1..315: mol_type = unassigned DNA
gcaacctttttgtggaagctaagaccacggaaggcctcgacgagcttcgaaacaagatagcccctctcacaagcgatctctttggggaagcggcttcattgcgcctgatggacgacagcaagaccaggccaaaacacgtcatcatcagaaatgttcctgcccactatgacgcggacaccatcctggaggaggcccgagtcgaatacagcagcgcctcatccgtcattaacttgaccaagccagggagcaccgccagaaggaggcccataaagctgagccttgacgacagcaatcaattggagcgacttctcaacc

SEQ ID NO: 2465 - DNA, 420 bp, Capitella sp.
  source 1..420: mol_type = unassigned DNA
cgatgtactctttgcgaattcttttctgccaacaatcaacaagccaactagaatcacagggtcgtctgcgactattattgataacattttcatcaataatctaacaagagcatcaactacatccggaatccttgccaactcaatctctgatcactgtcctgtattctgcttcacaccattccacaataataagagcaaccaaaataacttcatcacaaaaggctattcactgaccgaaataaaaataaattccacgacctcataagctccacgcaatgggatcaagtactcaatgaagcaaactgccgaacagcattcacatcattctacacacaattcaccaccatttttgatcaaagttttccattaaccaaaataaaacttggatataaaaatcgaaaaccatggctaacagatgca

SEQ ID NO: 2466 - DNA, 317 bp, Capitella sp.
  source 1..317: mol_type = unassigned DNA
tccttgacaccagcaacaaggtcgtgtctatcaccagtgagaacgacctaagggactactgacacagatgactgcctaatatcacggactccgatctctcacaatcattcaacctctttctgttcttgttcttgctatgttacaacccccatccctacctttacttgcacaaagcacctatctgcacgtcttccactctggtgagttcctatccaactttcttcattcctacccatcatgcgagtatctcataccttcgccataccttacctacctgtatctgaccctagctgcgcgaacagaaacctcactacgaa

SEQ ID NO: 2467 - DNA, 459 bp, Chlamydomonas reinhardtii
  source 1..459: mol_type = unassigned DNA
ggcggcggcggaggcggcggcggcggcggctgccctggcggcggcgggtgcggcggcgcctggtggtgcggcacccggtgccgcggaggcccccgctgccccggccgccgggccggcgatggcacccggtggcgccgccgcggccaccgccccggcagtggcgaccgacgcggcgcctgcggccgctgcagccgcggtgacgctgccgcccgcgtccgcccctctggctctggcgctggcgcccggcgctggtgccggtgccgccgcatctgcggcggccgccacggatggcagcggcagcggaactggcagcggcagcggcagcggccacggcggcggcggcggagtggcggcggcggcgacggcagctgcggcggccgcggccatgacaatggggatggtgggcggcggcggcagtggcggcggcggcgacggcagctgcggcggccgcggccatga

SEQ ID NO: 2468 - DNA, 51 bp, unidentified
  source 1..51: mol_type = unassigned DNA; note = Description of Unknown:Copidosoma floridanum sequence
tccaatgctttaaaacgctggaaggacctgcacatacaactatcaaccagt

SEQ ID NO: 2469 - DNA, 439 bp, Crassostrea gigas
  source 1..439: mol_type = unassigned DNA
gaggagcaatcaatcaatccagtcttttgtacatttattttcggtgttattgatttttcattacaccacctgttttatataactcatatttttttcattttctttcatatttactacattctaacgcaatacgtttatgcgttatttaactacctttgtatattgttatttaccttttgttttgtcattgtgcacatacattttttatgctattactttcacccctacgttttgtttatctcttttgttgaacaatattttgtcaattgtcatattgaggtatcgtcattttcatttgaataccttcattcagctgtaagtttactactagtggtgtatcttccggtttttggtcttattcattacccatatacgacacattatacagattgcagccatcatttcccccctattgttatcaaaaagttaatcattgaca

SEQ ID NO: 2470 - DNA, 609 bp, Crassostrea gigas
  source 1..609: mol_type = unassigned DNA
gagagagagttgttagacgagatgaagagaaacatcaaatctttgcaaaaagaaaaaaagacattaggcaactaaaakattcaatcgttgatctgcaatgtcgctctatgaaawacaatctagtgtttacggggctgggtggcgaaacaaaggaagaggacacaggggcaagctgcgggactctatatattttgaactgggaattgactggaaagtggagttctgtagggtgcatcggttcggtcgatttcagcasaacaggagcasacctactgtagcgaaattcctttatgaaaaagacagctgcaggtctgtagctcccggtctgaaaaaagttgaatggatcccaggtcgtccatccgaatttkttcagaccggkagctacagacctkcagctatgaaaaagacagattaaststccttgaaasagcctatcaattaaawkgamgtggattcggtatcaatgaacaattcccgcacgcttttgaggaaagacggaaacagctttatccttaacaaaaatatgttagacatgaacatatcacttgtagaccaattttgtagtactgttgtctggatacgttttgaacataaaagcaaacagggtaa

SEQ ID NO: 2471 - DNA, 326 bp, Crassostrea gigas
  source 1..326: mol_type = unassigned DNA
gatgataactctgtattacctcaagaaatatttatgtgtcacagtatgtttgasagtatgtgtattaatgaacaagaaataattgatatactatctattcttcctgtaaacaaggccataggtgcagaccttattagtcacaaaatgttgaaagctactaaacttaccattgtcaaaccattatttctattgtttaaccgctcacttagagaatctgtttttcctattatgtggaaacaagctaacgttattccactcttcaaaaaagatgacccttctgttttgtcaaactatagaccagtttcgttattaagttgtgttggtaa

SEQ ID NO: 2472 - DNA, 430 bp, Crassostrea gigas
  source 1..430: mol_type = unassigned DNA
tgcgcatgcgtgaaagtatcgacatggcgtaaaattcagctgcgagaattttctgtttattccaaaatttwggtwgttgttatgtcaacaaaaactccgacaaaagtcccgactaacgtgccaaataaatctggacctggagctgatgttgggaagcgaaggctctcgtcggacggtcaaaccccaaagccaacacccaagcaagtcaaaatggcgacgaacagctcaccgaacacacccggcaagtccggtaggtcaaacatttctcatgccgattatgaaacatttgtggaaaaaatgactattattgctgatgctgttgataagttacagaaagggcaatcgacactacaatcaattgttgaaagcaaattagacaagttcaaaaatgagttcgttcagggcatcaatgaaaaattcaaagccatga

SEQ ID NO: 2473 - DNA, 141 bp, Crassostrea gigas
  source 1..141: mol_type = unassigned DNA
atcacgtgatatgtatggaggtggacgtgtttttaccggagtacgacctacgggaatttcataccatatatagcgaagtttagttaaaggttgcggtaaatgtgatacaccattgatacgtgagtattatactctgttcct

SEQ ID NO: 2474 - DNA, 427 bp, Crassostrea gigas
  source 1..427: mol_type = unassigned DNA
tataattgtatttcatgaacattaatatatctcacataattttggtatgatttttataatatgctgtcatattaacaagctcaaatcatcagaaaatcaaggtactttttttttaaacacatagtatgcgcagcatagggtttaaggtttttaaaaaaacagacaataagttatacatataaaactcctcacgaccgattctaattatttatactattgtacgatttttttttttaagttgacaaaaaaaaggttgtttttggtcaacttcatgcagtcaactattttttagtgtttgtaaaattagcaagcgtgatgtgctttcgcaattccaaacttctgccttttaactgttttttctcccttttatttgccccctttctattcttttcgggaaccgtaaaccttataaagcatttatatagac

SEQ ID NO: 2475 - DNA, 559 bp, Crassostrea gigas
  source 1..559: mol_type = unassigned DNA
aaaaatcgagcggcwatgacaacatcatcaacgagatgctcagtgcagatgtgtcgacccttgaaccagtgttaaatgtgttatttaattcgatatttgatagtggttattatcctttaaattggaaattgggtataattgtgccgattttcaaaaaaggagataaaatggatccacagaactacaggggcataaccctacactctaagctgcctggcgaagcttttctcccgtatcctaaacaatagattacaaagatgggcagaagaaaatagtgtgatatctgatgcgcaatatgggttaaagaaaggttgtagtactattgatgcattatatgttttaaaaagtatcgttgactttaaaattgcaaatggcagtaagctcttttgtacatttgtagattttcggagagcgtttgacacggttgatagaaatgcattgtattataaaatgtttaagttaggtatagaaggtaaaatgttacgcataatcaaatctatgtatgatgatgtgaaaagttgtgtacgagtcaatggtaatcttacagatttttttttga

SEQ ID NO: 2476 - DNA, 839 bp, Crassostrea gigas
  source 1..839: mol_type = unassigned DNA
gaatcatggaaaaggatctggtgtcaataaaagaagctaatgaaagtctacaaaactctgttacagacctaaaggctcgttcaatgcgcgacaatctgatattttctggaatcccggaggagagacatgaagacaccgaagctgtcctacaagaatttatccaaaaaaagtataaactggattacgaagtcccattcgaaagggtccatagaatgggtaaatggaaggagtacagttcccatcccagaaatattgtcgccaaatttacctattttaaggatagagaattaatccgtacacgtgccccccagaagctccacaaatccaacgtttgggtaaacgaacaatttccccctgaaatcgaggaaaagagaaggaagctatatcccgtcctccgccaggcaaagaaagaccacaagaaagtaaaactggtccgggacgtgctttacattgacggacaggaatatatccctcctataggatccgctccgagagcatttccaacgcccacgccagctcagacgcgatccgccagcaatcaaacagccgagcgacaatacaccccgcaaaacccgaccaaagacgaccgacaggcttttaaacgacaacgtcaaggatcaacccccgaccgaattggatagggagacgcaggagaacaactctcgcgaacaaacagctacacgtctctgaaatttctctcgcttaacgtatgcggtgtcaaacaaaaactaaattaccccgaattttgtgattttattgcaaactatgatatcattggactatctgaaacaaaaactgatgattcggacaatattcaaatacccggttacgtcacttac

SEQ ID NO: 2477 - DNA, 981 bp, Crassostrea gigas
  source 1..981: mol_type = unassigned DNA
ccaaattccaacaacagcacagacagtattattaaagatatttgcagagaaaaactggggatccaaataaccgaaaacgatatttttcgttcccatcccattggaaacagaaacaaccatgggggcatccaaattatttgtcgtttccaaaattggaaaacaaagaacgcagtgtacaaagcaaagagtaaactaaaaaattccgatatctttgtgaccgaggacctcaccagataccgacaaggaatcatacatgaactgtcagctgctaaacgcttgcgtaaagttcactctttctggaccaacgacgggagaattttcactaaactgtccgaaaatggtcaaaaatatttgatcaaatccatcagtgaactgcacgaaatcgcgccgctaccgagtgacgaacaacaaggctaaaacgcaaatcccgtactctcttctgaaccacaaacccatgtgagcaatgtatagtataaattagatacaatgttcaatcagttatgtgtgatattctaagtatcgtgtcttcaaaagtagatacatgtatttgcagatgtatgaaaataatttttagttatatgtacaccaatctaatagttgtggttaaattacatagctacatttttgtttgttatatagtagtattataactgtgtaaacctatgaatttatatttcccattttttctcaaatgcaatcaatttggtttttaccaatattgtacttgatgccataatgttttttttttctacattttcttgtttttgttcatttgttcctttcttgtttttcactttgcattctttatttgtttgcatacactttttcaagtgtttgcttactgtgtttttaccttcaacttttgtcttgatgttacgcaacgaaggtcatggtcgttcagtacatgtatgaattcacacctgtcttttcaatcgcagtgctctctcatagtttcaataacgttaatcaacatgtctttca

SEQ ID NO: 2478 - DNA, 36 bp, Culex quinquefasciatus
  source 1..36: mol_type = unassigned DNA
cacgtggcctcgcggtcttgtgatccgagaatttga

SEQ ID NO: 2479 - DNA, 22 bp, Culex quinquefasciatus
  source 1..22: mol_type = unassigned DNA
atactaccagaacgtcggaggc

SEQ ID NO: 2480 - DNA, 24 bp, Culex quinquefasciatus
  source 1..24: mol_type = unassigned DNA
tagggctccttaggctagccactt

SEQ ID NO: 2481 - DNA, 1879 bp, Culex quinquefasciatus
  source 1..1879: mol_type = unassigned DNA
gaattgtggtttggttgagcgttttagcagaatgcattactgtgaatacaaagagacgagttgttccttttaattccgctatatattttaatatcttgacagatacgtatttcgtctactacttgcagacttcatcagtgttctgttctcgactgaaggttcatcgctggtgtatccgtatttgtagttactgtaggtactacctcctcgttcttcttttgtgcctgtataggtaacagcttaaacagccacgttgagccgttacctgaatccttgttgagtaaacgtttgttgcctgccttgaagatttccaaactttcggcgacagccagcttcgatgggttagtgatgtgtcttaagatgaccgcgtcgctagctgtgatgttatgtttttcctcgatgatgtgttcggttactgctgacttgaaatgggggacaaatcctttccgtttttcctccatggcaattttgacatatgtgtgtatatgctcatccaacctggtttgcagcaatctcttagtttgtccaatgtagctcatatcacagtggccgcaggatacctcgtagatgccgggtttgcctaaagtcggtatggggtctttcgttgaacctaagatggattccaactggctgtttctactgctgaacactaaatcgatgccaaatttagccagtttttgtcgtaatgggcgtgttatcctgtagtcgaattctactgctgctcttcgcagtggctctgctgatggcgtaagggttgtgagtgaagttctgtgcagttttctttccttcttatcgatgattgcttggatagttgttctgctgtaaccgttgatttccgctgtttcaaatatgtactccaattctttctgttttcctgcttcgctgaggggtaaagttgtcatcctatgtataaaataatgatatgctgccatcttatgttggaatgaatggtttgacgtggctgggattgttcttctggtgtttgttggcttcctgtagatctcgaaagaaaacgaagatgggcaacctggttctcttaggatcaggatgtctaagaaaggtaactttccttcgacttccatttcgtaagtgaacttgatgctcctgcgtgcactgtttatggtgtccagtaccgttgttagtgagtcccttttgatgatgcagaagacgtcatctacgtatctccaccaacgttctggtagtaggtttttggtttgtagttcgtgttccaaagctgccatataaacatcgctcatgaacggtgacagtgggttacccatcgatgctcccatcctctgttggtagatgcaatccctgaactggaagtagctctgttccatgcataatttgacgaatgttatatactggatcgttttttgtctccatggttctccctcgtattgtgattgcagccaatcccgtagagttcctattgcgttttttactggtatgcttgggaacagtgctgttacgtcgaaggaaaccattatttcatcctcagctatcggtcccgactctaagagctcctttgtgaacacctgcgaactgatgatcgaacggctcgggatcactaacccatcgaagctggctgtcgccgaaagtttggaaatcttcaaggcaggcaacaaacgtttactcaacaaggattcaggtaacggctcaacgtggctgtttaagctgttacctatacaggcacaaaagaagaacgaggaggtagtacctacagtaactacaaatacggatacaccagcgatgaaccttcagtcgagaacagaacactgatgaagtctgcaagtagtagacgaaatacgtatctgtcaagatattaaaatatatagcggaattaaaaggaacaactcgtctctttgtattcacagta

SEQ ID NO: 2482 - DNA, 99 bp, Culex quinquefasciatus
  source 1..99: mol_type = unassigned DNA
ggataccatcgtagttgtaggcgattacaatctgcctcacctcaactggtctttcgattcggacatcaacggatacctgccaacaaacgcatctgctga

SEQ ID NO: 2483 - DNA, 177 bp, Culex quinquefasciatus
  source 1..177: mol_type = unassigned DNA
ttgtttggatttagatgatagtagatttgcccagcagtacaggattttttgttgttattgttattttgtttgtttaagsagtttatctgaaaaccaaaacagcactattatcttttgttttgccctgattgctcttttcctacgcgtgtttttctctacatagatttatatattttt

SEQ ID NO: 2484 - DNA, 615 bp, Culex quinquefasciatus
  source 1..615: mol_type = unassigned DNA
gtgtgtgtgcgtcgcgcgttattatcgcgcctcggtgcggctccgcgaaagtgccctcagaaccgcagaattaccgttccgtcgtggccgaaagtgtgatcaatcaacgccgaagtgcgtcgcgaaccggcgtcgtgtgttataattgacccgcaatcgacggctgggcaataaaagtgaagttatttttgccgtccatcgtcgtcgtcgcgggaaaacaggcagaacaaagcaagaagtgtggtgtagcaacaagaccagtggcagtgccgttgtgtcggttgcgtatacgcacactaatcgaaaccgcgcgcggtgtgccgagagtgcgaatttttgaaaaaagaaaacgggcaaaaagttttgaacttttttgcaaaaaataaaataaattttattattgcgaaatttggcgctagtagtgaagcgcatttacgcacgcagcggaggacgtcctcttccggatatgaagaccgttaggcttcgagataaaagccccgttacggtakcgtgagaaaaccggggctaggtctcggtagcccgtaggtggttctccaccccgagactaggtagcgcagccctgataaggctgcctaccgaaaaagaggatcgcga

SEQ ID NO: 2485 - DNA, 255 bp, Danaus plexippus
  source 1..255: mol_type = unassigned DNA
atccagagggtgtcctactaagtatttttccgatatttagccttgggcatacgggtacgcgaccccggatcctcgagccaccactttcatacctctatcctcagtccatgaaggtggtgtcctgtacctcccctcattccccttcctaacctctttccccccttctctatcttttcctttcctggttttacccgtaaaacggggttttggaggtcagacggcagtcgctccgttaaaaccactcccgccactctt

SEQ ID NO: 2486 - DNA, 205 bp, Danio rerio
  source 1..205: mol_type = unassigned DNA
ccaagatggcggcgcgcattgacgcagcggctcagagctctccttctcagtgctttgtttgtttgtttttatatgtctgtttaatttttttaacctcagccagtcaggcgaaaatattttatagtcgacaagacctcctctcagtgggattacagagcaaagagacagttacaacaatgtttattcagaaccacagcatacctga

SEQ ID NO: 2487 - DNA, 10 bp, Danio rerio
  source 1..10: mol_type = unassigned DNA
tcgatccaag

SEQ ID NO: 2488 - DNA, 190 bp, Danio rerio
  source 1..190: mol_type = unassigned DNA
attgtatagctttgaggcgtaatgaatagtgcgacaaatagagttaaacaacctctttgcttgccattttaagacttgctgtctttttttagtctctgtgtgcaaaaacgtcttgcctcctattcagcgttggcgctgtggcttagttggtcaaagtgcctgtctggtaagaaacttggctgaggccaag

SEQ ID NO: 2489 - DNA, 1752 bp, Drosophila sp.
  source 1..1752: mol_type = unassigned DNA
aggcaatcgatttgaggggaaaaaatcactctacctcaaagccacagaaaaataaaaccatacatggaactgccaaaattcgacggtamctacgtcgagttcaaaattattactactattcaatgtcaaaaaaatcaataattttatatccgctttgaaaaggaasagtaaaggcttaccaaatcamgtcgaccatgaatagggggtatgtaatccgtaatgcaagcgccatccgccgcagtgttacgatctctcttcgacgcccttactagtttttacggatttcttctctcggcaacgaaaagttggaaaaagtcatgtccaggttagatcgaaaaacgcggtcgcgatgggaagaataaaccagttaaaattctagtcagatatggaaatattcttgggaagcgattaataaacgttatcaacacttagtggctgaggattccacgacaggaaggagagcttccaagcgggagcagccaaacaagccatgctttagaaagaaggcattcgtagtttcgtgacctgmcgaagactcccaattgaaatktcaattttgtaagtcaaagttctatcaattgccaaactgtttacatttcgcccaaagtcttaagaaaggacgaaatttcaacagatgtaatatatgcaaaacatagaccgcattaaacatatattgtttcggttttcccttgcccggtttcgccttttgtttctaagaatagatcgggagttacaaaattacgatagtattgaaatattgcttacatagtcattattgcttttcggcgagccgagcagctcgattgctcaagaaatatataaacttaattatttatttataatgacaattattatttatataaaaattatacagtgtattggccagccattccattgaacaaacgtattgccgttgtgctctatccttaaattacgaactataggcaagtcaaacagtcatttcgcaacgatactgaccggttgtgttttatttgagctcttgaaattacctttcaatcgcggttacaccgaacgtatataatcttaaaattggagaataactttctcaacccccgcttaacacttcacgcaccgtatataaacattacatcgcgccaattaacatatttaattgaatcgcaattcatctgctgttgccacaagkgcttctgttccctatcgccgtcgcgtctgttctttacacccgctcgccaattgctctctcaaggccacggtcctctctccgtgcacttcactttgagcgcttcgcctctctcatcgcctggatattcgaattggctctccgaatcgacgactctcccatcaagtattctaacggtcctctctccgtttacttcgagtgggtcgcctctctcatcgccttgcttgctgcggatcttcgaattggctctccgaatcgtcgcctctcccatcgccgtatctgccactacctggtgttctgcgtgtctctttaatctcccacggcctgctcttctgcaagattctcttaactgcctcttaactgcatagtgtccaaacaatcactaaaatgagtgtcgtcatctgttccgcaaagaaatgcgagttcaattgtgttatcattggagataattatttgtcttgttggctttgcgacaattgcgctcatgtaaaatgcgcaggaatgggtcaaaacggccgtgtagttgatctgatctcgaagagaggcggcttaacttggttctgccctacctgcctcgtacttactcggag

SEQ ID NO: 2490 - DNA, 136 bp, Drosophila sp.
  source 1..136: mol_type = unassigned DNA
atgtagggccagaccaataacaatcgtgcagtgttacgccccaaccgaagacgcaaacgacgacatcaaagacgacttctataccgcccttactaccactctcactgacatacctcgaggcaacatcaccgttctc

SEQ ID NO: 2491 - DNA, 238 bp, Drosophila sp.
  source 1..238: mol_type = unassigned DNA
ggggggatgggggagagcatataaggcaaagtgtctgactgcattcaacttggtgaatgccagcatgatccttatcactgatctcctcaagccgacgcactacctccacgtggttctccctggattgccattcaacatccgttgagtggcaaactaaagcgcgcgacgagagtcctagctcttcaaactaggttgtggcgtaggacttgaaatccacccatggaaaaaccaaaattca

SEQ ID NO: 2492 - DNA, 16 bp, Drosophila kikkawai
  source 1..16: mol_type = unassigned DNA
ggaacaaaccaaccaa

SEQ ID NO: 2493 - DNA, 298 bp, Drosophila kikkawai
  source 1..298: mol_type = unassigned DNA
ggccatgcgatgcaaaaagcacaaccagctcacaggtgtttttacacgacgtggtgtggtgtacgtgaagctgagcgacggaggggaacctcgatatgtgcaaagctcacacgagctttctgagctgatcaacgatgctggcggcgccgataagagcacatttcgagattaagaagcttcactcaattttgtatctcctatgtttacacataactataatatttattagatttaaaattaatgtaggtcgctatgttttctttgtgtccttttcagtatgtttccaatgccttaattt

SEQ ID NO: 2494 - DNA, 237 bp, Drosophila sp.
  source 1..237: mol_type = unassigned DNA
gctcatttttgtctctcgccttaatcctggtgcttctgaagatgacgtcaaaaactacctgagcagcaaactgaatgtttctcgagccgaactaaccgtcttgaagttcaagtttaagcagagacgtgaaatatcttcgtttaaaattggacttcctgaggaacatcttaataaggctctcgatgtttctatatggcctaaacatgttattgttcacgagtatgtaaacatgcctaa

SEQ ID NO: 2495 - DNA, 438 bp, Drosophila simulans
  source 1..438: mol_type = unassigned DNA
caccacggaagacgagttgaagagtgccttggaggcccaggcagagatccctgcagcagtcgtggctatcaagagccttcggcaatcgcagtacggagggaagactgcggtgatagcagtcccagccaatctgacggacccgctgatcaagcgtggcaagctgagggtaggatggtcccaatgcttgatcaaggagctggagccacgccaaagatgcttcagatgcctggaagaaggccacatagcggcccactgcagaagcaccgtggacagaagccagtgctgcttcagatgcgggaccgcgggacacaaagccgccgagtgccctaacgaagctaagtgcttcttgtgcgcaagcagaggtagccaagcgaccaaccaccaaatgggcacccggaagtgcccattggcgggtaaaggagcaccaaaggcactgca

SEQ ID NO: 2496 - DNA, 904 bp, Drosophila sp.
  source 1..904: mol_type = unassigned DNA
gaaacgtcaaaaggatagattttcacaaaattaggacaatwwtggacgcaaaaagcaacaataacgaacggcagcccccccctttcaacaagaccccccacctaccatatagttccgaaatggccaaatctcggaaggaagccgccaggaaaactacatcaaacccgttccggcaaaatgcgaaggacgataggccaaaccaaacgggattctcttcacatgaagctgccatccaaaaacggctgaataaatggcgccgacacgcggacaaagcgaccacaaaaaacaggaccaactcgaaggacaaccccaagccgcgacccacaaaaacgacaaaaaacccggcacaaagacaccttgaggccttcaacgacaaactccgcaaggaaaggagggatgctatagaacacacccgcgacgaagctatgacaagccccaggaggggtgatgctggtagcccgccgacaacaagtagagccgccaaaactaatttcaagacaaggacctaaaaattaaccgccgatgggaccgaggacgtgcataagcacttgcaaagaggaccccctgacgaccacagcctaaacctggcgcaacgagtactggaaatggaaaagaaaattgacacacttatggaactcttcttcaaatgcttagaaaataacaaaaacctgaccacagcacaccccatgtcctcctaaacttctaagttcctcgcaaaaataagtagcaccatgacattaaacataaacaacacacatactatcaatacccttaaaatagggtattggaactcatgtggagttaccaataaaagagacgaactagaagcttacataaaaaaagagggtgtccagatcatgctggtaasagaaaccaagctagaacgaaattctactatgcttaa

SEQ ID NO: 2497 - DNA, 216 bp, Entamoeba histolytica
  source 1..216: mol_type = unassigned DNA
agtaatacaaaggaagataaataaactaaaagacatgctaataagaggaaactataaaaaattaagaaggatattaagaataagaagaatgatagaagaaaagataaggggagaagtaaatgaagaaataaaacaattagaatatttaaaagaaatgaggaaaaagaagtagacttaaacaaaagtgaaagaacaagaatctacagaaacaaaatc

SEQ ID NO: 2498 - DNA, 140 bp, Esox lucius
  source 1..140: mol_type = unassigned DNA
cctctccgggagccatcaccttatcgtggtggagaggtttgtgtgttcctatgaacctgagggctgtgttgtccgggccttagtgctcctggtagggtttcccatggcaaagtggtctcaggggaggagccagactaaga

SEQ ID NO: 2499 - DNA, 47 bp, Folsomia candida
  source 1..47: mol_type = unassigned DNA
aatttttcaaaaaaaaaaataaaacgcccaaaaatatagagaatgaa

SEQ ID NO: 2500 - DNA, 194 bp, Gasterosteus aculeatus
  source 1..194: mol_type = unassigned DNA
cttccgtggaattactggacattctagtcaaaggtgcgctcacctttcgtcacgcggtgagacgccgtaggagaggaaaacgggccggctcgctggtgagactccgcaggcgtggttctcgcactccgctgccaggcatctttctctccaacgtgcgctcactgtgcaacaaactggacgaaattcagctgctg

SEQ ID NO: 2501 - DNA, 156 bp, Gasterosteus aculeatus
  source 1..156: mol_type = unassigned DNA
cctctctgggaaccgtcaccttatcgtggtggagaggtttgtgtgtccctatgaacctgagggctgtgttgtcgggagccttgtgctcctggtagggttacccttggcaaagtggtctcaggcgaggggccagactaagaatggttcaagaccccc

SEQ ID NO: 2502 - DNA, 84 bp, Gavialis gangeticus
  source 1..84: mol_type = unassigned DNA
agcttagttgcctgtacactaackccakaagcatgsgaaacaaacgtactgaccaacaagcaacacgaccagctccacctmtga

SEQ ID NO: 2503 - DNA, 273 bp, Gavialis gangeticus
  source 1..273: mol_type = unassigned DNA
atacaggacctccacctaactcaggaggtgcacagtcccaccaggggaaatgccctgctggacctggtccttgccacaggcgatgacctggtgagggaattgcgggttctcggccacctgggcgatagcgatcatcgcctgctggaattcactatccagcgcagggtgtcaagggctagcagtaaggcggaagtccttgacttcaggagggctgacttcaatgagttaagaagactagtatgagaggcattgggatcccgaagttttggggag

SEQ ID NO: 2504 - DNA, 969 bp, Gossypium arboreum
  source 1..969: mol_type = unassigned DNA
gacttcgtttgtgtgtctgcctattattctttgaattttatggcagtcttgtggtgttgagtgtttctttgttgtttttggtattattttatttttttttgtgtctttcttcggtgggtttgcggtgccgggggaccgacgtgacatgttgctgttgaagtctggcgttaggtggggattttcagagggtttcttggctctgtgacgttcgttgctttgcatggccaaggagttcttgcgactttatgcgctttagcggtggcgggccattcgaggtgggacgggcgatacatacgtggctcgtcacgatcttttctagcatcgtcagaccctgttttgatgggattgtttcattggcagcaataaggttttgtcgtttcttttgtcttgttcagctattttattgattttctttacgttcagtaggttgcatgggtcttgcatgtatcttgcatggattgtttcgtcttgcacgtattccactggtggtatttcttattttctttgacttttcaacgttattcaatctgagggtttttttggtttaacaggcattatatgaatgcggaggataagttttaatgattttccctatttgttcgatttagttgtttttgttacagtagctattaggtttctgggttttcttggactgctggtgttaggttgcagttttttggtactttcttgcatgttttcctttccttgatgttcggggatgggggtttgatggggggtgtttgttcgtagcttgagtcggggtgttcctggctgttgttgttttgctgtgtttttgcaggttcttggactgtttctttgctctgctcccggtggcggttttcggggttctgtttttctctattcttggggtgtttcttgtcgaggttgggggaggcgacaagagaaaagtgttgatcagtctccctggcactcgtttaaggtagcagtctcgtgagttgtcgtttgaaa

SEQ ID NO: 2505 - DNA, 1429 bp, Harpegnathos saltator
  source 1..1429: mol_type = unassigned DNA
cgccgcgctckgcggccgtcaccataacgtgccccgacggaaaataccatgagttcatggtcgaggccaggcgccgaatcagaccggcggacctsgggataaactcttccctgagggtccgccgggccctgaacggggcaatgctgatagaggtgcctggcctcaacgtcggggcgtccgccgaccggcttgcggaggagctccgcaagctggcggcggaaaaaggccccggttatcgcatccagcggccggcaaagttcgcagcactgcgaattgctgggctggatgcgacgaccggggccgaagaggtggcggccgcggtggccctcgctgggggatgctcgcctgaggaagtttcctcgggcgtgatgagcgtctcccagcggggagtcggcgccatggtggtgcggtgtccgctggcggcggccgctaaggtcgccgccgcggagcgggttccagtgggctggacccgcgccggggtgacggcgctgcccgctcgcgcaacgctgtgcttccgctgcttagagcgggggcacgtgcgcgagcggtgcaccagcgccgtcgaccgcagcggtatgtgctaccgctgcggtaaccccggccaccgcgccaaggggtgccaggaggcggtgcgctgcccggtgtgcgccgaggcgggcaggccctccggtcacaagatcggaggacctgcctgcaaaccccctcccggaaggagaaaggggggaaagaagaaggaaggaggagagaggcagaaggggaaggaggacaccggcggggggaggcccgaaccaccaccgccgggggaggaccggacccgacgaagcctggggaggagascggaccagtctcctccccgccgagggactgagggggagccggggcggatccggcccccccctggcaagaaccccagaggaaaaggggaggagggggactcctcccccgacctaatagactgggactgggagccggagagccccgatccaggagccggaggaacctctgccccgcaggaagaggagaggggaagaagaggccaacagggacgaggacgacccggaggaggasgcccaggccgcaaaggtgaggagggtggagccctcgggcacacccccaacaggtgtagaggaaggggagtcggtgggagcgctgcccccgactcccctgcaggttgactccccctcgtacccccgagaggaggaggtcacgcaggtagggaccccccgtgtctccgcggagacacccgcgttggaggccaccatggccgaaaccccctccggggagaccgagacggcttgccgtcggaagtctcccaggaggagggggtggacgtaggcagcccggaggaggcgtgtaaggcttagccttcacgacactccgggccctacaggccaacctcggccacggcgcccgggctcaggacctctgc

SEQ ID NO: 2506 - DNA, 49 bp, Hydra vulgaris
  source 1..49: mol_type = unassigned DNA
gtgtatataaaaaccttcaaatattttcaaaataacaaaaacatacaaa

SEQ ID NO: 2507 - DNA, 117 bp, Hydra vulgaris
  source 1..117: mol_type = unassigned DNA
cgcgcgccgttaaagatggcagacgtgactttgtgaaaaaataagaataacaaaacataaacattttgtaataataactaaataataaaagataaacttatcttgtcaaatttgaca

SEQ ID NO: 2508 - DNA, 1122 bp, Hydra vulgaris
  source 1..1122: mol_type = unassigned DNA
aaacgttatcatctatggactagaagcaacccaatgttcttctcagacggaaaaactagaaaatgataaatcgcaagtaaataatttacttagtgctatcgaatgcgatagagcaaaagtgagatctattcgccgtcttaaatctaaaggaactatcgatcctttgcttatcgagcttgaagacgttaataacaaaaatatggttcttaaagcatcaattaaattaagaaaaatcaaaaaatatgaaaatgtgtatataaatcgcgatctaacagcaagtcaaagattcattctaaaaaataaattaatagaacgaaacgaaaaaaatgcgttaagaagtgaacaagaaaaaattaaatttcattacggtatgacaatcttactcgaatttttcacaaatagccactagcaaccactaatttagcaacgtcatcaaaagtatctcccccaaaaaagacaaatattgactatactcgaataaaatctcaatttattcaagatccacttctcaacataaacaaactgaacacttcttactttgattcggataaagccgctattttccttaaaagatgtgaattatatttttctaatcaattctcagtatttcatttaaatattcgtagtattactaaaaacttcgacgaactaaaagtcctactagataatcttaactttaactttagcttaatttgtttaacggaaagctggattttagatacaacatttaatcaaaattctaaatttatattgcccaactacaaagccattagttttgaacgtaagtcttcaaaaacaggcggtggtatatgtgtctatgtgcttgatgaatttacttatcaaattagatatgacctgtcgttctctgagccggattttgaatctttcactttagaaatctacaataagtcatctaaaaatattattgtgacaactacataccgaccaccaaacggatgtttaaataactttcaaaatcacttaagtgattattttgaaacagcatgcaaaaaaaataaagaccactcatttttatttcttggagattataacgtcgactatttaaaatatggtgaaaataataaagtacaacaattttacgatagctttaatgagtttgga

SEQ ID NO: 2509 - DNA, 148 bp, Hydra vulgaris
  source 1..148: mol_type = unassigned DNA
agaagctggaatgtttgcgtatatttcatacgacaagttggtggttcgcgatggtctcgaaaacccacgtaaatatttcttttaacgttactttatttttattttttatttatcaatagtttttcaaattttaatttaacttttagaa

SEQ ID NO: 2510 - DNA, 1083 bp, Hydra vulgaris
  source 1..1083: mol_type = unassigned DNA
tgcgcgatgaaggaaagatggcggtctwaattctgagttgaagtttggtatacttttattttawcgagtcgaaatttatatttatccatctattattaaatcaatgaaaaagataaaaaattaataaagtaattagtatcaaaataatttattcgtgatcaatattaatacaaagtaaccctaaagtagcaaacaaaaaaacgagccatatttcattatccatcaaacaagaagaaaagaagcaagaagaaaagtataacataaataaaatgaggagaagaaccgaaaaaaaaaatagcacgaatctattggaaagcataagatttaaagatacttaaacctccttatttttttcttttgatgatttttggttagccacatttgtttattatttttctggactatttatcaatatttgtaggttatttattttcattactttatagaattataattatatctaaatagctaatatatctgtaatataatttattcatatatataaaatattattatatacctatataactatctatatatctatatagcttttattagtgattatataaatgtcatataacttaatctttcagtttatgttaattatatatttacataactatcattatttacataactatcactatttacataactatcattatttatcatttgaactttatttattatttgtacatttctcttcatttattcttttctttgtgcttgttttaacattttatttgtatatttatttttatttattcttttcttcatgattattttaacattcttcccaagtatattattttattattatattggcttgttagtgtttttgttagttgtcaacatctatttaatctcttcaacatcatctacttgattttgtataacctacctgtactgtgttatatatactgttcttatgcaaatccattttgcctcacaattactctcttattatattattatattattataagtttatcttatttattatatccttagtcactcctttttttttcatcaccttctgtgtttatcaataataaaacataataacattctgcctatcaagtt

SEQ ID NO: 2511 - DNA, 1081 bp, Hydra vulgaris
  source 1..1081: mol_type = unassigned DNA
  misc_difference 798: note = a, c, t, g, unknown or other
aacatacaaaatggataacgataaagtaattacaatgggaatgcttcgagaactcatgtcaatacaaggagatacaattttcaaatgctttaaggaaagttcggtcagtgtcctggaaaaagttgagaacttagccaaagrcattgaagaaataaaacgtgggcttacttttgttggtgatcaaattgagacaaagtaagcaaggttgatagtaaaatggcagaaattaaagaaactattgtgtattaaatcattccacggaaaattaagcattgaaaataaaakaaaaactgtcgatcttgaaaccgacgtaacaatttaagaattgttggaatcaaagaagaawataacgaatcttttaatgatgttgtaraaaaagtaaacctactaattaaagaagatctggaaattgcgggtcyagttattatagaaagagcrcatcgtgtcggtaaatttagtggaaagcctagaactattgtctgcaaaatattaaactggcaggacaaggaaaacatcttatccaacgctcgtaaactcaaggggaaaaatatatatattaacgaagactatagtgatgaaacaatgcgaattcgtaaagaactttttgtacaagcyaaaatacatagtggtaacggaaaatacgcgaaagtcatttacagtcgattagtggtaagagaaatgataaacgagaacgaaggtgttgaaagyaagtaatttatttatttacgttttaatagttttattagatattaaattttawggtttttatttaaggataatattaacaatgaatatrtntaaaacaattcataayaatgaagcaaatttaacaaaattaatatctccaatttttgaaattttgaaatataacaaaaatgattayaattttttgactgaaatagatattaawtgcttaaataatgaatactataaaccggaagaatttaagagaaaaaaagcttaacaaagatttaaacattttaagtataaatatacggtcaatgaacatttttattattctttaaattatctttttgacgtaatatgtatatcagaaacttgggaagatgcaaacttgccc

SEQ ID NO: 2512 - DNA, 930 bp, Hydra vulgaris
  source 1..930: mol_type = unassigned DNA
aggtcatcgcaaatggcggacgtatttttctaacggtaaaaaataaataaaagaaaaaggataagataaacagttaatttttcattttcaattcgctaaaaagtttttttaaattgttaaaaatctgatttaaatcaaacgcttaaaaataaaaatcaaataaaaaaaagaacttcgaattattaaaaaaaaagaacactttaaacaaagaaaagaacgaagaaaaaaaaaaaaaaaagaaagaaagaaagagaaagtaaacaaagaagaagaaaaaaagaagaaataagtaaacaaacaagaaagagaagaacaaaaccaattttaaagagaataaagaagattggttattcatttattttcgcgatttaatttgtaattattattttttaatataattatttaacttatttgttattttattattattattattattttttttttttttcactttttcacatattttttaattatttatttatcattaattatattcattagttctagttaataaggttttcccgttatctatctaagttgtattatcacatattatttatttatttatcattagattatctatttaggaagttttgttatatattttattatatttaaattattttactatatataattttattatattttttgatcattattataactttatcattattatatattcttatacatttatttattatggatttatattattttaattttatctattgtttattattttatcttagttattaattaatattataaatctatactctttatttataatttcgataataattaactacgtactactactgattactgttgctatttatccatttactgtttattgtttgattattttctcttttaattttctatattttctgttctataaacggctttaccatctatatc

SEQ ID NO: 2513 - DNA, 460 bp, Hydra vulgaris
  source 1..460: mol_type = unassigned DNA
aaaggtctataatgaagcctattttcggaaaaaaagttgcatttaacagaaactctattgcaggcgaacgtacggtgcgagaatcttatatctttgtaggaggggtctgtaactcaatgtcggaagaagatctatctaaccacatcaaaaatgaaataggtattgagcctattaaggtagagcttaaccgggaaaataaatacaatcgttcattcaaagttatcataaaaagtactgaaaaagacataatcctaaaccctgatatttgggatactaatattatcgttaaaccattcaggcttcatcgtgttacctcaagaaacgaaacaccacagcagagtgcagttaatacgctacactctgtacaaccaactcaacaaatattttctacatctaaagaacaaccatcctttgcacagcaacattcttactcaactcgaatactaaattctaattcaaa

SEQ ID NO: 2514 - DNA, 750 bp, Hydra vulgaris
  source 1..750: mol_type = unassigned DNA
  misc_difference 38: note = a, c, t, g, unknown or other
gggaaatttttcaagaaatgttycaaaaacaacaaaangatattttaamattaataagtggaaatttaaaactgactaatgatcgaatcgatggattgctaaaagaaattactacattaaaagaawcttgtgaawctttaaaaaaagaaaacgaaaacmgaaawgccgatcaaaataaaaacaaacaagcagttaataaagtatgaaaaaatacaaaaagacattgaagaaagtctaacgttctatcaagatagccawgataaaaaagttagcgayttagaaaaaaaaaagtcatcgaatgcaaatataggtgagaatgaaaaaaataaatttagacarctggaagatcgacaaagaagaaataatcttcgaattgaaggagttaaagaaaatgataacgaaagttgggatgatacggaaataaaaataataaacatttttgaaaataatctcaatgtaaatggagtaatcatagaaagagcgcatagaactggaattattgaaaaaaaaaaaccaagaacaattgtaattaagttactaaattataaagacaaagtaaaaattytaaaaaatgccaacaaactaaaaggwtctggaatttatatcgacgaggatttttcgctagaaactacaataataagaaaaaaacttcttgaagaaagcaaaatgcataggaaaaatggtaagtattctgttgttatatacgataarcttattgttaaagaatttataaaaaaaaaataatgataa

SEQ ID NO: 2515 - DNA, 560 bp, Hydra vulgaris
  source 1..560: mol_type = unassigned DNA
gaaagtcttaacttccaagaaacaactattatggaaaaaataaataagatcacgaagcgttacgaaaaggagataaacaacttaaataagaagacactagatttggagaatcgatctcgaagaaacaacctaagattagatggaatatttgaaaagccaaatgaaaattggaatgagtgcgaaaatgcagtaaaggaaatgtttaaaaaacaactaaaaattagtaatgaaattatcatagaaagagctcatagaataggccaacctaaagaagataagaaaccaagaacgattgtcctaaagttattaaattttcaagacaaaacaaaaatacttaacgctacaaaaaacttgcgaggaactgggatatatgttaatgaggatttcgctaaagaaacgatggaaagccgaaggatgttgtgggaagaggtcaaaaagttgcgacttgaaggtaagtatgcagttataaagtatgataaaattgtttctagagaatttcgaaagtaaatgcgctcattcttaataagaactcctttttaatttatttgtgataattaatc

SEQ ID NO: 2516 - DNA, 750 bp, Hydra vulgaris
  source 1..750: mol_type = unassigned DNA
  misc_difference 396: note = a, c, t, g, unknown or other
ggctaaaggattatcatttactcaaattaaagaattactggaaattcatgaaaacacaatattaaaaatmtttarcgataaatttgataaaatggaaaacaaaatgtaagtacttaaaagmgaaaataaaattttaaaaaatgaaatagcagatattaaaagtgcaatgacttttcataaatgaaaagtatgaaaaagagactaaagaattatacgattttaaagaacatcttaaacacaacatgaaagtaaatgaaaaagctttaaacaatgatgaatttaaagacgaacttgckgaacttgaagacagaagtcgaagaaataatttaagatttaatggaattgaagaaaaggaaaatgaaacgtgggaagaaagcgaaaaaaaaattaaagaantcttaaaakaaaaacttggtattacgaacgaaatataaattgaaagrgctcatagaacaggaaaaaagaatgaagttgaaatgaaaaaacgaagaactattattgtaaaatttttaaactataaagacaaagaaaccgttttaraaaaataccgattactcaaattatggaacgaaaaactatacataaatgaagattttagcgaaagaacaatggaaatacgaaaaaatytwtttaaagaagcaaaagatttaagagccaaaggtaagtatgctaaagttgtatataataaattagttacacgcgatttttaaaagaattaatttttttatttttggatttcgaataactaaa

SEQ ID NO: 2517 - DNA, 106 bp, Hydra vulgaris
  source 1..106: mol_type = unassigned DNA
agtccctgtgtaataagcaaaactaataataataacattacaatttcactgacaggaggtaatccactgttatttagggtggtagccctcctatccagtaatccaa

SEQ ID NO: 2518 - DNA, 505 bp, Hydra vulgaris
  source 1..505: mol_type = unassigned DNA
aggagcatgtttatgaaaatgttaaggattggtgggaggctggtaaggagagagtaaaaataatctcgaaaaaatttagcaaaagattaaaacaagaaaagaacaaaaaagaatttaaattaatcaaattattaaaaaacgcatcgaaaaaaatgcatttaaattgcaatatgaaaaaactttacgacgatttaaaagttaaacttgaaaatatagaaaaagaaaaagccgtaggcgcggcaataagagcaaaaattcagtggaggttagaaggggaaaaatgctcccatttttttttcggattggaaaaacaaaaattagctaaacaatatgtctcagaaataaacggcagagacgggcaggttaaaatcgactcaaaaaaattttattagaatttgaacatttttatagaaacttatacaaattcaaagaaaacgacaaaccttctcaagaatttttgttcttaaatgctaaagttaawaaagttactaaggaagaaaataaa

SEQ ID NO: 2519 - DNA, 75 bp, Hydra vulgaris
  source 1..75: mol_type = unassigned DNA
gggaattggaagattaacaatttaagagtagatggaattgatgaaaatgaaggtgaaagctgggaagaaagcgaa

SEQ ID NO: 2520 - DNA, 804 bp, Hydra vulgaris
  source 1..804: mol_type = unassigned DNA
cttaagcctttgagccgataagacgtgtttttgtttgagcgtaagttttcaggaattttaaatttttttctttttttttttttttttttttccgtattctttatctttcttttttacttatttttctaactttttctaaccactacttctttttctacttattgctttatctaattagcttattaattacttttctacttaaaattatagtaatatattaactattcgtgtctataatacagttttttgttgtacttcgcatacctaaattaaatataattcttatattttatacctatacttatattttattatatatatctttatttatatattactattataaaaatagttataactgagatttttttttatgcttcagttcgcttaattttttttttttttttttttacagagttataaaaagttttttttttttttttttttttttttttctttttcttcgccaaaagttgcgtttgcacctgttctttgtttttagttttctgaacaataagctaaatttttgcgctctgacacaaactatattagtaaattatatatccatatattatatataaaatacatataaaaaagttatatataaacatatacaaataatataaagaaattaaatatatacaaataaatatgataacacggaaaaaaacacatactgaatctttttagtccctgtgtaataagttatttgtcataattgtaacaaataaatttgcaataattgtaacaaataaataaacataaaaacatcactgatataaaaaaaaaaaaaattcatctgtg

SEQ ID NO: 2521 - DNA, 46 bp, Hydra vulgaris
  source 1..46: mol_type = unassigned DNA
tacaagttacaatttgtgtttgtgtttacaagttcgagtaaaataa

SEQ ID NO: 2522 - DNA, 137 bp, Hydra vulgaris
  source 1..137: mol_type = unassigned DNA
ttttttggacttttatagcgatcggacatgttataagagcttttcattaaaaaaaaaatttacggaaaaattcaaataaagttaactatactttgtaactttttgtgaaaaaagtatatttgcatagcgtaccaact

SEQ ID NO: 2523 - DNA, 914 bp, Hydra vulgaris
  source 1..914: mol_type = unassigned DNA
tggtaaagatggcggagttatagatagaattgtaaatttatcaaataaagtaatatatctttacatgacagcaattaagaggaaaaatatttatagaaaaaaagactaaaaagtaaaaaaaaatatatcggaaaattaattagaaaaccaaagtacttaaagtttagagatgtgtaagaacttcatagactcaaataaatataattaaagaacaagatacattacaaaattaataaactaagagaaagtaaagaaagaatcaagttaatgaaagraaaagatcaagagttttttacatttgttttgattattttttgctttaaatattatttgtaaatttaagtattttccaggattcgtttttattattgactttttgattattattattagcagttatcattgttattattattataattaaatatttatcattattattaaataatatagcattatttatcctatatttatccattatttacctcttattacaatttacatcataatttatcttatataaatgttatttacctaatattactacttatctccttctttacttattattacttaccttattatcatcaaattatttaaataacatatattatttatattatactatgtctaaagctactagaggtattaatatatctaaatttatattctaaatcaagttaataatattctaattttatctagctgtaatacttattctcctgtgtaaagtatttaaatctcttatatcttactatcatttctttataactgatcattcctcaatatttaaaatagcaaccatttctagattaacatttcttagttttaatctctcagtttctttataaatatatagtagatatctttatttaattattttttctctatactttgtttaagcataataagtc

SEQ ID NO: 2524 - DNA, 97 bp, Hymenolepis sp.
  source 1..97: mol_type = unassigned DNA
ggggtgtgcaatagacttacctccacgtggtgcaccctgggaaacgtatactcatacggcaaaaagtctataaatcggcagttgacttcaaactact

SEQ ID NO: 2525 - DNA, 100 bp, Ixodes scapularis
  source 1..100: mol_type = unassigned DNA
catttggccggcagggtgcgtttttcgcccttttttcggcattcttaaagaactctcggacacggacacctcggtcgatgtaaacgcataatcaggtacc

SEQ ID NO: 2526 - DNA, 581 bp, unidentified
  source 1..581: mol_type = unassigned DNA; note = Description of Unknown:Locusta migratoria sequence
aggatgtcggatgtgcctttaatagccaggagatcgttctgattgtctggctgccagttagcgctagttcatttagttcacgttttacaacgctatccggggtgcaccacggggaggcgaactagcattacacccttacaaacgcccgacttatagatagcacgcttgccgcagaacattccaggtgacagtgggggaccaaatatgcccaaagaaccctaaacaacggattaccacagggctccgtcctagccccattgctattcagcatgtacatcgctgacatgccccaaacaactccagaaaatttgaatatgcagacgactgggcttagcgtcaacataagagctttgagacaatggagtgacctcgtcgtccaacttggcgactggcgcatatttccggggccgagcctacaaaacgggacgtgcttccatatctgtaataaatcagcaggcagacgacgacgtctactttgagggaactcgctccggcataacggtatccaaagtacctcggagtcacattagacagaaccctcacctataagcgacatctggagaacactgcagccaaactag

SEQ ID NO: 2527 - DNA, 157 bp, unidentified
  source 1..157: mol_type = unassigned DNA; note = Description of Unknown:Locusta migratoria sequence
cgactgttcgcgtccgtagcaatcctcaagctacacgtgtcccctgggtggtgctaaagaacagtcacttcgaggcacgaagtcagagccagaagtcacggcagccagaccacttgtggactgtcctggctatcaaacacttgggctgattaatgca

SEQ ID NO: 2528 - DNA, 1745 bp, unidentified
  source 1..1745: mol_type = unassigned DNA; note = Description of Unknown:Locusta migratoria sequence
cccctcaggggctcagcattaatttgctgagtacgggcttggcgaacccggggtcctgagccgtgggctgtgtcgcgccaacagtccgctacaccgtaagctctgtgcgtgcttcaacgaccatcgttcggcgcgacggtggaacgttgtacgtttcagagcccggggatcttggcttaatcgcccgggtcgcgaggacggtacaaacctctataaaaaaaaaacctcaatctcaaggtgtgctactgccgaggagatgcatggctgttgaggttgaacagtcgctagcgagcaacctctgaggaacctgccgcacctcagttgtataaggcttacccaggcaagcggggctctgcctgggtggacttagttccctagctgctcgtgggacgaaatgaaacgagccaaatagcgtggtggacgtaaaccaccgtctccaagcgtggaagagttgctttaatgcagcgacgtatgatccccgaacgttcccttccctggccacccctgggaggaacggcgggctaaagacagggatgagcttactccccaagtatcttgtttgcagtcgaacagatggggaaactttcatgtcgacgaagccacttttcttcgtgaaaaccttgaagataagtttggtgaagtctcggatgtcaagatgaggagcggttcggtactgatcgaaacagcgtcatccgcccaatcgaaagcattgcttgcttgcgataagctgggtgacgttccggtcagtataacaccccacaaatcgctaacatgatccagggtctgatctatcacagggaccttcttttacagtcgatgagagctacgcgccaacctagagcgacggggtgtccacttcgtccggcgcgtgcataggggtccgaaggataatagggtagccaccggtgctttcatcttggcctttgaggcgatacattgcccgaaaaggtcaaggtcatgatctaccggtgtgacgtaaagccttatatccctccccctatgcggtgtttcaaatgctggaaatttggacatatgtcctccagatgtagctccagccccacatgtagggaatgcgggcgtccatcacacccggacgctccgtgtactcctccacctatctgtgtaaactgtgggcagcaacatccaccctgttctccagactgtaccgtgctccgcaaagagcgaaagattatggaatcaagaccctggatcgactgacatatacggaggcacgtaaaaaatatgaacggcttcacccagtttccatgacgacgtctttcgctgcagttacatcgtcgccacccttctgataacacctaccgtgcaacaaccttctgtgggcccaaagggccgtcaaagctcatctgcctcctcaaggtcgggggcactcctctcactgccccccactaccacctggggggcaactccacccccaccatcggggacaccagtccccacctcccagccggagaaggagcagcctcctccggctcccctcgctcggaaggggtccctcggggcactcccttctgaggcttctcctagtgctccagcgatccagccaatggctgaaggatccaaaacctgctggtagaagggcttcccgctcttcttctacccctggcgccgctacagagaagccctcccggccctgcaaacctaagggccagcgagagggacggaagaagaagacaaaagactcttcggtggctctaagccaccgctactcatctctacatcggacg

SEQ ID NO: 2529 - DNA, 47 bp, unidentified
  source 1..47: mol_type = unassigned DNA; note = Description of Unknown:Locusta migratoria sequence
gagcgaaaattatagccttactmaaccagtagcaaacsaagtgataa

SEQ ID NO: 2530 - DNA, 523 bp, unidentified
  source 1..523: mol_type = unassigned DNA; note = Description of Unknown:Locusta migratoria sequence
atgtacatagtcagaagtgctcaactgaacagcacatgtcctcttctcaatcggaattacagttactcactatcaatatgacacgtcatcgtgatgggagaccttaacatgacttgttaagagacactccatccacaataaactaagagattgctccaacaacatgaacattctgccattagaacctactcaccatacggagcacactcttatagatgtgatcgcaacgaaaaagatcgacaaagtacagatctaagtcaaacgtcagcccgcctctcagcacacgatgcagcgccaaaagttaaatcacgttatattactcgtagaaacgtgaaacaaatagaccgtgaggctctaacagccaactgctcagaaatctcatggcatcaagtaaccagagaacccacgattgatggaaaaatttttgaacttagaataaacttatttcctatatgacaagcatgccccctacaatccgtgtaagaaaacccctgctccatggctgactaaagaattacgtcaa

SEQ ID NO: 2531 - DNA, 1080 bp, unidentified
  source 1..1080: mol_type = unassigned DNA; note = Description of Unknown:Locusta migratoria sequence
tcgtttcagaacctggtctaacagttacttcagtaaatatagaaggcatgtcacaatccaagcaacagctgcttcaagaactgtgccatgaacagaagtttgatgtactgtgcatacaagaaactcacagagatatccatcaaatgcgaccgacaatacctggtttgcagctagctgcagaagtaacccatgctaaacgtggaggtgctgtttttgtcaaaccaggaatacgagtcttgagtgcatataactaaatgacaataacatcgagatcatcaccttggaacttagtaacagtgtgatcacttcggtgataagcggtcctccttccgaaaattctccttgctcctctaaaaacttcattcaggaaaaatatcttggtaatatgggatatgaaaatgtgaacccgttatgtctcgagctgaaaccaacacccwcactctcactcacgacagcaaactacctcatccttcaaagtgaaggtggcaacgtgacctctatttgtgagtgaaactagccaacagtgttacaatcaatgtgtaatttcatacccaccacacaacacgggtaccaataatgtgtcgaattcttcccatcataagaccccaagaaactggttttagacgaagggatagtttcaaaaaggcagattggccgaaattctccaaaatgctggatgaaaaagtttatacacttagcctgtgcctgaaagtatgaacactttttgagctcttaattcctcgcgagcattatcccaagagctgcaaacaaactacctgagggcattacttcagaaacagctaccttgctcgatattatacccaatatgataatcccattcagtgatgaaacccaaaacagccagatccgtcctctcctcagtctccgaggcaaagagagtacaatgcgagaaactcatggaagactgtgatatgagtagaagtagtcacaaggctggaggcttctaaaggcttaataatgacccttcacaggaatatgcaggaatattcgatctgataaaattcatacatgaaaacacctcattcaaccaggtctggtaagaagacatgtgagagataa

SEQ ID NO: 2532 - DNA, 295 bp, unidentified
  source 1..295: mol_type = unassigned DNA; note = Description of Unknown:Locusta migratoria sequence
aagttgtttgaacattcatatgcgggaaaagttattcacattgtttttacctctacgggaggaaatgtatcggtgtttacggaagttggataaactccgcagcagtagagtaaggttatgtgcttgtcgtgttgaagtgtccatattgttccacgtttgctaaggttgtgcaccatattaattctcctgccgccacgtatcaagcaacgtgctgcttagctcttgttcgtgaaaggatccactttatcgtcgtcaattagattttgtttccaaggagttatttcggcttcattta

SEQ ID NO: 2533 - DNA, 203 bp, unidentified
  source 1..203: mol_type = unassigned DNA; note = Description of Unknown:Locusta migratoria sequence
acgagtactactaaaaggattgcaaagaatactcacggccatcccagtagaaaagccggctttcgtsccagccgaagcgtgcagaccaagtcctgctcttactacacatattgaagcagcttccaaaagaaattaaaaactctgtggcctttttgacttgtcagcagccttcgataccgcctgggacaaggcctgctctataa

SEQ ID NO: 2534 - DNA, 178 bp, unidentified
  source 1..178: mol_type = unassigned DNA; note = Description of Unknown:Locusta migratoria sequence
gtattctgaactcaattgatttagtgaacaagttaaaagacttccctatcccccctagtgccaagctaatttcttttgatgccagcagcttattcactaatataccagttggtgagtgcctaaacatcctcacagacttactggataaatcaggagttaatccacttgtcacagatga

SEQ ID NO: 2535 - DNA, 483 bp, unidentified
  source 1..483: mol_type = unassigned DNA; note = Description of Unknown:Locusta migratoria sequence
tcaaaataaaaatagtgtaaagataacagacaataaggaactcaaggcgaaaactgaagcagtgatgacgaaagaagaaattttcatattgtcaacaagtcatggtaagggttagcaaaaataatgtcgatatccaatcagaatatagtcagtggaatctcaaaacctggagctcgttgcgagaggtactgaaaaacagtgaaactactgtaaaaagtggagtgactgtgtagtaattggtggtggtaatgatgtgtatagaaatgagagcagccttgccgtgaaagcacgagagaatcactaggaaaattgtcacaagcgaaggtatttttggtaagcattcctcatagacatgaccggagacgattcatgtgtaaataaagaaatcgtcacaacaaacaggaaattcaggaagatctgcagcagttttgtgcacactacctttattgaggctactagctctatcagagaacattttagaga

SEQ ID NO: 2536 - DNA, 933 bp, unidentified
  source 1..933: mol_type = unassigned DNA; note = Description of Unknown:Locusta migratoria sequence
ccccccagggggcccacagctcttttgtgggtacgtgtgtggcgcgcacgggtccccgagccattgcggccttccttcctgtttcccaggccgcttttcctcaccccggttccctcccctccctaatccttcttcccaccctacccttctccaaccccgtctctaggtgttctcgcgatgacggcccggctatttccacggtactgctggtttcgcaattgtgtctttgtttgccgttttcaccgatttcggcccagttaggtccccctcggggtttgacctccatcaaaatttcagagtaagtgtgagccatttggggaagaactcccaacctagcccctacggcgcggattcctaccctttccttccaaatccctcttcctcgccgtagctccctcccccgctaggtcaccagcacggtagccagtccgtgtggtggggctgttatgtaccctcatggttgagccccctgaattgcacagggatcacactgccgatgcctgagctgtgacctcctcatgaatgccaaggagtcgatgcttgtctctgcggggcatcaggactcccagcaacggtcatcctgccaggtggcgttgctgtggctgggtggcgcccttgaggagagcccctgtttcggagtgggtggcatcggggcggacattccgcaatgaagaggaaacaaacctctgaaaatcctggctctaagtcaggtgtctcaagtgtggtaagtttaatttcaatgctgcaagatacgaccccaaatcgtttccttccctaactccatcatggggggaacgtgggcccacaaagcagactgaaccatactcaccacgatacctagttgttaccagacaggatggggaatctttccaggcaactaagccttccttcttcgtcgaacacctcgaagaaaggtttggagaagttgccggt

SEQ ID NO: 2537 - DNA, 347 bp, unidentified
  source 1..347: mol_type = unassigned DNA; note = Description of Unknown:Locusta migratoria sequence
gggtacgacgtgtagacaacctccccgatggtgtaccctgggcgctgtaacatgggacagcggcgaaaagtctacacaactatggcggccggacgcacaaatgcctcccggtccactcaaaggcaaatggagcaagcaaggaactttaacatgaagagactgaatgtatgtcatttcaacatagaagactacacaaggacgaagggagaaatccttgaaaaaattttaacagagaacaagtaagtgtcgtacttctacaagagacccacctcacagatgaaactatcgaccgactcaaaataccgggattcactaatgtgagctacattggccacgacaagcgtggt

SEQ ID NO: 2538 - DNA, 39 bp, unidentified
  source 1..39: mol_type = unassigned DNA; note = Description of Unknown:Locusta migratoria sequence
ggacttccctcatagccaacaccgcccagtcttcattga

SEQ ID NO: 2539 - DNA, 48 bp, unidentified
  source 1..48: mol_type = unassigned DNA; note = Description of Unknown:Locusta migratoria sequence
aaccattaaattacccatttcaggctgtaatccctccctccacaatga

SEQ ID NO: 2540 - DNA, 151 bp, unidentified
  source 1..151: mol_type = unassigned DNA; note = Description of Unknown:Locusta migratoria sequence
gccatagccggtcccaagcccggttgagaaaggaggagggggaggagtaacacctcgtaaaaaaccttggttcacctggcccgggtgatagtacctgtgagggccccttgccagggatacggtgaagacctcaacggcagtgaaggcggag

SEQ ID NO: 2541 - DNA, 158 bp, unidentified
  source 1..158: mol_type = unassigned DNA; note = Description of Unknown:Locusta migratoria sequence
cactcctagggagctaccagtttccagtttcatcagctctgtggagcaagtagtcaacactctaccatcagtgttgcagaagagatcggagagagacgcagggcgctaccagagcaggccccaaaacaaacatctcaagagacgagaggtggcgctag

SEQ ID NO: 2542 - DNA, 481 bp, unidentified
  source 1..481: mol_type = unassigned DNA; note = Description of Unknown:Locusta migratoria sequence
gccctagctaagtctggcattgcttccactacttgtgtcagacttctgctttcttcgttcctatcggcctctcttggtcaactctgctgcttcgaccccgacggtattaggttgcgaggccgagggtgctttcattttcttttctaacacatggctgttaaccgaatggctcccggtataaggagaccaaccttaccaagtgccaacggccagtaaggggggatgagcggtaaagaaggggcacctccttgtccagggatgagaaattgtccctaaaggcggaggaaccattaacatggtcaacggcaggaggatgcagaaggcaacgggaaccactgcattaacgatcccatacaggattcccaaatagaaatatggctacgtccaattcaaaattttccggagtttcaattcccccattcggatctccgagggaaatgtcttgagcaaggctgtaaggagtaaaggaataaaagaacag

SEQ ID NO: 2543 - DNA, 453 bp, unidentified
  source 1..453: mol_type = unassigned DNA; note = Description of Unknown:Locusta migratoria sequence
tttaacagatgccggaatgaaggtattgttcctaagtttgctagaatagttcactaattgattctaatgcacaagattaagaagctgccagtcttgcgctagtacgtgaacgcttcgttttactcgtagacaactggattttgtttccaaagacttatattttttgcatcttgagatttcatcacggctttcggccgcgtcatgggagtgggttgatagcgcttcttgggccttttccgactcggcacagaggggtgctgcctgcaaacagttatcaaatttgagcgactttgcactcaacagacaattctggtgacgatttccgtcggcgggttgtgtcaatcttacagataaggaactggacaacgctgcattatcggttttggaaaaaggtttaaattttgcacccacacctaaggttgtccctattacggaatttatttgtgctgttga

SEQ ID NO: 2544 - DNA, 30 bp, unidentified
  source 1..30: mol_type = unassigned DNA; note = Description of Unknown:Locusta migratoria sequence
agaggctgccgtacctcatacattccgggc

SEQ ID NO: 2545 - DNA, 888 bp, unidentified
  source 1..888: mol_type = unassigned DNA; note = Description of Unknown:Locusta migratoria sequence
ccctcaggggctcagcattaatttgctgagtacgggcttggcgaacccggggtcctgagctggggactggtaagcgccgccagtcctctagacaccgtaacctctgggcacgcttcagcgaccaccgtgtggcgcggcggtggaacgttgtgtgtaccggggaatggggatcttggcttgaccgcccgggtcgcgaggatggtacaaacctctataaaaaacccttcaatcccaaggtgtgctacgtgctgatgggatgcatggctgttgaaggggaacagtcgctagcgagcaacctctggggatactgccgcacctcagttgtataaggcttacctaggcatgcggggctctgtctaggtggacacttacttccctagctactcgtgggaccgagatggaaaaattctaatttacccatgaacctcctagtgggatgggtgtaccactggggggtaccaacacccaaccaamcaagagggctmgggtagccagtcctccggattcaggttctcaaaaaaaagtttagtttatagtaacagaacacatgctgctmmacagaatgtgtttattgtcgtgaagagaaaagagggctcgtttgagaaggtgtcgcccttctatatccagaaaggtctcgagggaattgctggtgmtttgaaatcagtaaaacggttgcgtaatggsacattgttggtggaaacatcaacttcccaacaggcggccaacctacagacggctaagtgccttggggaatatcaaatcgagacggagctgcacaacacccttaactatagcaaaggcgttgtcacctgtagggatctggtggacattccagcggatgaactgaaggatgagtgggcttcagaaggcattgttgatgtgcaaaac

SEQ ID NO: 2546 - DNA, 171 bp, unidentified
  source 1..171: mol_type = unassigned DNA; note = Description of Unknown:Locusta migratoria sequence
gttcgtaagtttcccaggaacagaatggaaacgcccattcttgtaaaatcgaacctccagccaaactgacagctgaactccgtggcttctctccgatcctctcacagtgttctgccagcgataagggatgctacctgacgccgattatgatggaaaaccgacagatgttga

SEQ ID NO: 2547 - DNA, 991 bp, unidentified
  source 1..991: mol_type = unassigned DNA; note = Description of Unknown:Locusta migratoria sequence
gacgaacaacatgttacggaatagcaatgtatgtcaggatgaacatagctgattatagagtggtttctaaggactctacagacaacatttatatcttagcagtgacgatatgtggaactactattgtcaacatctataaacccccattagtcatctggcctacgcccccattcaaactttttactgaccctgccatctatgttggagactttaatagccatcaccatgcttggggatacaagaataatgatataaatggtaacattttacatgactggctgtccttgaataatttgtatctggtctttagtgcaaaggacaaaggaacgtttcgatcagcaagatggcagaaagacacatcaccagacctatgttttacactaccagtcaagctaatggaaatcaactggcaaacaggaaagttatagattcttttccacatagtcaacatacgcccattatcattgactatggcatccagataccattagtaaattcaactgccaaagctcgttggaattttaaaaaagtgaactggcaacagtatgctgacaaacttgatgtgactgttgactcatccctgtgcaatttaataactatgacagatttgctaaagctgtcagagaggtagcaaaaagaacgatacctagagggaggaaacaaatattccaggatggtccaatgatgtgatgagctatatgaggaatacaacttacacattcaaataaaacagcagacgaacttcttcaagctttgaatgagcacagaagaaggaaatggcaagaagctacagagagcctcgacttcacccattcgagtcgtaaagcgtggcagctattgaagaaactgggtgcagactaagcctgagagatgcaccataacgtcacacaaatgaagtcgcgacacgcttattgcaaactctaaagcatctgtgaacaagaaccgcactaggctggtgaagaacagttacgatccaaacgctctcagctag

SEQ ID NO: 2548 - DNA, 340 bp, unidentified
  source 1..340: mol_type = unassigned DNA; note = Description of Unknown:Locusta migratoria sequence
aaaacggccttgactatgcaaaaatgaagttcgcaaaccagaattgctttgacgtagctaacatagttagtaataattcatcaaatgctgtgtacatgatagttaatcttaaataataagctaaagaaccgatgctttaataaccaaatctgacaaaggttgttccttggttattgctagcaattctgaatatgtctctaaaaccttagaattttttaatgaaaataatatttcggaactgcacgaggacccgaccgcagaattacaaaaagaagtcaggtcggccgtcagtgatgcaaaatatttgcttaagccatttcataaaaaaactctcgttaat

SEQ ID NO: 2549 - DNA, 59 bp, unidentified
  source 1..59: mol_type = unassigned DNA; note = Description of Unknown:Locusta migratoria sequence
tagagaaacagtaggaaatgaaaaagcctgcatgaggtgtcaaagactataactttgcc

SEQ ID NO: 2550 - DNA, 642 bp, unidentified
  source 1..642: mol_type = unassigned DNA; note = Description of Unknown:Locusta migratoria sequence
acctgttacgctgtcgtaacaggcggagaggtgatactccgacgtggcgcgtcccaggtggcggatakgggggtcctaactggcttgccagcggacttgagcgaaataaaatagctctcgcggaccaaacacaaaccctctggattaacactccagttgtatctcgagcaatcctcggaaagctccaccactccaaccttacaaatkttatggattatcagtggaaaagaaaacaaattaccccagggagtaaaatctctcgacctccggtcgcaagcaggcatttcggattctggggagcctgcactttctgctcttgttttaccaagacaacctgaaaaacttaaattcaagamgaaatacagtatcggaacactgaacattaactcgctcatcaaaacaggaaaacataaagaactgactcaagcacttgagcatcatgatatccaaattctggcactacaagaaacccgctacactgacgaaaactcttttgaaacaggcaactacagaatttataaaggaaaaccagcagagtatatctttggaaaatgccccttattaggtacagcttttattgttagaaaaaatataacggagtccgtaataaacttcaattctacgtccaacaggctctcaaca

SEQ ID NO: 2551 - DNA, 414 bp, unidentified
  source 1..414: mol_type = unassigned DNA; note = Description of Unknown:Locusta migratoria sequence
agtcgccgagtggacgtcgtccagtgcacacctgtccagcgccagcacattttcagttgtaagtgtaaccggcttctctctagaagctacatattttgacttttcagtgcgctttcccttcagttcattaaagttattgtgtgctcgcgtttttatttgattcatattcacgttaaatatctggttagtgtattattccgccgtgtgaatcgcgtcgcgacagtcgtctgtctttgttttctgattagaagcgacatatagtattttgattttcgtctgcgcgttctcgtttcagtttgtaaatttatactgtgctctcgtgcatattagattcaaatccgcgttttaacaaacagtgtagtcttcctttgagcgcatcgcgactgtagtttttgttttctcggcactgtaatc

SEQ ID NO: 2552 - DNA, 351 bp, unidentified
  source 1..351: mol_type = unassigned DNA; note = Description of Unknown:Locusta migratoria sequence
ctctgaaagtactggagattctaggaaacgccaatacggtcctagaatcaatgaaaggaaaatcctgacattcacctccacggggtagagagggggcaacgtttgcatagcaagcggctaacgaatgcagggaccgaatatcccccgggataaggggatcccctataccaagtgccaaaggcctccatgagggcggatgagcgggtataggatagggcactctcttgtccttggagtgtgaaatcgctcctaaaggcggaagaaccagcaaggtcaacggcatagaatggagaaggcaagagggaaaccactccattaaagatccttttggatatcccatgtcaagcagca

SEQ ID NO: 2553 - DNA, 848 bp, unidentified
  source 1..848: mol_type = unassigned DNA; note = Description of Unknown:Locusta migratoria sequence
gatctttggcgtgacgtcacagtgctggatgctgtgcacatcgctctcgattttttataattttaggattaatatagttattttaattgttatttcgtgataatattcaatataaaggtgttctagaaaaggatcgtcagtaattttagcgtttgtagtgccgtattgctttaagtggtgttatttgtgttcgcgtgtgcggcaccgacgtcttactgctttgtttacatctggtggcgagtggttccagccgtagcggtctccgaaagctaagttccaataagtgtttgtgttattgtagttaaattattaaagtgactagattcaggaggtgttatcacgctagttgtttattaaatttagtacttttcaacaggtgacttgctgtttttaacgtagttgaggttgggaaactttaagttacggtatttgataactcttktactctcactgtgtttagttagtttattagtgacgcttgaatttgaacttgtttatacaagcaatagtgtaaagtttcatgtggtagtgttatttgttcttttctgatactattagttgttgttacttgattttgtagagactgaggtttgttgattgctgtagttaagaggtacttcctagttcttttgtagaaacgtaacttaataacttagacgtctagttttttaaatattgtgaaattttaccatgagtgaaaaatgtgggctctgtcgtagggtcgtgcgtagtgggctgcagtgtgggatttgtagtaagtattttcatggggggagtgcagtggggaagacagtgggcattgtggtgaggttctctcctggaactgtaggatttgcagcaggaataag

SEQ ID NO: 2554 - DNA, 237 bp, unidentified
  source 1..237: mol_type = unassigned DNA; note = Description of Unknown:Locusta migratoria sequence
cacacatgtagtgatgactgacactgttatcaataagtcaaaaagagtattgctcaagacgagatttccgtccttacaaaaggtggaaactatgctataacgcctgtggaagtacagttgaggatattattgcgaatgtgaagcaggaataagaactctcccgaaagaaactgcaaatgcaattcggattgaaaccaccagagtactatgtcgcagtaacctctgaaaagtaatttg

SEQ ID NO: 2555 - DNA, 268 bp, unidentified
  source 1..268: mol_type = unassigned DNA; note = Description of Unknown:Locusta migratoria sequence
cccgtgtggagtttgctggtcttccatcgggcacctccccaggtggcggataggggaatgctcaccagatatggtgggtaccggggaaataaaatacccggggtggaccaaaaccagcaactgctgccttgtagtatgatattggcttatcaaaggctaaaggaagaaaaccttgaatacaaattacctggtcctccaggttgggggttgtgcagtgggccagctcctcactcacataaaaatataaaatgctaaaaaacctaataat

SEQ ID NO: 2556 - DNA, 147 bp, unidentified
  source 1..147: mol_type = unassigned DNA; note = Description of Unknown:Locusta migratoria sequence
aaatcacagtaaaagtagctaatgctctagaaaataaatctaactacatgtatccaagacacacagaatttttgtaatacagaacgatcaactctaaaaaataaaccacaagttaggcaaataatgttatagaaataaagctgataa

SEQ ID NO: 2557 - DNA, 520 bp, unidentified
  source 1..520: mol_type = unassigned DNA; note = Description of Unknown:Locusta migratoria sequence
ccctcggaataccaccttaacgttggtggggaggtttgtgtgtgtcagtgatccactgagctatgctggcgggagctgtgctcccggtagggtcacccatgccagacaggtcagttggtgagattccagacaaagagtattccccctagggggctcctgccttgggagtatgtgggtggcaaccacatgggcccttagctaagtctggcattacttccacttacttgtgtcaggcttcctctgcattctttcctatcggcctcccttggccaactcttgatttttccgaccccgacggtattaggtttcgaggcccgagggagtctttcattttccttcttctactcttattgtcaactgctgccttgtagttagaagtgggaacttcaaaggctaagggaagaaaccccgacagaaaatcagtaggcctggctacttagaaggcagccccttcaccaggctatgggtgctgaaggctaataacctacacacccgagattaaactattacagaaacatca

SEQ ID NO: 2558 - DNA, 174 bp, unidentified
  source 1..174: mol_type = unassigned DNA; note = Description of Unknown:Locusta migratoria sequence
ggtggtgctaaatgagtaatagcaacaagatgagacggaactgcccgaaaaggcctcccggtcaaagagtgcagagcaaacaacaagaagtccttttcaggatgcacaagttcgtagaattggaccatctattcgcatactccaactkaacatagaaggaataagcaggtcgaa

SEQ ID NO: 2559 - DNA, 623 bp, unidentified
  source 1..623: mol_type = unassigned DNA; note = Description of Unknown:Locusta migratoria sequence
cccctcaggggctcagcattaatttgctgagtacgggcttggcgaacccggggtcctgagccgtgggctgtgtcgcgccaacagtccgctacaccataagctctgtgcgtgcttcaacgaccatcgttcggcgcgacggtggaacattgtacgtttcagagcccggggatcttggcttaatcgcccgggtcgcgaggacggtacaaactctataaaaaaaacctcaatctcaaggtgtgctacgtgccgaggagatgcatggctgttgaggttgaacagccgctagcgagcaacctctgaggaacctgccgcacctcagttgtataaggcttacccaggcaagcggggctctgcctgggtggacctttagttccctagctgctcgtgggaccaatgaaacgagcaaataaagcgtggccggcgcaaaacggcgtctctaagcgtggcaaaacgagttcaatgcgtcactatgaccctaagacgtttccttccctgccaccccgtgggaggaacgaagggcccttaatagatcagagccatactcgccacaataccttgtatgtgcgcgttcagatggtgaatccttcatgaccactaagcccagttctttgttgaacagctga

SEQ ID NO: 2560 - DNA, 1043 bp, unidentified
  source 1..1043: mol_type = unassigned DNA; note = Description of Unknown:Locusta migratoria sequence
caagatggcgccaggtggaaagtactcacgtaacgacgagatttcatagtgacgtgtgtaaaatctgcgaaaaaaagttaaaagaggtatcgtatgtgttgactgcaagtcttggtatcatgataaatgtgtaaaagtaaatctaaatacataaaagagatcatgactggcatgccggcagtgcattgtgaatgccacgaaaagtgaactagtgaatacactaaagtcaaaagaagaaataatacgtgtgctgacagacgatttagtggctataaatgcaaaacaccaagaacttctgaataaatatcaagaactagtaacgaaacacaaagaagtggagcaaaatcattgccaagaacaagaaaatattattgttaatggacgttctgtgcgactaaggtggcatgtaccaaataaaaamtgcaaacaaatgataagtgcagctccggcgttaatgctttcaaataaattgccggtatagaagattttggctctgaaacagaagtcgcgaacgatctccagtgacaaattaccatcagaatgcagtacaagaaatcgaattctattgcaaaacgtgaaaaaacgggttctgatactggtgacagccacaccaggaaaatttccgagaaaataaatgaatataacacactttctatggccacaggaataacaaagccgagtgcgcctctatgtgagatactgagaaacagtaactcagtctgtgactcactaataatgattttgtcattatcatgggaggcagaatgatgtctatcgaaatgagagtaaaaatkccacacggtgtttaaaatctacactgcgtgatcttaaagtgccaaaatcatagttactagcatgcctcacagatatgacctgcaagaaaactcaattgtaaatatggaacttgcaaaaataaacagacaattccacaaaatgtgcaagtccttccaaaacktaacgttctgtgagcttccaaattcaagagatctattcacaaaacatggacaacactasaacacgctgggaagtcatacattggtaaa

SEQ ID NO: 2561 - DNA, 432 bp, unidentified
  source 1..432: mol_type = unassigned DNA; note = Description of Unknown:Locusta migratoria sequence
cccctcaggggctcagcattaatttgctgagtacgggcttggcgaacccggggtcctgagctggggactggtaagcgccaccagtcctctagacaccgtaacctctgggcacgcttcagcgaccaccgtgtggcgcggcggtggaacgttgtgtgtaccagggaatggggatcttggcttgaccacccgggtcgcgaggatggataaacctctataaaaaaaaccttcaatcctaaggtgtgctacgtgctgatgggatgcatggctgttgaggtggaacagtcgctagcgagcaacctctggggatactgccgcacctcagttgtataaggcttacctaggcacgtggggctctgtctaggtggacatttacttccctagctgctcgtgggaccagcatgaatatttctttgtttttcccctcccagtggg

SEQ ID NO: 2562 - DNA, 131 bp, unidentified
  source 1..131: mol_type = unassigned DNA; note = Description of Unknown:Locusta migratoria sequence
gagaagcctccccgcggaacatattaatacgttttggcgtctcccgggacggcggcaaattcctcaaaccagaacatcaacacagtcattaaaatgcctcataaagaacccaaaagctcttttcagaacca

SEQ ID NO: 2563 - DNA, 299 bp, unidentified
  source 1..299: mol_type = unassigned DNA; note = Description of Unknown:Locusta migratoria sequence
gggggtcacagcagaagcgttcccgttcgcgacccctgtcgagtctgataccagtctggtatcagtccgcgaattctgctacaagacgagctacatcggatcaatatgccgaaacaaaaagatagccaaaagagtggactcgttttagagcccacctgacaattatttcgctaacatcgaaggaatttcagtatccaaacaagatttaattgcagaaatctgcagaaccaacagctgcgacgtcctgtgcctacaggagacccacaggggcctctcaaaataagccaaacattgtaggt

SEQ ID NO: 2564 - DNA, 444 bp, unidentified
  source 1..444: mol_type = unassigned DNA; note = Description of Unknown:Locusta migratoria sequence
ttctcggtattgtaatcatgaatagggactgtgactgctgtgtgcggatgcagtctgagctggtgacacttcgctcccagcttcaagctggaggctgcggtcgaggggcgtcgttgttgttggccggtcgtgggacaacggatccgttccaccgatcggcctgcggcagcgacatgccctgatactgccagcaatgaggcagacaccccaccgtggttgcgtgggaggtgtccagtgcgtggcaggcggcgaagacattccgggggaccgatcgtgaggcctccccggttcgtcttgcgaacaggtttgaggcgctatctgttcggacaatgttcctgagccggatggtgtcgctcatcctgaagtcaccacgcagcctgcagatccgggctttcacagagggtgggtttgcttgtagttgggagctccaacgttaggcgggta

SEQ ID NO: 2565 - DNA, 215 bp, unidentified
  source 1..215: mol_type = unassigned DNA; note = Description of Unknown:Locusta migratoria sequence
cttgatgaagaaagacggatatataaataaaacgcttgacttctttaamtgcaaataacattacacgtatagacaaagaccctacaaaccgatttcaagctttgataaaaagagctataaaaatctgagtttcttttaacacaaaaagaacaaaacagatatatagttgtgaatccacaatgccccaagctcagagcacaaccaaaggtccataa

SEQ ID NO: 2566 - DNA, 118 bp, unidentified
  source 1..118: mol_type = unassigned DNA; note = Description of Unknown:Locusta migratoria sequence
gggggcgaagttgttcgcgtccggaagcaatcctcaaagctccacgtgccccctgggtggttctaaacggacaacaatctctggtagctggtcctgtcaccacggtgatctcccagct

SEQ ID NO: 2567 - DNA, 425 bp, unidentified
  source 1..425: mol_type = unassigned DNA; note = Description of Unknown:Locusta migratoria sequence
aatatgataaacaaattagaaaacacaaatgtaacaatagtaaatcaacctcgcgacatgacgcgtaaataaattaatagaaaaagtaaacaaagaaattgatgactatgcaaaaaatttcggtatgtaaacttgattgatgtaagcaagttagagagatctatgcataccagtcatggtcttcatctcaattacagtgggaaacagttcttagctgaagaaactgtaattcagtaaaatttaaccacaagaggtttaatctggaagctgtacaaagtactttggacaaatgggtagtaaggaaggaccaggtctcccagttgtcaaatacgtggccccagtgactgaagaaactaatgctgctgcaagacctgaagtcctgaagacgccagcccaacaccaaaatggttttctagacaaaataa

SEQ ID NO: 2568 - DNA, 610 bp, unidentified
  source 1..610: mol_type = unassigned DNA; note = Description of Unknown:Locusta migratoria sequence
ggggcccacagctcttttgtgggtacgtgtgtggcgcacggggccccgagccgaagcagccttccttcccgccccaggctgcttcagtccccccccccggtttatgccttcgcccggagacgggtgtcccgtgtgagtttaggtggtctcatgtaccagcttttttcttttctcggtttctcttctcctaacctttgcttccgcctttccctccttactgtactcttctagccttcctctcctcctttagtctccgcctcggcgtttgagactcaacctttcccacttccttcttctttccttctttcctctttcttcctccctgtgcgttcctgaaggccgcccacgcactcgctgcgtaacaggtgactgggtaatgcgtaagtcccagccccgggttggcatgtagggcccgcacgtaccccctggtaaaggccaggcccagggaggggtgattacccgagctgataccttccgaccgtgccgattggtccctccgtccgtttctcgggaggtgtgacctgaggtgtggacaatcacctaaggcgggtgagccctcagtgagggttccccattaggaaggagcgcgccatcggagacgccggtaatc

SEQ ID NO: 2569 - DNA, 176 bp, unidentified
  source 1..176: mol_type = unassigned DNA; note = Description of Unknown:Locusta migratoria sequence
ccaaaccatcactggaacaacaaccccactagaagcaactccataattgaagtacacagtcaacaaaaactgaactaccagcatcagaggcaactgctatgcctcagcaccactgacagcagcaacaggaccaactgcaacaccaacccaacattatcaccagtaacagcagctaa

SEQ ID NO: 2570 - DNA, 605 bp, unidentified
  source 1..605: mol_type = unassigned DNA; note = Description of Unknown:Locusta migratoria sequence
caaaacggcggacgactatagggccatcacagcgaagtttggggcgcttgataagcccttctatacatttccttctgccgccgacaaaacattgaagattgttttccgtggcctgcccagtaattacagtctggaacacataaaacaacaattgtcggacatggggtatggttttcgactccgctccgtgactcgggtgaattctggacgaacgaggaaagagacaccactggtcttggttgtcacctgtgacatacctcataacaggggtctctggcaagttaccaggatcgctgcgacgcctgtcaccacggaaaaactcagatcaaagcggggtgaaccacagtgctacaactgccaagctgtgggacacgtcgcccgattttgctaattacctccgcgctgtgtgaagtgcgcgggagaacacgccagccgagattgcacacggaagaaagaagacggcccacccaagtgcgttggttgtggtggggaccacgtcgcctcctaccgtggatgttctgtattcctccgggctgctgtaaagagccgcggacaacgtcctggggccactaggaaaccagcgacagtacgcccaggagtaagtt

SEQ ID NO: 2571 - DNA, 248 bp, unidentified
  source 1..248: mol_type = unassigned DNA; note = Description of Unknown:Locusta migratoria sequence
gggggatggtgttattcgcgtccgcagcattcctcaagctgcacgtatcccccggatggtgccaaacgaataacaattctggtagctggactgtcacaccagtgatctcccagctatgtcagctacccaccaaaatccaaatggaccttctcaggaccaacataattttaagaatatagtccagttctcagtgtttgtcattttaacgccgagggtttgagcaaatcaaaatgtgagtgtctaagtaa

SEQ ID NO: 2572 - DNA, 65 bp, unidentified
  source 1..65: mol_type = unassigned DNA; note = Description of Unknown:Locusta migratoria sequence
gggcgaaacgtcaggggaaagtttcatgtatggaccacggcatctcagcccggaagctttaagta

SEQ ID NO: 2573 - DNA, 420 bp, unidentified
  source 1..420: mol_type = unassigned DNA; note = Description of Unknown:Locusta migratoria sequence
accaaggtgctgctgcacagcaacaagtatgcaagtaaacctacaatgaatagtccttttcaggaccaaccaagctcagaacacccagctcatggtaacaacttaagaatatgtcacttgaacatgagtcgatttcatctgctaagactcagatctttcacgcctgatgctgaatcggtgtgcaattcaggaaccaaccaatctacagaaaagaaatcttttggatatgttctggctgggctataaatgtgacagtaggcattgcaacatatgtcagatccatttctctacaaaatcatcataagacaaacatcagagtctgtcttggctatagagatgcaggcacactattgcgaatatctacaaacctccgcttatttggcctaatccactgttaggtccttcatcccccagttgtgt

SEQ ID NO: 2574 - DNA, 539 bp, unidentified
  source 1..539: mol_type = unassigned DNA; note = Description of Unknown:Locusta migratoria sequence
cttcccaggggacacagccttgtagtaggcaccttcagtgccgggcgggagggcttgcgtgcttccgtgaagttgagagctgtgccggcagtagcgtagctactggcagggtcacccaagccgtattggtctcaactgagaagccagacgaagagtgtcccacaacatagggcagggagggctctagaggcgtagtgaagccagcttccctaggggaggaaaccttatacaaatcccggtcctccaggttgggggttgggcttgaggctaacaacctcttcctgtaaaaaaagtcaggttatgaaaacccaaagagcagaagcggacagatcaatagacgacgacatggcacggatattggacaacgaatggttaaaaagctgaaaactgatcttgaattggtacctggaatgttcgatctttatatagcccaggcgctctaaagaagttattagaccagcaggggaagctcaaggagagcattattgccatccaagaaattcgatggacagggacggggtattggaaaagaaggcact

SEQ ID NO: 2575 - DNA, 129 bp, unidentified
  source 1..129: mol_type = unassigned DNA; note = Description of Unknown:Locusta migratoria sequence
gggtgcaatgaaggagcctccccaaagattgcgacagcaagataaaaaaaaaaccgcaatcgggcgcaccccgggcaacgttgatcatcagcggctaatccttcaacaaccggaacggacttctgagaa

SEQ ID NO: 2576 - DNA, 458 bp, unidentified
  source 1..458: mol_type = unassigned DNA; note = Description of Unknown:Locusta migratoria sequence
ggcggctagcgtgaaaatacggaatgtgactccgcgaaaaaacgtgaattttagtgttaaaaataaacagtgtgtaaattgtaaagccgaaattcaaagctaaatgaacgtgtgtccagtttacagcttattatcagcgcactgaagatggatattacgaaacttaaagatgaaatcagtgaactaaacacatcaagatcgcgccatgatatttcgactctgtcggaaaagttggcggaagtaaagttaaaggatgcaaacaaaaagtgaaaaagcaagaaaacagtgaaacaaagaaaaktgtagtgcacgaaaattacttccaggttcttacagatacggtttgtgatatcgctgtgacaaatgcaagtaggccaaaacaacataaaaaacaaaacgaatccgtaaaaaacaatcaaagtgcaaataaacaaaatstaatacaagtgacagaaaag

SEQ ID NO: 2577 - DNA, 435 bp, unidentified
  source 1..435: mol_type = unassigned DNA; note = Description of Unknown:Locusta migratoria sequence
cagggacaagcatcttgcgtgacgtggtggcgagcatggggacccaagctggcctggcattgcttccccttacctgtgccaggtccctcctgttatctttcctatcgaccaccctcggtcaactcttgttcatttccgaccccgacggtattaagctatggagtcttcattttcctctctcagtgcaaggtaacaggaaaccaccactgacattattttctctagacgctcatggggtgacctctttgtaaaagatttggaggtaaagcttcccctcaatcggatctccgggaggggaatacaacgaggtttccagacataaggagagatggaacaggaaggaaggagaaggaaaaagaagaattattgaggataggaacgtggaatgttttgacccttttgcaggaagggaaattagaaaacgctaaacatgaa

SEQ ID NO: 2578 - DNA, 94 bp, unidentified
  source 1..94: mol_type = unassigned DNA; note = Description of Unknown:Locusta migratoria sequence
ggggacacagaaggagcctcctagaagatcgaaagatcgggcgtccctggaaacggcacacagccggmtaatccttctaacaccagaacaccag

SEQ ID NO: 2579 - DNA, 142 bp, unidentified
  source 1..142: mol_type = unassigned DNA; note = Description of Unknown:Locusta migratoria sequence
cctggtcaacggtctcaaaggcggaagaggaatcttagttcccaaggagaagagcggaagaactaatggagaaaaccatgaaaaataatcatttcggactaacaatccgatcttatcttggaatttacttcctccctgtaca

SEQ ID NO: 2580 - DNA, 421 bp, unidentified
  source 1..421: mol_type = unassigned DNA; note = Description of Unknown:Locusta migratoria sequence
gctaataagcataaacattgagcgcttggccaacgataagcaggagctgctctcggaatgtgcagaaatacaaatgtcacattctgtgcatcagagacccagacaccaattaacctcgtccaacataccaggaatgaagcttgtaattgaggtatcacacaaaaaaatatggtagtacaatctatgtagaaccggaccaaattataacatcagtgggctcaacaaacatgacaatttagaaattctaacagtggaaactgacaatgcacaataacaagtgcgtacaagcccctagccaaaaattcatattaatgaacacataattttagaacaaaataacaactgcttcatcctgggtgattttaacagccatagcactacatggggatatgaagaactaacaccaatggaagtcttgtag

SEQ ID NO: 2581 - DNA, 248 bp, unidentified
  source 1..248: mol_type = unassigned DNA; note = Description of Unknown:Locusta migratoria sequence
tcttaaacgaaaatggctaaaaactacggccaacataaatttcaacaaggcttgtgtaaagaataaatgtatcccgaactatatcaagtttaagatatgtaatccaaagtccaatgtaggtagggcagtggttgataaagcgcggaaattttggttgaattccgaaattaaattcctccataagaaaaaagattgtattagtgggcaattacttaaggcgcatttagaagcagctagtgcggtacaca

SEQ ID NO: 2582 - DNA, 411 bp, unidentified
  source 1..411: mol_type = unassigned DNA; note = Description of Unknown:Locusta migratoria sequence
cccctcaggggctcagcattaatttgctgagtacgggcttggcgaacccggggtcctgagccgtgggctgtgtcgcgccaacagtccgctacaccgtaagctctgtgcgtgcttcaacgaccatcgttcggcgcgacggtggaacgttgtacgtttcagagcccggggatcttggcttaatcgcccgggtcgcgaggacggtacaaacctctataaaaaaacctcaatctcaaggtgtgctacgtgccgaggagatgcatggctgttgaggttgaacagtcgctagcgagcaacctctgaggaacctgccgcacctcagttgtataaggcttacccaggcaagcggggctctgcctgggtggacctttagttccctagctgctcgtgggacgagaatgaaacgagcaaata

SEQ ID NO: 2583 - DNA, 783 bp, unidentified
  source 1..783: mol_type = unassigned DNA; note = Description of Unknown:Locusta migratoria sequence
tctcctggcgaataacaacttcgaaaaactacgggtatgctgccaggtatcaaaatcgacgtcaaatttttcgaagctgttattcgccaggagaaattaaggaatccattactctacggggaggaaatgtatcgtttttgcggaagtcagataagcttcgtagcagcagggtcaggttgcaatgtgcatgtcgtctttgttggaatgtcgtgataatagtgttgttccaacttttgccaaagttgtgcacatatcaattctcctgccgctggtcgcattaaacaacgtgcaggcttagctcttgtccgcgagaggattcattacacccgccgagaattggattttgtgtccaaggaattatttcggcttcatttgtacattgcctctgaaatttcggaattttcttgggactggttggacggtgcttcctggtcacaatccgattgggaatttcaaactgtaacggcccggcattcggcgaagtttgaacggttccgtagctcagggtctgcttttacaactcgacgttctgtgattaatctcacagagaaaacctttgacgacgcagctctatccgttctggggaaaggtttgaattttgcaccgacgcctaaacgtttacctgttgttgattttattagttctatcgaacaggctgtttttaaactaccttctgacattaaagaggaggttaggagggaagcttgtcgtgtgttgactagggcacgtccgcctgtgagtaatataacagcagctgaggcagctgccttacgttcacttagg

SEQ ID NO: 2584 - DNA, 299 bp, unidentified
  source 1..299: mol_type = unassigned DNA; note = Description of Unknown:Locusta migratoria sequence
tgcatgaacagtgtaatactttaagagcaatatttttggacctaaattcatttacagtaagtgtctagcacaagatggactgcatctaaataggctaggcacaaatacttgtagcaaagtattggagatgtatgtgtgtgataaaaacaagggaaactaatgtataggcagggggtgaaaatccagacaagaatacaaaaagactacaacctctgtgaactagagcatgtactagagatatttaaggaaaacaaagtaagtgccaaccaagtaatcagaaaaaagtgtattattatttt

SEQ ID NO: 2585 - DNA, 338 bp, unidentified
  source 1..338: mol_type = unassigned DNA; note = Description of Unknown:Locusta migratoria sequence
tcacatcagaaacctctacggggaggagatggttgaatcgtgggaagactggataaacttcgcaagaagaagggtaagctgctgagcgctcttgcttttttattgagatgtcgtagtgaaagtatcataccgaagttcgccaagtttgtgcattacattgatcgaaagtggccaataacatcaaaaaacgtgctagtcttgccctaataagggagcgcattcgttttactagaagacaattggatctcgtatccaaggacttattttatttacatctagaggtatcttcacggctgtcggctgcatcttgggaatgggttgatagctcttcgtgggct

SEQ ID NO: 2586 - DNA, 261 bp, unidentified
  source 1..261: mol_type = unassigned DNA; note = Description of Unknown:Locusta migratoria sequence
ttgcttgtctcctaccgagcgcctccccaggtggcggatagggggatgctcaccagatatggtgggtaccggggaaataaaatacccggggtggaccaaaactagcacaagggcacgacggatccatatgtcagtggcggtaccccaacagcgtctgttccacatgtcagtggcggctgatcagtatcctctgtggctaactaccatagttgtaacacggagctcgctccactcaaggttgatagcctctgacagtcaatc

SEQ ID NO: 2587 - DNA, 600 bp, unidentified
  source 1..600: mol_type = unassigned DNA; note = Description of Unknown:Locusta migratoria sequence
caagatggcgtcaaaagttcagtgcagtgacacttcgatctcctcaaagaagcagttatacaactcttctgcttgtaaaaagtgcgataaacgcgtaataaaaggtattctgtgcgtcacatgcaaattttggatgcatgaaagatgtgctaaagtgaaccttaagttcgtaaatgacgagttkccatggtcgtgtggcgaatgtttatgtgatgaacggaatgaactgttaaacacaataaactcgaaaaatgaaatcatcaagatactaaataatgacgttgaagaacttaaaaaggtaatagttgcgttgaaagaagaaaatgcgaaacttgcaagtgatggaaatacacaaaagtgcgaaaagaatgtatcactgtgtggaaaaaaccaagaaaatccaagtgtttctaattctggaaatgatgcaacagtaaacaaatcgggtaggcctagcgtggaaaagtgacaaacaatgccacttatgcggatacaacaaaccaatacaaatggactgtcgtacagcacaaaaagagggacaagcaggaaaagaaagaaaaagagaacactaaaaacgacttcttaataatcggtgattcc

SEQ ID NO: 2588 - DNA, 90 bp, unidentified
  source 1..90: mol_type = unassigned DNA; note = Description of Unknown:Locusta migratoria sequence
ggggtacatgaaaggaacctccamgaagattgcaataatagaagaacaagaaatgaacagcaatcgggtgtacctgggcaacgtcagaag

SEQ ID NO: 2589 - DNA, 133 bp, unidentified
  source 1..133: mol_type = unassigned DNA; note = Description of Unknown:Locusta migratoria sequence
gggggacttgaaaggagcctcccagcagaatgtgctgttaagctagcatcacattcgggcgtcccctgggcaacggttttttcttgccggccaatcctttcaaatccagagacatcaaggcatagctagtgta

SEQ ID NO: 2590 - DNA, 545 bp, unidentified
  source 1..545: mol_type = unassigned DNA; note = Description of Unknown:Locusta migratoria sequence
tggcggcctgtatagatgtactaataagtggctctgtgaaaaacgattatgttgtaaatataaagtgtattttgtgcagtgaaaatgttctcagtggcattaggctgtgttcagtgactcaaaagtgggtacatacgaagtgcatagcatattttgacactataaacacaaaatgtaattgtggcgtaattcattgtgatttgcaattggtagctttagcaaaatatgatgctgagcgggaagaaaatgtgctatttacgatagaacatgacatattgatcgttaaaaagtactcaaacaacttggaaacattggcaataactcttaacgaagaacaaaacacgaaagagcatccatttattaggcctaaatggagctggtgttcgaaacagaacgagaaagaaaaacatcttggaaaaacaaatgctttagcagtagaagcagttgcgcctaaacaagcaaaaacaagaagtatttcgaagaaacaagaaaaagcaaagctcctacaaaatgaatccatcaacacagaaaaagagaaggaagag

SEQ ID NO: 2591 - DNA, 209 bp, unidentified
  source 1..209: mol_type = unassigned DNA; note = Description of Unknown:Locusta migratoria sequence
gtggagttgctagtctcccatcgggcacctccccaggtggcggataggggaatgctcaccagatatggtgggtaccggggaaataaaatacccggggtggaccaaaactagcacctactgccttgtagttaggtattggattaccaaaggctaaaggaagaaaaccttgatcaaaaattacctggccctccaggttgggggttaatgca

SEQ ID NO: 2592 - DNA, 1068 bp, unidentified
  source 1..1068: mol_type = unassigned DNA; note = Description of Unknown:Locusta migratoria sequence
gccatagccggtcccaagcccggttgagaaaggaggagggggaggagtaacacctcgttaaaaaaccttggttcacctggccctggtgatagcacctcgtgagggcccctgccagggtacggtgaagacctcaacggcagtgaaggcggagatgaagatcatcggtacggcggaactggcggaagaggcagccctaatccactagcgtctgccctggaatccagcggttagtggtcagcgtctgttcacctagttggtgcggctgctcctagttcttcttgatctcaacaatcaagtcgtaaacatgtgaccttcgtagaagatcaccaaaacaagtttcaacttgaataagcatgatggaacaaaaggaaagaattccactaccccaggcatcagtctctagactgaattctcctggtcatcggatctgggggaccaggaacttcatgcgcagaagagtcggagcttctcaaaatctctaagaccaaaacagaaaaacttcataggaactctcaacacaaacacactctcaaaagtaggtaaacttaaacaactcacaaacactgtggaaaaattccacataaaaatccttgcgattcaagaaacacgatttaccgacgaaaatcattttgtacaggaaacttcagaatctacaaaggaaaacctgmaatccagttgaacaaaggacccaaacaatttggcacagcttttgttgtgcataaatcaattacagactcaataataaacttccattcaacatcagaaagaatatccacaatctcattaaaatctggaaacaaggcatacacactgataaatgcacacgctcccacaaatgattacaatagaaaagacccacaggtaatagaggacttctgggaactactggaggaaacctcaaataaaattcctgcacatcatgtgaaaattcttttaggagatttcaatggacaactcggcaaagagaaaaaattcaggaaaacaacgggaattcatacagctcacaagaggacaaataaaaacggcgagagactgataaacttctgtgaaaattttgatcttaaaatc

SEQ ID NO: 2593 - DNA, 376 bp, unidentified
  source 1..376: mol_type = unassigned DNA; note = Description of Unknown:Locusta migratoria sequence
ctggttcactttaggatagtgctgttttactattaatctcatacttacattattaattacggtaccatattaggtttaaattcaattttatatagcgttggtctcacgcatcattggcaattgctcgctctactatcgatattgttatctttatttagtgttgttccgtgcagattacttttactgtgcttggcgagattctcccccccccctcagcgccccgccctcggcgaacggccggcgaccttggctgcagcgcctccctgtccctcccctgtcctgaacccacctgacctgcttcgctctctctctctgctgtcctgcactcctcccccgaccccccggaccgctagccacccagccacgccacattcca

SEQ ID NO: 2594 - DNA, 1764 bp, unidentified
  source 1..1764: mol_type = unassigned DNA; note = Description of Unknown:Locusta migratoria sequence
tagttattctcgcatatttgataaatactgtttgatagccttgtctgtggctggttttcaaaacaagtcagagaccttactacagtcgttatcagtcagtccagtgccagctgttgccagtgtcacatcgtaaacagcgctaagtatctaatttaatttgtgtcaaatttaatttgccagtctagttcttcattttcgttagtacttctgttttaagaggtttattctcgcgtacttggcagatttcgtttgtgctactgttttaatagtttattctcgcgtatttgataagtactgttgggcgcgtcagcagcacacagtcagcagcaccagcagagttacagctaagcaggagcgaactattgtgacttatttgtgggctgagcagtgtcaatttctataaactcgcgctagtaacaagatacttaactctctacaggcaattgttgatttgttaggatggataggatgtgtgactgctgcgtacggacgcaggaggagctggccgctgttcgcgagcagctgagcgtgctgttggccgcggtcagccgtcttcaggctgctgcctcggagtgttgcggcagtgggggctctggtgcgtcgcatgggacaccacaggtgttacatgcttcacccacggtccctgctgtcgggacatcttcgcgcgtgccggacgcggttgagccaccctctcctcaaggggtgtggcgggttcaacggcgttcgcgtcgctcggggcgaaaggtcaatgtggaggctggccgtgcggcgtcgcccgctctgcctgtgagtggacatgtggccgctccttcagcagggtccgagcaggcacacggggggaggggtwtattagtgattgggagctccaatgttaggcgggtgatggagccccttagggaaatagcggaaaggtcggggaagaaggccagtgtgcactctgtttgccggggggtctcatccgagatgtggaggaggcccttccggcggcgacagagagcactgggtgcacccgactgcaaattgttgctcatgtcggcaccaatgactcctgccggctgggttcagaggtctcctcagttcatacaggcggttggcggagttggtgaaggctgaaagcgtcgctcgcggggtggaatctgagctaactatttgtagtgtcgttcccagaaccgatcgcggtcctctggtttggagccgagtggaaggcttaaaccagaggctcagacgattctgcggagatctaggctgcaaatttctcgacctccgctatcgggtggagaaatgtagggttcccctgaataggtcaggcgtgcactacacgcaggaagcggctacaagggtagcggagtacgtgtggagtgcacatgggggttttttaggttagagaattccctccctaggcccgacaagacgcctcctgagccgcgacaaggtagcagtaggcagaacacaacagggaatgaaaagatcaatgtagtagtagttaactgcaggagcgtctatagaaaggtcccagaactgctctcattaataaacggtcacaatgcccacatagtactagggacggaaagttggctgaaaccagatgtaaacagtaatgagattctaaactcagactggaatgtwtaccgcagagataggctgsacagtgaagggggaggcgtgtttatagcgataaaaagtgcactagtatcgaaggaaatagacggagatccgaagtgtgaaataatttgggtgaaggtcacggttaaagcaggctcgaac

SEQ ID NO: 2595 - DNA, 1259 bp, unidentified
  source 1..1259: mol_type = unassigned DNA; note = Description of Unknown:Locusta migratoria sequence
agtttttctggmtggatcaaatgatgtagcgasaaatgaaggaaaagacttgttgttatcattaaggaagaagctgcaggaactacaaaatacaaaaatcctcatcttttcaacaccatttcggcatgatcttaaatcctggtcatgtgtgaatgtctaagtaacgagagtaaatgaagaaaatttgtaaacacgttaaattgttgcttttgtaaacataattaacttaggtgaaatatttcatacagstcatkgcttccatctaatcactggaaagaagatgtgagtaatgaatcataaatctagccatgagttattatacacaaatcgataggtcagatcaataccacttagatttaagggaaattcttttttagaggtagaaaaagggctgagccaactggtttgcccagattcacactggaagaccagattaaagataagaataatctaataaatgtttgtaatattagagagaaatatagcagtaatgatgattgccctcataacaacaattattcatcaactttgtcatttaagataggctatctcaatattgaaggtatgagtggaaaacacgcaattttaaacgattttgcaaatgagaacttatttgatgcattatgcttaagtgagtatgggtgtaaaggaaatgaaatatcttttcatgtattagatgatttccatttagttaacagttttagcagagagcagcatattcctggggggtgtgtcaatttacattaagaaagcattaataaattgtagtagtgaactagatctagggttcttgtgcagtgagatacattttgaagccacaggtgtatgtatggatmatttaaaattgtattgtagctctttatagatcacctagtggtgatccactaatatttttaagaaaaacttgagaatttattcaatttctttctcagacctcagtggaagaaatatagttagtgattggtggtgacatcaagctgtatttgatgtaaataaagatgcacacactgtaaatatttaaaaccgttacgacaattcaacttcaattttacaaactgcaacagtctgcttgtcttgacaactacttacaaatgtaatagagagttactgtcctcagatgtagctgtttttgatttctcggaccatgacccagtttgggtaaaaataagtaccgataggcctaatatgcagtataaggagttcaaagagcctaaatagtcatcacaagaccaataacacaggaaaaactttcctaattc

SEQ ID NO: 2596 - DNA, 1314 bp, unidentified
  source 1..1314: mol_type = unassigned DNA; note = Description of Unknown:Locusta migratoria sequence
catgggctcagcattaattgctgagtatgggcttggcgaacccggggtcctgagctgtgggctgtgtcgcgccagcagtctgctacaccgtaagctctgtgcgtgcttcaacgaccatcgttcggcgcgacggtggaatgttgtacgtttcagagcccggggatcttggcttaatcgcccaggtcgcgaggacagtasaaacctctattaaaaaaaacctcaatctcaaggtgtgctacgtgccgaggagatgcatggctgttgaggttgaacagtcgctaggagaactctgaggaacctgccgcacctcagttgtataaggcttacccaggcaagcggggctctgcctgggtggacctttatatccctagctgctcgtgggaccaagatgaaacgagctataaactatgccaatggcgtctctaagcgaggaagatcaaatttcaatgccacgaaatatgacccccgatcgttcccttcccttggtacatcacgggaggaacatcgggctaaagatagggatgagttatactctccaaaatatctcatatgcagcagaacagacggggamagtttcatgacgacaaaacctcttttcttcgtagaaaatctggaggataagtatggtgaagtcgcgggaatgtcaaagatgaggagtggttcagtgctgatagaagctgcatcatccactcagtcgaaagcattgcttgcttgcgacaagctgggtgatgtccctgtaagcataacaccccacaaatcactgaacatggtccagggtctgatttaccacagagaccttcttctacagtctgatgacgagttacgcaccaacttagagcgacggggcatccacttcgtccggcgcgtgtataggggtctgaaggattgtagggttgccaccggtgctttcatcttggcctttgagggcgatacattgcccgaaaaggtcaaggtcatgatttaccggtgtgacgtaaagccttacatccctccccctatgtgatgcttcaaatgttggaaatttgggcatatgtcatcccgctgcamctctagccccacatgtagggaatgcgggtgtccatcccatccggacgctccgtgtactcccccgccaatatgtgtcaactgtgggcagcaccatccaccctgttcaccagactgtaccattctccgcaaagagtgtaaaatcatggaaattaagaccctggacagactgacatacactgaggcaaggaaaaaatatgaaagactccacccagtccgcagacaacttcctatgcgacagttacgtcgtcgccagccaccctggcgacg

SEQ ID NO: 2597 - DNA, 806 bp, unidentified
  source 1..806: mol_type = unassigned DNA; note = Description of Unknown:Locusta migratoria sequence
cccagggggctccaactaggaggcgcccgcgggaccccgagctgagtctgacattgcttccacttacttgtgcaggcccctgcttttatctttcctgtcggcctcccttggccaactcttgtttcttcgaccccaacagtattaggtttcgaggctggagggtgtctttcattttccaaacccttcttctacaactggagagtaaactccaaaaacaaaaaaatcctggtcctccaggttgggggttggcaacaggctaccaacctgttccagaaaactaacaaggtaaaaacgatataacaaggcctcggataggacggatgaatggaaatcgacccaagcaagtgaacggacagaatactggactacggattggaacctggaatgttagaagcttgcatcaagcaggagcaatacggagtatgacaagggaagtagaaaggtacaaaatggatgtagtagctctacaagaaattagatggccgaactgctcaaccgatgtgaaaactcaacattctgtatggagtttcagaagaaaccatacactggggacaggttttaagtaaggaaagccttatgtaaccagtactagacttcagtcagtaaactcaagaatctcttttttgactatagtactgggggacacaagcttgtcctgatcaactgaattcgaaggacgccttttatgatgactgagactgcaagtgacagtgtccaaaggatcacttaaggtgctgttaggtgacttaaatgccaaaattggaaaagaacaaatttttttgtggactccatgatgtaagcaatga

SEQ ID NO: 2598 - DNA, 228 bp, unidentified
  source 1..228: mol_type = unassigned DNA; note = Description of Unknown:Locusta migratoria sequence
cgtaccctgggcgttaggagaaatcctwacggcagatccttccatcacmaggaccaaaatcaagacgtatctcawccacaacggcttttctcaaagcmakmtctcgmagkaatatcactgaataaagaagtsmtactmtccgacagctgcagtaacacagcttgtkatattttactgctacaggagacccacagagggccacaacagcaaaggccaaaagtaaatgga

SEQ ID NO: 2599 - DNA, 682 bp, unidentified
  source 1..682: mol_type = unassigned DNA; note = Description of Unknown:Locusta migratoria sequence
ccccagggggcccacagctcttttgtgggtacgtgtgtggcgcgcacgggtccccgagccattgcagcctttcttcttacattcctgggctgcattacctcccccagttcctctcctcctccccatcctaattcctccccgtccctctcatctccccccctctctcggtggtttcctttaaaacggcacggctattcctatggttccgatgatggttgtagcaattttgatcttcgtcgttttcctctgttttcggcatagttcggtccccctcggggtttgacctccacaaaaattcacagttactagtgtgagccatttggggaagaactcccgacctagcccctatggcgtggatcccaatcctttcctttcccacttccttccttgccatagccccctcccccgctaggtccccagcacgtgtagccagtccgtgtgggggggggggggggctgttatgtacccttatggctgagccccctgacaacgcagggatcacactgctggtacctgagctgcaacctccccatgcaggccaaggagtcgatacccgtcctcgtggggtatcagggctcccggcaatggccatcgtgccaggtggcctttgctgtggctgggtggcgcccatggggagagccccggatcggagtgggtggtaccagggcggacgtttcgcacg

SEQ ID NO: 2600 - DNA, 335 bp, unidentified
  source 1..335: mol_type = unassigned DNA; note = Description of Unknown:Locusta migratoria sequence
ggtagggtttcaccctatcccacaatctaaacccacgcaactaccatgatggcacaactacggaaactagtaccccagccggttcaatccggggccaaaattttggttcaagtagggcaatggattctgggggccctacaccatcatgtttggatcagtcagaggatccttcatcccgcaaactcagaacgaaggagaaacatttctttggtacacttaacgtgaacaccctattgaaaattggaaaacaaaaggaactgtcaaagtacttgatgaatacaaaataaacttctggcagtcaagaaacaagattcacaacagatgaagtgtcagct

SEQ ID NO: 2601 - DNA, 134 bp, unidentified
  source 1..134: mol_type = unassigned DNA; note = Description of Unknown:Locusta migratoria sequence
ggggacaaggaaggagcctcccagaagattgtaccgtacatgtacagtcgggcgtcccctgggcaacggtaaacaccggcaaatccttccacacactgagctacgtctaaaccgacattgtattcagaatctga

SEQ ID NO: 2602 - DNA, 515 bp, unidentified
  source 1..515: mol_type = unassigned DNA; note = Description of Unknown:Locusta migratoria sequence
gaagatggctgccgatcagtatactcattttgtgcgcgccgttgtgaatagtaaaaatcgcgtgttcaagtgttctctgtgcgagaaatacaatgctatatgtgataatttatgcgtgccgtgtcacatcttaataaaaaacagtggaaaaaatgaacaggtaaatcctcgtgtaggtctttgtacaagtcttagtgatcagcgtggtaaacatggacatctgcatcaaaatgtggacgaaattctgagtgaattagcaacgaaagaaaaaattatcaacatcctgtgtgacgacatagcaaagttgcgacaggaatatcatattttcaatcaacaaacagtgtgaatacatcgccaaatataaattgtgctgagtttattaggcctaaaaagttcacgagtggtaaactacacgaaacggtcgcgcaagtgccttcaaataaccgtttcagtgtccttgaagakaacactgatactgttgatttgtattgaaaaacaaaagtttgtctacaaat

SEQ ID NO: 2603 - DNA, 331 bp, unidentified
  source 1..331: mol_type = unassigned DNA; note = Description of Unknown:Locusta migratoria sequence
ctcagtgaccgccggccagtgcacacgtgacagcagcagctctacattgtaaggtaaccggcttcttaatagaagcgacttattttcatttcgtgtgtgctttcttttacagttcttcaaactttagtgtgctcgcgtgtttatttattaagaatcgcgtttagttgtcagttcagttgttgatattttgatttattagctcgcgtatatatttttcagattcgccgttaataaacagtttagtgttaggttcatatttttcgaagctcactgtttatcaaacttctgtgtcctcagacgtacttacttggaacatacataggtttttaga

SEQ ID NO: 2604 - DNA, 416 bp, unidentified
  source 1..416: mol_type = unassigned DNA; note = Description of Unknown:Locusta migratoria sequence
ttaagacggccactgcacggaagattatggagaagggagccatgctattgtgagagagaattagttatacaggcaaaggttggatacatttcaggaactgttcccttgacatcgaagattgcagcctttccccccgggactgggttgatggagttacttcgccaactttgattgggaattttggatgcaagttcgggatgtcaaaattgatcgcatggtgccacaacaagcttcaacacaggaagttactgtacaacgttccattttaaatttcggagagaatttggacgttgcaactgtctgttttgggcaaaggactgaagttttgtacctacacccagtgactgggttgaagaagctgtacgacattcctatggcactgctgaagaaatgggaaacttgccgtgttctcttga

SEQ ID NO: 2605 - DNA, 427 bp, unidentified
  source 1..427: mol_type = unassigned DNA; note = Description of Unknown:Locusta migratoria sequence
gtctcccacaaggccaacccctcgtccacgtcgtgggagacgggcaacggcgcgaagtaagggattgtctgtaagggtgaagtacagtggagactatgcgagttccgcgaccgctacggcagctgtgaaggccttacaggaaccctgaaaagcggcggctaacggggctctggtgaagccgtgttaggcgtagctggccagcggtggattaaagcgtgctttcaagactaaaacaagcctcggatgtataaaagaaattactggacatgacacctctccagggacctcacgaaagtatgacggccaaaaacctgaagcatattggagacscctgaagacacaaaaaccaacaaagaaacaaaaactcagacttggaactctaaacatcctcacgctcactggtaaatgtgaagagcttgttgaccta

SEQ ID NO: 2606 - DNA, 306 bp, unidentified
  source 1..306: mol_type = unassigned DNA; note = Description of Unknown:Locusta migratoria sequence
ccaggcacaacattaccagacgtgaaagggcgcgctgcggtcgctgcgtgatgatccagacgtcgtcgtcctgccggcggataaggggaacataaccgttctgctaacagctgcggaatacaaggagaaaatgtataagctcctagatgaccctgcttacaggaagatcacgacggatccaaccagccgaatacagcgcaagacaattgaacttcttcggagtactttcacagacgaaacagctaagaaactccgtcctcgtgcggccgcaccaccaagactctagggcttccaaaggtacacaag

SEQ ID NO: 2607 - DNA, 464 bp, unidentified
  source 1..464: mol_type = unassigned DNA; note = Description of Unknown:Locusta migratoria sequence
aacacctacataccaagaaacaagaataaatgttgaactttacaaaattcatctggaactaggcaaccacatctctcagacatactcaatgatttaatgaatacagtcaaacaaaatacagaacaactaatcaaaatgggagaaacaacaacaaaaaataaacacactcctcaaacatagcaacactgttaaagatagaaacacacaaccaaaccacactttcacaaacgctagtcaacctgactgacatacaattcaccaaacaggaaacaaacctcttagaaaaaggacccaaatataatgtcaacacacatattacacacagaacaatagagaaccttgtcacagaaagtgaattcataataaaacaacaagaaagaaacacaaatttcaatgcaggcctcacaagagaattaattgcagaggaaattagatgcataataaaagaaaacagaaatgacata

SEQ ID NO: 2608 - DNA, 191 bp, unidentified
  source 1..191: mol_type = unassigned DNA; note = Description of Unknown:Locusta migratoria sequence
tattggtggattgagtaaccctgaagtgctgctgccggtcccaacccggataaaggaggagggttggcagccaaagaagccgtaaaagaaaagccgggtcacatctcaaggcacctctgaggctaactaccccagttgtaatcacgttgacgcctaggcgtcaaccsccaatataaatcattcgtttcagc

SEQ ID NO: 2609 - DNA, 321 bp, unidentified
  source 1..321: mol_type = unassigned DNA; note = Description of Unknown:Locusta migratoria sequence
gaaaccgttgcaacaaatcgaaaatttaggacgatttgtagcagttttgtaaacacacattcattgaagcaaccagttctgccaggagcactttaccggacatggactgcacagaaaccacctgggcaaggatgtgttggccaaagaaattctccatgtgataaaagctgcaggaatgaacagtcacgtaaaaattgcactgcctgcaatatgttcattgccaattacaaamgaaaagaagacggtaccaacagcatatgaagaagaaacacctatggctwcatctaataagtagaaagtacatcagcaccagcacatgaa

SEQ ID NO: 2610 - DNA, 1103 bp, unidentified
  source 1..1103: mol_type = unassigned DNA; note = Description of Unknown:Locusta migratoria sequence
ggggtacgaagaaggagcctcctagtagactgtgaaccaataagctgaaggacacagtcgggcgtaccctggaaacggtgaaaaacttcaccggctaatccttctaacaccagatcaagttagagccaaaaggaacatcaaagatgcaacggcctttatcaagaccaaccctcgtgataatctctataaatattgagggattttctagtcataagagtattttattagcagacatatgcaataagcataaatgtgatgtattattggtgcaggaaacacatcgggaaaccaccagccacagacctaaaattgcaggaatggagttagtcatcgaaagacctcatgacaagtacgggagtgcgattttcgttagacctgggctcaatgtaatatcagctgcattgacagagataaataacattgaagtacttaccatccgggcccagaagttctctgtgacgactgtgtacaaaccaccagatatggactttgttttcaatgaacctaacaattttacatatgaccatattaattttgtaatgggcgacttcaactgccatagtgaagcgtggggatacaatgagactgatgaaaacgggatacagcttgaatcctgggctgacagtaatgacctgcaacttattcatgacccaaaactcccagcatcgttcaatagcggaagatggaggaggggatataatcctgacaacatctttgtgagtaggaagttggcaatgcagtgtgtgaagcttgttgatcatcccatcccaagtacccaacacagacccattatttgtgttgtgaatgccatcgtgaagccagatgaggtgccctttcgaaggcggtttaatttcaaaaaagcaaactggcaacaatttcaagagcaattggatgaagagattgagaaaattcctcctcgaccagatgagtatggtagatttatcgatctttgaaagaggtttcaaggaaaaatatcccaagagttgccacacccgtacatccaaggactgactggcagcagtaaagccttgcttgacaggtaccagaagttgttcaatcaggaccctttcagcgaagatacgttggaggctgcggaagaccta

SEQ ID NO: 2611 - DNA, 100 bp, synthetic construct
  source 1..100: mol_type = other DNA; note = Description of Artificial Sequence: Synthetic polynucleotide
tcaaatcaaatcaaatcaaatcaaatcaaatcaaatcaaatcaaatcaaatcaaatcaaatcaaatcaaatcaaatcaaatcaaatcaaatcaaatcaaa

SEQ ID NO: 2612 - DNA, 554 bp, Lottia gigantea
  source 1..554: mol_type = unassigned DNA
ttaagtttaaccacctcaccctcatctccagcctgtaaaccacgacgtcataataatgagaaggataaatccaaatggtctattcccacactcaccaaaccaacagttatcattggatcttccaacatcagcaacatcccgttcctacatccagatacccaagccgaatcttaccctggtgcccgaattcagcatatcaatacattactctccaagatctctccaacaaccattccgaaaaaggtgttatttcatgttggcctaaataataaacaggaatcaggagaatccatacacagaagaatgctggaactcctcaaacttgccaagtcgaaatttccgtctgctaccctttacgccacacagattccttactcaaaggagctacaattagctgaacctcatttagtcaataacctccagaagttcaacagtctattatatcataaaccgtctaccaatgcccatactattcctcgcttcaatggagtggtcagtgtcatttcggataacatccactggatgtcccccactgcaaaaagtatttatttttc

SEQ ID NO: 2613 - DNA, 882 bp, Medicago truncatula
  source 1..882: mol_type = unassigned DNA
taatcctgccaaggccggtcccaagcccggataaaaggagggttgtgttaggcctcgacagccaaagtaaaactttgtcgaatctctatgacatggaccaaatgcaaaatagcgtgaatgctaggtcgttgcccggaagcaacgcgttgtatggctcgagtacagtgtcaaatgagcaagagccgctgcatcaccacctggatgtagtgaaaattaagcaagggttcccgcatcttcgtgaacgggtgcgggtaaagaagctagttcatgagaataggattcgttttggaacttgaaatataggtacacttacaggaaaatctatggaagtagtagacacaatgactaggaggaagatcaatttcatgtgcctacaagaaactaagcgggtggggaaaaaggcgaaagaattagatagttcaggatttaagctttggtatactggtgaagttagatcgagaaatggggtaggcatctttgtggataaggagtggaagaaagatattgtagatgttaaaaggataggagatcggattatagccctaaagattgtagtggaacaagacacctttaatgtaattagcgcttatgcacctcaggtagggttagaagcacaccttaaagtgaagttttgggaggagctagaaggcttaattcaggatatcccgttaggagaaagatttttctaggaggggatttaaatgggcatgtagggagtgtttcgagaggtttcgagggtttgcatggggggtatggtctcggggagattaatgcggagggtaaatccatcttagatgtttcatcggcttttgatcttactatagctaatacttgtttcaggaaaagagaggagcatcttatcactttcaagagtggggtctc

SEQ ID NO: 2614 - DNA, 694 bp, Melopsittacus undulatus
  source 1..694: mol_type = unassigned DNA
tctctttcacggacacccccttgtcgtggggaaagagcttgcgtgcccttgtgaggttgggagctatgctggtggtggcatatgcctctagtagggtctcccatgccagacaggtctcaactgaagggtcagacaaagtgtgtccatgggcaggatgggctcactagcctttgggcaaccatcctaggagaaggacaactctaacttcaaacccaggcagatggagctcgtttagccctgtaaggccatccatctaagagaaggatactctaatcaaacctatgacctgaggactttgctgtcaccgtccaagctcgctaggccctggcagataaacctcaggtgtaaagggtggggccagttctgcgcatgctgtgcctcacctaaaaaatccactgcacaggcccgaagggtttacccacacttgcaaagccctgtagcgacaggcgagggacgaaacggcaggtgataaggtgcactggaagycgcagacccaaccctgcatgcaggcggttcaggacattggtcgctcgagactgacccaggagatgacagtcttgtttggcaacatcctgaatgaccaagcagccttttttcaaggagagcactgcttgctccatatggagagaggcctagaaaaggtggcctaaccaaagctcatctccccctccacctggttggctagccgcggcca

SEQ ID NO: 2615 - DNA, 167 bp, unidentified
  source 1..167: mol_type = unassigned DNA; note = Description of Unknown:Mesobuthus martensii sequence
gccttagaggaaccgactaagatcaaaacctagtgtccaatccgtaccttcacgtggtgcagctgttagtactcaatgtttctttaacatgaggaacggacacggatgggctcacaccaacccgcattggccagcgtggtgtgttttggctaaaaccttcaagcata

SEQ ID NO: 2616 - DNA, 111 bp, unidentified
  source 1..111: mol_type = unassigned DNA; note = Description of Unknown:Mesobuthus martensii sequence
aactccgcccaagaagccatatagctgactggccagtcccaagcctggataaaggaggagggttggcgtcaggaagggcatccggccgtaaaaacaccctgccaagtcttt

SEQ ID NO: 2617 - DNA, 53 bp, unidentified
  source 1..53: mol_type = unassigned DNA; note = Description of Unknown:Mesobuthus martensii sequence
ggaacgtccagacactatgggccccagggaaactcgaactgttacgacatgaa

SEQ ID NO: 2618 - DNA, 61 bp, unidentified
  source 1..61: mol_type = unassigned DNA; note = Description of Unknown:Mesobuthus martensii sequence
  misc_difference 60: note = a, c, t, g, unknown or other
ttcttcgagaagaaagaacagtgaaaatggacatggatcagccccaacggacggacaaana

SEQ ID NO: 2619 - DNA, 142 bp, unidentified
  source 1..142: mol_type = unassigned DNA; note = Description of Unknown:Mesobuthus martensii sequence
tggggaaagcaatggtgaactaccctgtaaaaacctcacctcgaaattctatggatcaagaccaaagtgttatcgatatggtgttggacggtgggcccccgggctggacaacatcgaccatgctactggggaagagcaaagg

SEQ ID NO: 2620 - DNA, 2726 bp, unidentified
  source 1..2726: mol_type = unassigned DNA; note = Description of Unknown:Nasonia vitripennis sequence
agaaaagtaagaaggaaagaactggagaagaggcagaagaaagaaacgcatttgcaaaaggagggaatgtgaaaagatcaccaattgagaaagagaagatggaagaggaggcaatcgggtcgttaaagtgcactatgaatataatcctacaaaaagtggagaagatgagtatgaaaatggataaggaataggtagaaagggataagatgatcgagaactgggaacagaaatatattggactggaggaaaaaatgaacagaaaaatagaggaagggctaaaaggtatggaaggaagactgtgagaagaaggagaataaaggaaaagaattagaagagaatgcaaggaggcgagagaaaaggaggaaagagagatggaaagaaagaatgggaatgagaatgcgaaagaaaagaagaaaaaaagaaattgaggagatattagggaagatagaaagtctggaaaaaggggaagagatagacaagggtagagagagtcaaccaggggagagagaggataagggaaaggtaacggaaaaggagagggacagaaagcagatagaagaaatggaatggaggatcgaggaaggagagaggataggaaaaagaataatattataatagcagggtggaaagaagaaaaatgggatagaaagacggtagaagactggatgaaaaaactcgaagtataggttacgttgaggaaaacggtcattgaacgggaagatctaaagaataggggcggaatgtagaaactgggaagaaaaaggagatatcatgagagagaaggctaggttacaagggtctgatatatttatagacaacgatctaacatggaaagagagaagaaataaagaaaaactgagagaatacgcgacaaaggaaagaaaagaaggaaaagaggtcaagataggatacaacaaactatggataaaaggcgtagagtatttatggaaggaaagagaacaggaattttttcggagaaagaaaaggacaggagaggaagaaaagaggggagcaaaggaacttaaggataattaattggaatgtagcgggaataaagtgagtagatgagaggacctggggctatctaaaagggtttgatgtaatttgtctgcaggaaacatggctggaagataaagaaggaaatttctgggaaaagaaattaggaggttatgaagtcagaattagaaatgcaaagaaagggggagaaagagggagagtgaaagggggaatagtgatggcggtaagacagggaacgaaaacagagagaatagagtggatagaagaaaagacaaacgaattcataggagcaagaatattaggaaggagagatatatggtggataggtacggcatacatgagagaggaaaaacaagaaaactttaaggagatagaagggatgacggaaaacgccagaggtgagaaattgatatggtgcggagacatgaatgcaagaacgggataggaaggaggaggagtcgacgaggaagaaaacgaagagaacagggaatcgaaagatgaaaagataaacagagaaggggaagaacttctggaaaaaacaagagaaatgggacacagtatattgaatggaaataccgaaggagacaaaacaggagaatacacgtacataggaggagcaggatgctcagtgatagattatgtgataacaaatgagcaaggaaaaagagaggtacaacgcaatagagatagagctgggaaaaacactcgggaaaacagatgaagagaaagacaaaatcacagaaagagctatatggactgaaaaagcaataggtcaattccgagaagaactaaataaaggggaagaggaaacagaatggacagaactaaaaagaaaactagaaaaagcaatcagaaggaaaaagggaagcggcagaaaaagaaagaaaaacacgtggtgggatgaaaaatgcagactcagaaagcagaggtaaggaagttaggcaaggcgattaagaagggagcgggaaggaaagaatacgtcaaagcaaagagagactggggaatattagtagaaagaaaaaagcaggaagaaatggaaaaaagaataaaagaggctggagatagtaaaaccgggagaaaattctgggaggtggtaaaaagtaggagaagaaaaaagaggacaagatgcagcagtaaaataaagaaagaggaatggttaactyacttcaaagggcaactaggagaagagacagaggaagatttgggaacaagcayacaaggagaggatgaagaaggagakagagaggataaagaagraagaataaccgaaaacgaggtgaggaaggcaattagaaaaatgaagaagggaaaagcgccaggagcagacggactacaaaatgaggtatggatacacggggaggaacaggtaataggagaaataactaaaatactgaataacatatggaaagggggaaaagtaccagaggaatggaaaacgggactaataaccccgcttttcaagaaagggaagaaggaggaagcaaagaactacagagggataactctcatggacacagggtataaattatacgcagaaataataagggaaaagatggaaagggagttagagggaagagagatgcttgacgatacacaaatgggtttcagaaaagggagaaggtacggcagacgcaatttatattttgagtaaagcaatagaaactgaactggataagaagggaggtaaagtctacgcgtttttcgcggat

SEQ ID NO: 2621 - DNA, 942 bp, unidentified
  source 1..942: mol_type = unassigned DNA; note = Description of Unknown:Nasonia vitripennis sequence
tggtgagtacagttgacagctctgctgatccatcatttttctgtactgcttttctgctgcttcttgccttcgggccctcttctgttgtagatagttgcacgctcctttttgcaaccttcacgtcgatacataaatcgccgaaggctgcaatttttctctgtcatcttttctactgcaaactttctacacggctcctaacctacaaatctgcttggcttggcttggcttgtttcctcacttgcacggcgtctctttctctccgcaatcaacatcgtggcgacatctgctgcatcgtgggagaactttcaaggcgacttcacactgatcgaggtcggtactttcacgctctttccactaacgctccatctagccgtaagagtcacaacacctactctttcactccgtcgataacttatcatcctcctacaaatatctgctttaccgactgctagtaagttatcgacgaaaaatgagtgcaaacggcgagaagagtgtggaagtgccttttcagccatgcagcagctgtaaacaacctatacagcacaaagaccccaagaagtgtgaattttgtggtctgcactaccacgtcaagtgccaaaacaccgttaacatcaaaactatcgtggtgaacgacaggcagattatagcctgtccctcatgtgcagacaacagcaacgccaagggtgccaaactgaggactaaatccacctctgccacaacatcagcaacgggagtaactgcaacaacagcagcaggcaagaatactcccaaacaacagcagccggtgaataagaagacgaggtcagcaccaccatcagccaacacgtcgagaaatccctcaccaacccgctcggccggagtaacaacacctacgccgtccgttgaggccgctttgagggacattcgcggagcactgctctcgacgacatacgcaatgctcaa

SEQ ID NO: 2622 - DNA, 77 bp, unidentified
  source 1..77: mol_type = unassigned DNA; note = Description of Unknown:Nasonia vitripennis sequence
acacagataaacttgcatcatagcaaaggcgcctcggccgcactggtcaggcgcatggctaagatgcacacaggcat

SEQ ID NO: 2623 - DNA, 438 bp, unidentified
  source 1..438: mol_type = unassigned DNA; note = Description of Unknown:Nasonia vitripennis sequence
tgctgtaacctaacctacaacctctcatggcttttctccttgctgcacggcgtctatttctcctcaaagcgatccacgtggagccacctgtcgggtacacggaacaccaccagcaacatcatcaatcacaggtcggtcaattctcacctctctcgattagcaccccatctggcttcgagagtattaagtctctagctctgtcgataacttaccacccgctactatcttacaacactctctacgttatcgactgccagtaagttgtcgacggagacttaacaataacatcgaaaatgagcggaattggtgtgaagaatgacgagtcgctcctcatgtgtgctcactgcaaaaaaacaaaaagagggaaaatgaagacctgcgagttgtgtgaccggcagttccacaccatatgtgtcgccttcaggtctataatggtga

SEQ ID NO: 2624 - DNA, 442 bp, Nelumbo nucifera
  source 1..442: mol_type = unassigned DNA
ggtgggagtaacagaagagataggggwtggtgaggmtgtagaagggtctaaggaggaaggggagmgaatctgggaattaatagtgatccttttcgagcagttggtagaggtggaaattcactccaggttgggatcagaagagggggctgaactkattgggactacttctaaggaaaaggagagggagattaataagagtggtgctggaactaaaaaggcaattaaaaaacttagcaagaataagaaaaaaggacaagaagtaactcagttaaaagcttcaaacaagggggagggagagaattctaaaagaagaagaaaaaagatgagtgaagtcgaaagacttaggtgtggtgtggattatgaaagaggaggcacaggaaggaaggagagaaagctgggttaaattaagctgagtcgtttgggcctttttgcttagttttcc

SEQ ID NO: 2625 - DNA, 379 bp, Nelumbo nucifera
  source 1..379: mol_type = unassigned DNA
gaagtttggggcaaaaggagakagaaggaaagggggaaagtagtggtcaagggtagaagggaagtaagaaagaagtgagaatgaagatactaagttggaatgtgagggggataggaagtgcgaggaaaagagcaacaataaaagaggtaataaagaggttcgacccagacattgtactgttgcaggagtccaagaggatggagtttaataacaggtgggcaaggagtgtatggaaagccagggggattagttgggtggctgctccctcttggggtgcttcaggggggatagtgacaatgtggaagagggaatgtggttgaaggcttggaggaactgattggaagatactcagtttccatgaagttcaaacagcaggagg

SEQ ID NO: 2626 - DNA, 249 bp, Nelumbo nucifera
  source 1..249: mol_type = unassigned DNA
  misc_difference 110: note = a, c, t, g, unknown or other
ggagatttgtagggaagattcagtggcagaatttgtgggaaagttggggcgtaaactgaagaacccaaatgatttaaaagcatttctacgaaaaaaggaggatagaaagntcgagaaaagaaaattgagcgaggttgagagattaagaagagatattgagggggataagaagtttggggccagaggggacagaaggaaagggcccaagtagattttggtggtgatagggcagattcttgcaaaattgtg

SEQ ID NO: 2627 - DNA, 72 bp, Nelumbo nucifera
  source 1..72: mol_type = unassigned DNA
agtgtttggagaggtagggggatcaattgggcgtttctgccctcatgggggtctgcagggggtgttgtgaca

SEQ ID NO: 2628 - DNA, 279 bp, Nematostella vectensis
  source 1..279: mol_type = unassigned DNA
tcctcgatgggatcgccaccttatcgtggtgagggtgtttgtgtgtcccaatgacctctagagctatgtcggcgggagtattttactcctggcagggacacccatgccgaacaggtcgaaaggtaggggccagacgaagagtgatccactggtcctccaggttgggggttgggcaaagggttgataaccctctcccataaaaaatagcttatcacagaaaccagaagcagagcaaattcacttgggaagaccgtggctgcatctcatgaaagagattgt

SEQ ID NO: 2629 - DNA, 18 bp, Nematostella vectensis
  source 1..18: mol_type = unassigned DNA
ggtcagcggtcgaccaag

SEQ ID NO: 2630 - DNA, 90 bp, Nematostella vectensis
  source 1..90: mol_type = unassigned DNA
ccaaaatggctgccacggcttttgtagctctgtgaatcttgtctctgttttcatgtgtcattgctagttgaaggcgtttgactgtcaaag

SEQ ID NO: 2631 - DNA, 519 bp, Nicotiana sylvestris
  source 1..519: mol_type = unassigned DNA
ctctcaataatgtgaaaaccttcctcactaccgctgctcctatagaacacaccttcctttacctcaatctcttcaacactttacacwcatcatgtctgactctcagcaacamctgcaacagcttaatcaagttwccgaccctccggatataggatctatgcaaatcgatgatacaagtatgcatacacaaccagctactttcctacaaactctactaacagataaataccttctgccawctctaaccaaccaaataccttccttaaacactctagatctagcagatgaagtactccataacmctactgacgatgacacatttataccaattacatcaactgataaatcacgtttatatgagccmtggaaatactctgtgatagttaagctwtttggcaaamggattacacaccaaatcatgcatgataaactgatgactctgtggaaaccaacagaggtcctcctctcattgatttgggttctgacttttttctcattaagttccaaagagaagaaaat

SEQ ID NO: 2632 - DNA, 60 bp, unidentified
  source 1..60: mol_type = unassigned DNA; note = Description of Unknown:Notamacropus eugenii sequence
aaattccttttatgatacaaatatggtwttgatacctaaactaggaagagccaaaacaga

SEQ ID NO: 2633 - DNA, 55 bp, unidentified
  source 1..55: mol_type = unassigned DNA; note = Description of Unknown:Notamacropus eugenii sequence
ggttactgcagcaggcaaggaatcccacaaaaaatgtacaaaaacatctgcaaag

SEQ ID NO: 2634 - DNA, 330 bp, Oryzias latipes
  source 1..330: mol_type = unassigned DNA
agatttgtttttattgacaattttaatcttttctggaacagaacctcattctataaaactgatgggattcaccccagtccactgggcagcaatgttttagctgcmaacatcagacactctgtccagacatcaccggcccccatcatgcccmcaccagtccagacctcctcctcatccgtgcagacatcggtctgtggaagtgactgactggatgtggtatcacccccccacattccccaaaaaactgcttcaatcgacagtgcttccttgccaccacctacaccccccccagtctatcccattaagaccattattacagacaggtcttcc

SEQ ID NO: 2635 - DNA, 99 bp, Papilio sp.
  source 1..99: mol_type = unassigned DNA
accggaggacgggcagcagcgtccctttcaaaaacggtggagaagtctgcgatcgccaacccgcctgccaagcgtggcgattatggcaaatccccccaa

SEQ ID NO: 2636 - DNA, 30 bp, Papilio sp.
  source 1..30: mol_type = unassigned DNA
gtacgtgcgactcgtgaktgctatgtatga

SEQ ID NO: 2637 - DNA, 296 bp, Papilio sp.
  source 1..296: mol_type = unassigned DNA
ggaaaagaagggagatattaaaaaataaaaggagtttgaagcaggtatatgttactgaagattttccgaaagaagtattagaaaagcgaaaagaattacaaataaaggttaaagaggagcgtgctaaagggaatatagcgtatataaaatatgataagatagtagtcaaagaaggccatttagtcaaagaaaaaaggaaaagagatcaatcaacatcaccagaaaatcaaagttatgccaaaaaactggttagcaataattcattgataaaggaaaataggaaaaacgctttcgac

SEQ ID NO: 2638 - DNA, 212 bp, Parhyale hawaiensis
  source 1..212: mol_type = unassigned DNA
ccagttaccctccgtggcggtcggttgtgacgtgtacggtgctccgctagagtagataaaatcagaaagctatagatttttctcgaaagcaataaactaattaagtgttaagcagtgtgccagcctggctataaactcgtacggaccgtgtgaccagcgggaccagtgaccacaccgtagctcgcttaataggggaagcgtagacgtcagtt

SEQ ID NO: 2639 - DNA, 404 bp, Parhyale hawaiensis
  source 1..404: mol_type = unassigned DNA
gcgtggcctgcgcgttatcaggccgcccccattgtccggccaccggacgccgctttgtttgtatgagctggctttgggtttggggctctgggtagcccctgagttggaggaaatgccactctaaaggcggatgagacctttttggtccaacggcatccctgagaggagatgaacaggctggtgccatagctgggtactcagtcttccgcagtctgctcctctcttccttccctcgggtagtaccacctgatgctcttttcctttcctttctcttcttcctcttttcggccaaagcccgtactggtgatggcagggtctggggcgcgtggatagctggccgctttcgttgctatcacgactgtcgatttgcttttttgtaatttttttgatgatttcctttgctt

SEQ ID NO: 2640 - DNA, 2175 bp, Parhyale hawaiensis
  source 1..2175: mol_type = unassigned DNA
cagaaaataatcaacatttgactgtggtgtatatacaaatacaagtgtagtgctaaaatgtgttcgattawactcttattcattgctctcgagtgctaccgctagatattttctccattgcttttggttcttttggttggattctgtggtcgaacttagaagacgctgatcctgagttactaagtaatattatattctatcaaattttcctctatcaatattttttccatcttcctcctcattgacttgcctgatcctcgccaaagggacaagtatgactcctgaacttcccgagtggctataagtttgccttactataggtgggattaaaaattgtgtgcttcggtctcaacttttttttagttttcaagtagataacaccttttcaagaacgctaatattttttttttcaaacctttctagagactaggaggtacactagcgaatatttattctcaaactccttacgttttggatcttcataaaatattattttttatttcttttttttctctcattcattttcttttctaacagactgtaggtttagttcagaaatgttctacatgaaatgaaaaaaaagagcttgaaacatatgataattgagttcattcctaacattgccaagataaacagttcggagctataggcccgatgttcgatctattgataattaccaatcttagcggcgtgaggcaaaacaaagtaacactccagagttcctggcaatttttgtttaattcttgtttctctactcctcccaaaactctcaaacgacttccaatagtcttcattttatttcaagacttttaatacatcttattgtagttttcttttattttgacatgttaaaatgcctaawtcgttgctgcaatgtacgtaaaaattagaacttgatctttttttgttcatctttctaggaacatttgtgtacggtgcaacgggttatatgttatatattatatacagttcctttgtttacctcgtcaaggaggttatgtttttctcgtgtttgtctgtcccttgtctgcctcttgtaagtcaccaagattactctaaaactaatgaacggactcttatgaaatttacagggattgttagacatgttgacagtaacagatgattaacctttggtaaaaatccgttcacctgtctgtctgcctcttttttcgtgcgccaactcaaaaggttccggacggatttttatgaagtttatatgatttgttgggtataaaacgtagagtaattgaccgaaattttggtgatatgtttgttcgactctgtgatgtgtttgttcgtctctgtgatgatatgtttgttcgtctctttgtttctcgctgtgtttgatcttgatattatgcttgttagcacaataactcgaaaagctgtggatggatcctcatgaaatttacaggacatgtagtaatgttaaaagaaataaaggattaaactttggtgaggatcggtatgttcgtttgggtgttgaacggatcttcatgaaaattacaggaatttttttaattctacagaaaggcacagctgattagattttggtgttgatacaaagaaattcatggtttcagagccaatttgaatttttcgtcaccgttgccttgcttggcggaggtatgcgctctagtttgtaatgaacttgcatgtagggcatcttattttactccttatcaaattatgtcctttcttgcatgtaggtttcttttcctttaatacattgtaacttactatagctatatctaggtagccttatttgcattttttacttgtttcataggaattgcttgggggcaggataacacgttaagatattttctttgtttttcatccttgtgtttgtaatttaactgccaagttcttatgtacactgtttaatcagttaagcatatacagtatttgcgatgtacagtatacggaggtgctactttgcatgaggaaacttattaacaaagttcattaatctagttcaaactgttcaggcgatttcgctcgaatcttgggccatagctttagtaacggccctatcgatggggcacgcgtgacgtttttgcattgatgcccctgtcccgaattcccggtaccgagtaactgttccatttctgtttttctccctttcctcttctcctttcatgtcctcttgtgccggcagcacaggcctacaat

SEQ ID NO: 2641 - DNA, 420 bp, Parhyale hawaiensis
  source 1..420: mol_type = unassigned DNA
ccacccgatgcctgtgcgtcttcgtcgtgggtggaccctgcgggagctctctgcgcggctgcgacggggacttccgcgggccaaacgcaggcactcatcgttggagtggctacgcgggtcgctgtggcgctccctttcttcctctcttactctcttctcccgctattctttctcgctgtctcgtgtttttttccttcacggacaggtcctttctgccgacgacctgcccgctcttgtctaggcagccttttccttacttgtttccccctcccgctgtcccttttctccccctatccattctactaagcggtgatcatccaccccaaccccggccccgcctgtccctgctcagtctgctcgcggaacgtcacccgccgggggtggtcttttctgtgttccgcctgcgcgcgctgggtccac

SEQ ID NO: 2642 - DNA, 568 bp, Pelodiscus sinensis
  source 1..568: mol_type = unassigned DNA
gggtggtggtggtcggggactccctcctaagagggactgagccatccctctgccgtccggacctggaatctcgagaggtgtgctgcttaccgggagctcgcattcaggatgtcactgagaggcttaccaagctgatcaaaccttcggatcgctaccccttcctgcttctccatgtgggaactaatgatacggccaagaatgaccttgagcgggttactgcggattatgtagcgctgggaagaaggatccaagaattcggagcgcaagtggtgttctcgtccatcctccctgttgaagggaaaggactgggcggggatcgtcgaattgaggacgtaaatgcgtggttgcgcaggtggtgtcgcagagagggctttggtttcttcgaccatgggactctgttccgggcgcaaggattgttaggaagagatgggatccacctaacgaagagaggaaggagcatcttcgcgggcaggcttgcaaacctagtgaggagggctttaaactaggttcgtcgggggacggtgaccaaaaccctgaggggagtgggaaagtcagataccgggaagaa

SEQ ID NO: 2643 - DNA, 458 bp, Pelodiscus sinensis
  source 1..458: mol_type = unassigned DNA
ctggtgccaagctgtactggctttcgcctttcccttgggttacatcagtggcgtggagagggggatcctgctgctgggcatcagccggttctcaacttacttgcccaggcctacgccctggagaggacactccggcatcgctttctgagcagtgacacaacacgggaagcagcggttaccggtattaagccactgcacttgattggcgtagagtgaggcgccaggggttgcttccgacggtgggagaggtcttcggatctcattgggcagctaccgcccgcctcaagctgggcagcccccagccaaataggtgctgcctcgccacggtccacttgctccattgggtgtgtggggcttagggaatcaccaacaggtggatcgttaaccttacaccaggcaaaacaaacaagcgacaaagtaatccagccttcaggctgggcacatggaatgtaaggacc

SEQ ID NO: 2644 - DNA, 395 bp, Pelodiscus sinensis
  source 1..395: mol_type = unassigned DNA
ggtttagacagttatgkgctattcctkttccgggtcctgtccccagcctcaawaactctgggaaccttaacgcctgkccatcagccctgagcgtgctgttgctgaatgccaggtcagtatcccagaagacagctgtcatccacgatttaattctgaatgaaggggctgacctggcttgtatcactgagacctggctgagagtggagggaggcgttgacctttcccaattgtgcccggctgggttctcagtacagcatcagctgtggcttaatggtcggggaggtggggtggcaattgtctatcgagataccatctcactggctagggtcttggtccaacaaagtgtcagattcgagtgtctgtacttgacgttgggtggccgggataggttgggt

SEQ ID NO: 2645 - DNA, 204 bp, Petromyzon marinus
  source 1..204: mol_type = unassigned DNA
cccaggtcgacgtagccctsagagkcttgggacacatcccggcagacgttsctagatctgaaatcgctgctaccctcaaaaacgctaagaaacccattagcaacatcagcaaggacgagcgtkttgaactctctcaattaaaaaacagagatgacataktcatcctctcagccgaaagggcaatgccactgtcatcatggataa

SEQ ID NO: 2646 - DNA, 10 bp, Petromyzon marinus
  source 1..10: mol_type = unassigned DNA
ggggaagaag

SEQ ID NO: 2647 - DNA, 344 bp, unidentified
  source 1..344: mol_type = unassigned DNA; note = Description of Unknown:Phanerochaete chrysosporium sequence
atgatctgtgcatacaaaaccttcgtacttttgccgagaaagagtcccttaaggggattcgttgctcccgacctcggggagacttttctccacaccaatcgcattacagccgacgagcgacatttcgcctctcgtcggcccgccagtcccttcgggcctggcggttgcaaggggtatatatcccagtaggaaaccgctgatgagtcttcacgacgaaagctcagcgcgacacaacagtgtcggctgccttcggttttcctgtgaagcattccgcgctcgccgctcactacgctcgcgtctcgcgccccccaaaccctaatcaaatcgagtaagcactcttcacc

SEQ ID NO: 2648 - DNA, 273 bp, Rhodnius prolixus
  source 1..273: mol_type = unassigned DNA
cacgttgtcagagacgatcgtgaggatggatatggtggaagtgccatatttatcagtaaaaaattgcctttcgacccaatagtgctgaataatccattaaggggcagagttcagatatgtggggctaaaatcctatttaggagcgtcagtattacggtccttagcacttactgccgtcctgggcataaagcctcagtagaggaatggagtaatgtactaaatcaggtttcgggtcctcttattcttggtggcgactttaatgcgcttcatcca

SEQ ID NO: 2649 - DNA, 195 bp, Rhodnius prolixus
  source 1..195: mol_type = unassigned DNA
gaatccagaaatagagtatccaaagataaatttattaatagtaacggttataaacttttggattttttcgatagcttcagtcttatagtccttaacggtagatttgaaaatgatttggaaggcgagttcacctacattagcgaggttggctgttcggtaattgactattcctgcattagtattaaaggtattgac

SEQ ID NO: 2650 - DNA, 197 bp, Saccoglossus kowalevskii
  source 1..197: mol_type = unassigned DNA
aacagtggctatgcaataaacagtggctatgcaatgaatagtggctgtgcaatgaacagtggctatgcaataaacagtggctatgcaatgaatagtggctgtgcaatgaacagtggctatgcaataaacagtggctatgcaatgaacagtggctatgcaataaacagkggcagaggagacacaggctggtggaatga

SEQ ID NO: 2651 - DNA, 39 bp, Saccoglossus kowalevskii
  source 1..39: mol_type = unassigned DNA
aaagcacagataccatataattaaaaaacaatatactag

SEQ ID NO: 2652 - DNA, 48 bp, Saccoglossus kowalevskii
  source 1..48: mol_type = unassigned DNA
aagttaaatctagtgagtacttatggtgtaaaattgatagtaatttag

SEQ ID NO: 2653 - DNA, 126 bp, Salmo salar
  source 1..126: mol_type = unassigned DNA
ctctcccgagctttcgctcgcctccagcacacacacactgttggggcgagtgactctgaacttacaatggctagccccaagtcgttatatatttaattttttcttgtgcattttgctatttgcctc

SEQ ID NO: 2654 - DNA, 1034 bp, Salmo salar
  source 1..1034: mol_type = unassigned DNA
ctgtatccggtacaaagacaacaaaggaaggatggtaggcgtgcctttatcattgtggacaaactctttatagatggacagctattccgagacagctccataacaccgtggctgtactaaattctacagggacttcaggttacgaaaaaaagaaggtatgggaactgtaaaaatatctgaacattatgaagtggatatgaacacacacgtactcaattacatgcttgcttacacatacggacttatacatacacacacacacctgatctcgctctcttctctcactctctctttctctcttctctctctcttctctccctctctctctattgtcgagaactgttttataatttaatgtgtttattgtttgtctatcttttttatgtatttgtctacaagtttatatatgtttacaacaagcaaggggaagatatcagaataggggcattggggaataataacatattgtacggaatacatttgtactgtagtgaagccgtctctagagtaatgcaaggtctctttcatgatcatgtgaaacgtcaattgctatggaaatgctgggatgtgtttttcaattatgttaaaggtaattatgatgcaactatgatggtgatacgatatggattacaattatcatatgaatattaaggctatacgcactacatgttacacacatagacactcaaacatgcaaattggcagagttattatttatttggacatcacacattatagtcttactcttatacagacatcatacacactctcattatatcatatccaatatcatacacatcaacctactcagatttgctacacacataatatcttgtctcaattttctaacatctgtggcattggctcacaggcaaacaggcaagggaataaaacaaatattgctagaacctatttcttgaattctaaatatcagacatttgaaagctctagttttgaccttcataatacctctgatggcagtaactttacaagcactaattatggtcaatttagactgagaatagtatctagtt

SEQ ID NO: 2655 - DNA, 607 bp, Salmo salar
  source 1..607: mol_type = unassigned DNA
taaaaaaaatgtattttttattattattattttttttgattggggggtacgttcaatttakcaaaatccttgttccsatctcctaacccacaatatgtaattgtactgctgtctatgtcggttgctgatggtttatgtttagaccggcattgcttagcaatgtaatcttgtgatgctatatcttgcttatctcagggattgacccaagatgamgcttaagtgcgcaatatgtttaagttgcaacttattctgtttaggtttaatagatgctaattgaacactttaatcgcgggagcctcctcagttcagatgttagtagaagttctaggatagtgagaggtgaacgtacagttgggattttatttttgttttacctcttgttcgaggtcgcgccgtgcttttttggcatcggccagacaatgtgtttattatttttattttcatgtttttttctctcctatttgtgtatgcctgttaaatgtgggttgatggggggggtaaatgttggggaaagtagggggacagggtggagagtaaaggtgcttgcagggggggaggggtgggttggatactgctcgggtgtaggtgctacatatgctgatcgtga

SEQ ID NO: 2656 - DNA, 85 bp, Salmo salar
  source 1..85: mol_type = unassigned DNA
atgcttttttttgctatcgtacctaacattttaacggtttacamcgacaggagctttgtatttcattcattttttacsaggaacg

SEQ ID NO: 2657 - DNA, 133 bp, Salmo salar
  source 1..133: mol_type = unassigned DNA
agatggcgccgacagacatggcagctctgcttctagctcctaagcaactttgcagtatttgtttttttgtgtgttatttcttacattattagcccagaacgttttttgtgttattacatacagccggaaataa

SEQ ID NO: 2658 - DNA, 97 bp, Salmo salar
  source 1..97: mol_type = unassigned DNA
gcgccggaggagatggctgccgttttacggkctcctaaccaattgtgctattatgtggggtttttttcgcgttatttgtaacttattttgtacataa

SEQ ID NO: 2659 - DNA, 333 bp, Salmo salar
  source 1..333: mol_type = unassigned DNA
gcccacaggactggaaaacccacmacckgcccaggtgataggcccaggccgaggtwgctkttctggawagagccaagaacttgwgaggaacgtatatcttcctcaacgaggactgtcctgaagctgtgcgccagaagaggaaagagctgatcccagccatgaaagctgccagagtgcgtggggacattgcktacatccgctacgacaggctcattgtccaccctccctcccagaagcctggaagggatgagagagccaagcctatgggttcgtagcctcaaccccacacacacacacacacacacaccaattgattaatggactgctgaatgt

SEQ ID NO: 2660 - DNA, 650 bp, Salmo salar
  source 1..650: mol_type = unassigned DNA
tggcgccggagaagaaggcagacgttttacgtgtccccaaccgattgtgtttttttgttcgtttatttgcgttgtttgtaacttatttttttacttattttgtacataatgttgccgctaccgtctcttatgaccgaaaataacttctggacatcaggactgcgattactcaccacggactggcagaatcctttttttcctttaacgagtctgacgagcccgacgcgaacgatatactgctttctcgggaacaggcccagatccccgtgatttgcgtgaagaggaggcggagaaaaaggggccagagggcgggctgccttctgagaattcgtaggcgatcgaataaacccccacttccttccattctgctagcaaacgtgcaatctttggasaataaaatagatgacctacgcggaagattaaactaccaacgggacattcaaaactgtaatatcttatgcttcacggagtcgtggctgaacgacgacactatcaacatacagctggctggttatacgctgtaccggcaggatagaacagcggcgtctggtaagacaaggggcggcggactatgtatttttgtaaataacagctggtgcacgatatctaaggaagtctcgagctattgctcgcctgaggtagagtatctc

SEQ ID NO: 2661 - DNA, 447 bp, Salmo salar
  source 1..447: mol_type = unassigned DNA
atccaagatggtagccaatcagtctgtccgtttgtatgtgtgatccttgagatcagagttttaagagtttttatgttttaatgaccctgatcctgtttacagaagcaaatactttttatgtgaaggtggatgctgtatataacaactattatttttagatctcagtctctattttacgaaatttacttgtacaaagatttcggattgagaaggcctttatttttttctacacctttctggagttggagctcgccgagtcaggagcgtctgtctgcgcgcaaggcctgctacgcgagcgcaggtgcgcactgaaggctaggagcggagaagcggttatcggattggaaaacctgatgcaccgtgggcggtgggaaaatctacgttgttctacacaacgtctactggtcgttgcacacctgtgctgaaatacctctaaaaaccggcatt

SEQ ID NO: 2662 - DNA, 81 bp, Schmidtea mediterranea
  source 1..81: mol_type = unassigned DNA
tatacaaacaccgataaactataccttcccaatcccgatccagaattaaattcaacactttcgaaggtttgtcgaaagatt

SEQ ID NO: 2663 - DNA, 146 bp, Schmidtea mediterranea
  source 1..146: mol_type = unassigned DNA
tttacacattgacattcgatagcaccgggccgaaatccggatctgataagttattttattcaaaacaaccattactttattttccagataataatgaattaaatgctgatcctatctttgagaaaagtttgcaagaattacgtctt

SEQ ID NO: 2664 - DNA, 10 bp, Setaria italica
  source 1..10: mol_type = unassigned DNA
aactccgcct

SEQ ID NO: 2665 - DNA, 593 bp, Solenopsis invicta
  source 1..593: mol_type = unassigned DNA
tttttgtgttctcatctttttttgtctggtcttgatcatttgtggtgatgggtgtcatttttgtattgaatagattttttattcttattttaatatatttgaaaataaattctagaggatatccgttttatagaagtagtccaataattaattccaaatttttttgttggaaagtaggatgagatagcaatagcgctctatccaccatgttatagattgttccaattttatggcatattgggtggtgagaaaaaaacgataaataacgaccagagaaagtttttttatggaaccaatcaatgatgattgtattgtcggttatttttaatgacaggtccaagaaacttaggctacggtcctgttccaattcaatggtgaattgtaatctattatgaaaactgttaaatgtctcgaggataaaattgagtgagttcggaggtgctgccataacaatgtcgtcgacataacgataatagaacggtatttctagatttattgactttaacgctttttcttctaaaccgtgcaatacgatattcgctataatgggtgataagggcgatcccattggtgtaccaaaagtctgtttgtaa

SEQ ID NO: 2666 - DNA, 371 bp, Solenopsis invicta
  source 1..371: mol_type = unassigned DNA
  misc_difference 242: note = a, c, t, g, unknown or other
  misc_difference 254: note = a, c, t, g, unknown or other
ggactttgcggcggggctcggcctggtccttctgaaccggggccgggtcagcacctacgtgggggccgggggggagtccatcgtcgacgtgacgtgggcctcccccggcgcccttaacagggtaaagggatggcaagtggagaccggctccttggaagaactgtctgatcacagacttatctccatggagctggtctcccccccccccccccgcggaggtgcgtgagcaacgccgccgcaancgggccggaaancgatgggtcctgaagaaactcgaccccgaagccctcgaggtcagtctcctcgcctccacttggccggagggaggagctgacctcggagccgaggaggaggcggagcgcctatgcgag

SEQ ID NO: 2667 - DNA, 365 bp, Sorex araneus
  source 1..365: mol_type = unassigned DNA
atccactacccagccaccgccaccctccaggtcgctctccggacacttgggccgaacctcacgcacgagtgaagccccgcaaagccaggtaagcagaactttgcgaccttgagctctaggttcaacgagacctggaaacaagatcctctgtctgcctcctccaatctccggcatctgagggaggggtccaacccagacgccccaccctacccaagataaatacctcactggccgacccccactacatccactacccagccaccgccaccctccaggtcgctctccggaccgcggacacaccataaaacacttaatacccattattcccgcaccatatttgatagggttcaaatttggtgtgaacc

SEQ ID NO: 2668 - DNA, 174 bp, Strongylocentrotus purpuratus
  source 1..174: mol_type = unassigned DNA
ggggcacgcaacaagagtcctatctcgcaccccggggcaacgtgtctgacacggccggttgtagcaactacttcgaagatcaagattaagattaagattgagaataataataatttagacttagacttagagtaatattaagattacgattaagatcaagaccaacataacata

SEQ ID NO: 2669 - DNA, 354 bp, Strongylocentrotus purpuratus
  source 1..354: mol_type = unassigned DNA
  misc_difference 50: note = a, c, t, g, unknown or other
tgaatgcgcctagcaggcagccgtctctgtttttgctctgaattttaccntgttttaccactgataatctgagtgtatgctgttttattgttgatcaactgtcatcttatgtacttgtgacactgcatgacatttttgaggtgatgtatttatatattagatactggaaactgtttttctaaattttgattcaacggatgtgtacacagtacatgcaagtaaagccattttacactgggctgttacacatgtactatactgcgtggatgtgtgaacgtcgttcgtgtgtgactgatttgcctatccgtggtgtgacattcatctacatacaatgaatagtcttgatacgcactg

SEQ ID NO: 2670 - DNA, 153 bp, Strongylocentrotus purpuratus
  source 1..153: mol_type = unassigned DNA
ggtatgcggctctttatgtaggtaaccccttttaattagctcagggaaaatccacctcccctgccttgcatagatggcattggaaggtgtagcgagcctccattgtagctatactttgaatttattcttattagcaagctaagaaacactgaa

SEQ ID NO: 2671 - DNA, 538 bp, Strongylocentrotus purpuratus
  source 1..538: mol_type = unassigned DNA
ggaataccatcagagttggaacatggaatgtgagaacactgtatcagagcggcaagctggaaaatgttaaacaagagatgatgaggctaaatgtcaacatattgggactaaatgaaacaagatggctgaataacggcgagtttgtgatagatgagtacagattgatttatgcaggaggtgaaaagcatgaaagaggtgtggggttactgctggatccagatatctcaaagagtgtgttgggacactggtgtgtaagtgatagggtgctcctagtgaaattacagggacacccttttaacatctcaatcatagtggtttatgcaccaacggcagatagtgctgacgaagttattgacaccttttatgattccttagataaagctaaatctcagtgcaaatcgaatgacattgtcattgtcctgggagacctgaacgctaaagtcggtcatggtacagagggcaagcagtaggtccgcatggaattggtgaaaggaatgaacgaggggacagatgggttcagtggtgtgagggggagaac

SEQ ID NO: 2672 - DNA, 434 bp, Strongylocentrotus purpuratus
  source 1..434: mol_type = unassigned DNA
ttctctactataatcagtgtttttatcacagcactgaatagacataatcaataaagtaaagtaatatttggttggttcaattagtactcttatcataagagtaattgtaatcgcctcattcttttattaaatgttaattgtttttgccatgcttagttgtaaccactgccttgtggttcaggttctctttagaatctaactaaggctaagggagcaaaccctaacagaaaaccatgccaccgtgacagcattgagggcgattgacgatacggaactcccgacatccttcgaccagtcactgcagggtctagtggttcacacccgtcctggcttgtcctcgccggtgtgaaactgccaccagttccccgagagagtgccgttagtaacttgcaagagctaccggtacttatccacctttgcaagcagccttcatt

SEQ ID NO: 2673 - DNA, 847 bp, Strongylocentrotus purpuratus
  source 1..847: mol_type = unassigned DNA
tagtatgtgacaattatcatgatggaaaattcgattgtccaaatgggtaaagcatttgaatcttgaaagaattgtacggttgtcactaatcctaaattgtcatgattgtattccttccaggggacatgcagtagaactttgtatcatgcaggaatgtattctttaccctcaaatgggcttgagacaagtattcgttatcctttgatcttgacgactgggattatcaagaccgaagtcctcactctttatcaatcattattatctgtatagcattccaaaaatttgagtctatctgttatattgtaattgactgaacttttttttgttttttgagcgggaatgtcaaaaccctctttgccatttaatattattgtactccgaaatgacgttattgctattaagcatcatctcagagtctgcttacatgcatacatttttctcctccgcacaacaaatctctttgttttgcaaaactcctgtgtcaatcacagaatccattgttatagactgaactagttttgatgagcgggaatgtcaaatccctcttttccatttaataatcgtactccgatttgtcattattgttatcaagcattttgtttcttcccagcccctctattttgcgtgtcaaaaatacaccctttactcgggcggtcgggctccgctctgttgctcctaagcaattattgtaactgtgaccaagatgggtcttattgtattttcatttgtattatattttgaagttacccgcacacttgcacttcgtacacacacaaacgcaccagcatcacacatgcagttgttcatcctccaaattttcggtactttacataatacgtatcgttaa

SEQ ID NO: 2674 - DNA, 101 bp, Strongylocentrotus purpuratus
  source 1..101: mol_type = unassigned DNA
  misc_difference 28: note = a, c, t, g, unknown or other
gctgtagtagtctacatgtgtactgacnctactgatctgttcctgccagcaagtaatgtatgtattattagtagtagttcttcataattagatattgtgta

SEQ ID NO: 2675 - DNA, 134 bp, Strongylocentrotus purpuratus
  source 1..134: mol_type = unassigned DNA
aactaaagcaacaatttgaagtctatcatcgcgatcttatcgccagtaggcctacatctctagccctctatcatcagaagagtttcctacgcagttcctggaagcacgtgtccttttcaggacaagccatcaag

SEQ ID NO: 2676 - DNA, 96 bp, Strongylocentrotus purpuratus
  source 1..96: mol_type = unassigned DNA
gaccatatttttgttttgaaatccctgcttgacatttacttgtctaaacggaagagaatttactgcgcttttatagactatagaaaagcttttgat

SEQ ID NO: 2677 - DNA, 947 bp, Tribolium castaneum
  source 1..947: mol_type = unassigned DNA
ataatctttaacaaaaatttgctttaaaataaaatgtttgaaaaaccgaaattaaactaaattaattgtgtctaacactttagtagaggaaaaaggagaagacataaaagtcaccaaagtcttcagagtcgtttttagtactaaatttgcttatatgcaagcgcttaattaaggtaacagttttttggtttcttgcttatatctcgaaaacagttactcctatcaatttttatctttttactaaaattaaagctgataaaatttcctacaaaatagttatttgcatttttcatgtaggactaaccataagcgagatataagtttgaaaataattaatatttaaaaaaagtgctttaacagaaaatgccttgtgatttaaaatacacttaatttattgggtccaatactttattatttactttatttttttggtgctatgctaggcttgtgctaatgtgctataaataaggtgttacaattttgtgctgtaaataaggtgttgtgcattttgtgctataaacgtcagttttttaatttttcgttaattatttgtggtaataacttaataagtgactaaggtttaaggttatgttaaactgtagtcaatagcgttttgcatttcttttggactttcaaacatttatactttacacaaagagttatactgatataaatgacgtgatcaatgctcgtactataaccaataatccaattttgtgctactttttatgaacattagtttttacatgtaaatttcatatcagaggcgtacgcttctagaattgctgataataattattattctatcctctgttccttttgtgtcctttccgtggcctacctgtgcttgtttttttattttgagtcactacgaacggccgcgtagtgtgaagcgtgtgtccttgtctttattcccttgcctgattgtatttatcaactcactcata

SEQ ID NO: 2678 - DNA, 484 bp, Tribolium castaneum
  source 1..484: mol_type = unassigned DNA
attctaagcattgtaaaagtattttttatcatataatatgtatgaaatggttcaagaaaacacaagaataaccgcacgcagtaaaacaagaatagacaatgtttttacaaatatgacctttaataactttaaaatagaagttcttgaaccacacatatcggatcacatgggtatacagctaactacgagcataaaaaataatactaataatactgatgcagtaaaaaacgttagaattttaaatgtatatgcatgtaatcgcaatgatatcaatgctcagtggagcaattttataaatattttcaatgataaatttaacgaatgttttcctctaaaacaaataaaagaaaaaaaaacaagaaaatatttataaaaatgatcctaaagtaaaatattataaatattatctagatttgttatctgtgataagtaagtgtgacgataaatatgttattctttataagtatttgaaaaaaaatacgac

SEQ ID NO: 2679 - DNA, 423 bp, Xenopus laevis
  source 1..423: mol_type = unassigned DNA
caccctcccccagggaagacacatctgcaagggctcccagggcactgttaaaatctgcacccatccgtgctttacaagtccccttctgccaacatctcccacaccagcagcctaaaagggacatccgctgcctaaaggaggaaaaactggctctctagcacacacagagccggagaacaaaacggggcctacctcctcgacagaagccggggactcgagtagtagaggtacccgggaccgagctggggcctgaactgcagggcagactgctggcctggtgacgtggggcacctcgggggagactgtgggcctagtggcggacaagatggcggcgcgacagtagattgcagcggcctctccggatcacaaggtgctttcttttttgtgttttttgtgcttttttactttgttttttgtgaagct

SEQ ID NO: 2680 - DNA, 927 bp, Xenopus laevis
  source 1..927: mol_type = unassigned DNA
ccccagacctgtgtgcagcagctcccagcttttactctccctatttattaagacctctttaggggagagcatttgctggggtgagcatttgcaagggtgctattcgaagtgattcatttacaagtgatctggaagagtttaacaaggagttatgaattgacatctctcttcctcttctgtttattacaggtaaatctgctaaaactgctattcccatctctgctgtggccctgttgtctgcatttttgcacctttattggtaaatctgctaaaactgctatgcattcccttccatctctgctgtggccctgttgtctgcatttttgcaccatttattggtaaatctgctaaaactgctattgcattccttccatctctgctgtggccctgttgtctgcatttttgcaccatttattggtaaatctgctaaaactgctatttccatctgcattacacctacactgtttagtgagttatatttatgcattgttcatttgccacttctaaactagtcacataatattgattataagttctccctgtagtcttgtaacttgtacattttacgaccccctataaactcctctccaaacaaactttgtaagtcaggttatctctgtattcatcctgagtcttgctctgctctcactctctgtcacagctgggtgatcagtttggtgtttgatcaattagaatcagttgtgattccccagacctgtgtgcagcagctcccagcttctactctccctatttattaagacctctttaggggagagcatttgctggggtgagcatttgcaagggtgattcgtttcgaagtgattcatttacaagtgatctggaagagtttaacaaggaaagctacaaggagagacaacacagaggactccattaaggacataacactgctaccggctagaaactgca

SEQ ID NO: 2681 - DNA, 24 bp, Xenopus tropicalis
  source 1..24: mol_type = unassigned DNA
ttgttttagacttaattctactag

SEQ ID NO: 2682 - DNA, 785 bp, Xenopus tropicalis
  source 1..785: mol_type = unassigned DNA
agtcctgtgttcaggagtggcccagcttgctctccctatatcttaagaacctcatttgggaaagcagcgcaagggtagcagcgcacaagtgaatccttccaaagtgaatcattcacaagtgaactggaaaaggagtttaacaaggagttaggaattgacaccctctctcttctgcttattctacaggtaattgctgcactatttccatctccactgtggccctgaatactgcatttttgctagtttattgggtaattgctgcactatttccatcttcactgtggccctgaatactgcattttgctagtttattgggtaatttagctagttctatttccattctcaattcccaatattgcatgccccctattcctgtgctccaccaatttgttgattttatgacccccatcgtaaactcctctaaacaaactttgtagttcagtgtatctttgggctgatcttcacttgtgcacttctctcatcctgggactcagctgattgatttaatttgttatttaactagctgcaatcagctctgattccccagtcctgtgttcaggagtggcccagcttgctctccctatatcttaagaacctcatttgggaaagcagcgcgggtagcagcgcacaagtgaatccttccaaagtgaatcattcacaagtgaactgaaaaaggagtttaacaaggagttcaacaagaggagcaacaggaggagcaacagcagaagaccggccagcctctgtccatttgaatcgggacccagtttactggatatacctgcata

SEQ ID NO: 2683 - DNA, 1348 bp, Zea mays
  source 1..1348: mol_type = unassigned DNA
gggaaaccataactgtggaacaattgcttaatccctttgctagtgttcaccaggttcatcctgacaccctggagctaaaggatgtggctgtttaccgatgttctgcttggtgtttagacccgtccttggtgcctgcttcaagggagctttggatcgtcgaacctccctttgccgttgatgggatgtcttctggcaggagaacgctgatgtatccaatccgcatcacattctcgtctgccccacggagggatggatccgatcctaagcttcatgctattacttcgggcggggatggttctggtcacgtgcagcagggatcccctcctttttcaagacctccccattcgagtgggagaaggggagaacatggtcattcgggacgtctctcagttcatgagcgtttgggcccaagagatgagaacatgcagcagcggagcattagctccggggtggcagtttcagatttgaggagaactttggaatctgatggggggaccttgtctcctaggctggtagagatgactgatgacatggttcttgtttcaccggtgaaggcgaagcagctgaaagtttattttcgtcaaagattcaagaatgtcctgaaccaggaggaagctggaactcccaattctgtcactgtgcttcctccatcccccacagacgtggcagctgctgacacagatccatctgagtatcctgtttcagatgttgacgctgtgttggcaactccgtctagaacattacctccctccctgtctgatgtggcagcagcacacgcggctccgtcggaggctaatgccttagacgttgatgctgagttggctgctccatctgaggaggacatttcagcaacaacacatgctgcgttggctgctccatctgaggaccctccagcaacaacacaagattctgtggagatttgtgctcaagagcaattcatcagcaaattgtcaaaccagatcacacgcgtattaccaatcccaaaatctgtcagacgtcagtcctctatccccctggcagttccaagacgcagccgacgtgtggcgggggttggagttgaatttaaaattcaggattggggaaaaagatctaagaaacaagctatggtggctctaaatattattgaggacaatgaaggattcagccgtcaagctttagatgactacgccaagctcttcaagaatactctttctcgtagtcatgtgcaggctcttgctgccctttttgggtggtctgtcccagataatttagaatatataactgggactggggatattaccgcaacaagcttattttagctggcgatgttgctgatattgtttgtcgatttacctctcattgtttctac

SEQ ID NO: 2684 - DNA, 353 bp, Zea mays
  source 1..353: mol_type = unassigned DNA
aatggcaagggtcttcgcatctgtctcaacgggtgcgaggggtggaagctagttgagccgactaggatccgtgtaggtagttggaacgtagggtcccttacaggtaagctaagagttagtcgatgcagcgagcaggaggcgtgttagtatcgacaaaatggaaggggcaaaaagcgaaggaggtggagaacactggtttactttggtactcaggaacagtggcaaacaaaaatgagtaggtatcctgattgataagaccctcaaggatggagtggtggacgtcaaaaggcagggagataggattatcctagtcaaacagtttggggatgtagtcttgaacattataagtgcat

SEQ ID NO: 2685 - DNA, 144 bp, Zea mays
  source 1..144: mol_type = unassigned DNA
  misc_difference 107: note = a, c, t, g, unknown or other
gtctagtcagcagaatcccccaaccctagtgaaacttgacagagtatttatgcacactggactgggtggatttgtttccaaattccttgcttcagagttctgcctcnaatgactcagaccactgccccctccttttgggcctga

SEQ ID NO: 2686 - DNA, 195 bp, Acropora digitifera
  source 1..195: mol_type = unassigned DNA
taatttattcacaacttcatgtgaccatatcttcaccaatggcaaagctcctctacactctcatataaaccacaacaacccacaattcctctattcgctctgacgaagggctaacgctcgaaacgtcagctttctaaatctttcacggtggtaattcaacctttatcaactcgtttgataaaaccaaatttttgt

SEQ ID NO: 2687 - DNA, 228 bp, Acropora digitifera
  source 1..228: mol_type = unassigned DNA
taatattgttacctcttatcatgttatttcattattttttcaccttatacttatctttagtttacactgtcaattatttttacttatttccggttattacaaaatatgcaacataaaaatcacgtaccaatgtaaaattctcattgtacctgaagaaggctggtttggccagccgaaatatagtacacctacaaaaaagatccttctacgttgtgtcgacttctgctt

SEQ ID NO: 2688 - DNA, 317 bp, Acropora digitifera
  source 1..317: mol_type = unassigned DNA
tgatttactctcacagtactgcccaacgtattctacgatacacgtactgaccttagacctgtagacggatcgaaacgcaccaatcactgtttagtctttccagccaattacatctaggctcaactgacagtcgaccaataacatcacgaataagttgaccaattacatctacgaccggagtttttatagtatctactgacgttacacaaatcacttgactctgaagatgacttccgctcaggttgtcgaaacgtcagtcaatgtcatctcaaacagtccttctcaggactacactcacccggacgatcgtactttac

SEQ ID NO: 2689 - DNA, 237 bp, Aedes aegypti
  source 1..237: mol_type = unassigned DNA
tgatcctgcccaatatgacgacgacattgatgccagcccacggatacgaaactgttttactaaattgtactatgtatagatgtaagcttgaaatgttagattgacagttatctccttttcatcggttcagtcttctgctgaccgtatttctccagggtctcagccttctgctgagccttctcccgtgttgaactagcataatgttaaaaaacacgttaataaagatgaaaaaaaaaa

SEQ ID NO: 2690 - DNA, 18 bp, Aedes aegypti
  source 1..18: mol_type = unassigned DNA
taagtaagtaagtaagta

SEQ ID NO: 2691 - DNA, 345 bp, Aedes aegypti
  source 1..345: mol_type = unassigned DNA
tgaatacataggtagatagttagggatttgtataattattattatcccccttttcaatttttgaccaagacatgacaggtatactcctgtcgaaaattttttcctaggtagtttgattgtgtaggtacttatctggtgttagtatttaaggtagagagatgcgacgatttcttcagtggatacgagtaactgacactgaagaagactgcaagtggtagtcgaaatacgcgtatctgtcaaagataagcatttaggagcggaattaaaaggtacacggtactccatctactttaaagtttctctattcgagattctgctcagaggattcgaacattcattaaagag

SEQ ID NO: 2692 - DNA, 123 bp, Aedes aegypti
  source 1..123: mol_type = unassigned DNA
taatgtatcctgttaagtgttgtccaagagttgatgcttagtttagtttagttttaattttattcattaagaccatgatgtcggatgaatcttcaatacaaatacaaatacaaatacaaatac

SEQ ID NO: 2693 - DNA, 476 bp, Aedes aegypti
  source 1..476: mol_type = unassigned DNA
tagtttgggccccgtatcactctgtacacatcaatcgacttgaacgagttcaaaaaagttttattaggtatgcactccagagactaccttggcgaaataggatgctgctgccgccatacgagcatcgctgtgcactcgtcgacttacctacactacgcaacaggagaactcttctaaagcagcttttcatttttgatctgctcgaaaataacatcgactgctctggtctgttaggcaaattaagtttcaacacccctgtgaggctcctacggaggactgcactattccgacacgctgctcatcgaacgttatatgggcaaaataatccgcttgatgtatgttgtgaaatgtttaataatgtgtatcacttgtacgattttaacatagctaaggaaacatttagattaaggattctacggaattgaagtctgtgcgatgtatttttatttaaatcgaagaccaaataaatcaaatca

SEQ ID NO: 2694 - DNA, 432 bp, Aedes aegypti
  source 1..432: mol_type = unassigned DNA
taatatgcattttttctaatgccacttccgtatctgttctttgtcattccacgccaccaccacccttcgccaccacccaccgccagccaccaatcaccaccacccactgctagccacccgccgccagccacccgccgccatcgccaccattcatcacttcacccatcgcttgccaccaacttcagtaaagatcaatgctcataaatatttataatgtgaattgaaagtttgtgaaaattctaaactatagcgcttccttcaaagagctacgctcattggaagtgcagttatcgctcaatcgttgaattatacttatttttttgaaaagatgagaaggttttatgcctatgggagaagtggcttaaagtagctacactctcacgggcttttcccttctccaagagaaaaaaaagcagtaaataaataaataaa

SEQ ID NO: 2695 - DNA, 115 bp, Aedes aegypti
  source 1..115: mol_type = unassigned DNA
tgatttttattgtgtacttgtttttatatatcttgacctattttgtcgtaaatttaagtaaccacacatcattgggactaattgtctgttggtgtaaacaaataaacaaaaaaaa

SEQ ID NO: 2696 - DNA, 145 bp, Aedes aegypti
  source 1..145: mol_type = unassigned DNA
tagaacattcaggaaaatcgaattcaggaacataattcgagttagttaaatagttttaatggaatcaccacagtgtaacatttcaagaaggagtttccttacgttacataaattcaaataaagaaataaataaaataaataaata

SEQ ID NO: 2697 - DNA, 71 bp, Aedes aegypti
  source 1..71: mol_type = unassigned DNA
taggatttagtttcaattcatgtagacaaaagtcagatggataatatacaaatatacaaatatacaaatat

SEQ ID NO: 2698 - DNA, 149 bp, Aedes aegypti
  source 1..149: mol_type = unassigned DNA
taatgttgttttatgttgttgtatttttatcgttgattgtaattttgttagtaactgcttcatatttgttaaactagaataagatatacataagttatacatcattgggacctgttttgtctgttgatgtcatccaataaataaataaa

SEQ ID NO: 2699 - DNA, 107 bp, Aedes aegypti
  source 1..107: mol_type = unassigned DNA
taatttttgtaatcttggtttgaatattttagtgtttgtattttgtttaagaaacaagggtcattggggtaatgttttacctgttgactaataaataaataaataaa

SEQ ID NO: 2700 - DNA, 63 bp, Aedes aegypti
  source 1..63: mol_type = unassigned DNA
taacagtctggcggattaaggtattgatccaagacgtagcaattaaataaataaataaataaa

SEQ ID NO: 2701 - DNA, 72 bp, Aedes aegypti
  source 1..72: mol_type = unassigned DNA
tagcttaagaaacagtctgtggaatgtaacaattcgagacggtgacaataaataaataaataaataaataaa

SEQ ID NO: 2702 - DNA, 94 bp, Alligator mississippiensis
  source 1..94: mol_type = unassigned DNA
tgatctcagcagtattcctgcccagagcaggggggttggactcgatgatctttcgaggtcccttccagcccttaatttctatgattctatgatt

SEQ ID NO: 2703 - DNA, 96 bp, Alligator mississippiensis
  source 1..96: mol_type = unassigned DNA
tgaccccagggttggtgactcttttcttgcctgccaggggcagggggtcagactagatggcccactgaggtcccttccaactctatgaatctatga

SEQ ID NO: 2704 - DNA, 27 bp, unidentified
  source 1..27: mol_type = unassigned DNA; note = Description of Unknown:Amborella trichopoda sequence
taattgggaaaaggctataatgatgat

SEQ ID NO: 2705 - DNA, 331 bp, Anguilla japonica
  source 1..331: mol_type = unassigned DNA
taaccaccaccattctgtatatttcactctttaatttaaaaaaaaaacaaaaaaaaaaaaaaaaaccccccccccctttttcatgtcacttgtatttgtctttgtcctaatactgtagcttactcttctgcctagttggctttgcacaggttaggttagaatagtgttcactgtgtgaactgtgttcttagctagaaatagctgtacaaaataagtattatacctttctgaacttgtgttcagcagatgcctacgaccatgatatgcacttttgtacgtcgctttggataaaagcgtctgcgaaataaatgtaatgtaatgtaatgtaatg

SEQ ID NO: 2706 - DNA, 84 bp, Anolis carolinensis
  source 1..84: mol_type = unassigned DNA
tagacacttgggaagtgtccgacgtgtgatccaatacaacagccagcagagtgtctgctgtggactcatcttgttgtgtttcaa

SEQ ID NO: 2707 - DNA, 172 bp, Anolis carolinensis
  source 1..172: mol_type = unassigned DNA
taaatcagatctaatttgccaaatagtcactgttgaatgtttttagttgaatgtttttatgttgaatgtttttatattgtggaatgatattttaaattgtaagtcgctcggagcactctggtggagagcgactaattaagaaataaagtgaagtgaagtgaagtgaagtgaa

SEQ ID NO: 2708 - DNA, 126 bp, Anolis carolinensis
  source 1..126: mol_type = unassigned DNA
gcttttcaatgctaattaaagtgattaactacacaacattcacactgacctctctcaccctagactttccacagatatatattaacctctttgcttagttttctccatacctcacaacctctgagg

SEQ ID NO: 2709 - DNA, 109 bp, Anolis carolinensis
  source 1..109: mol_type = unassigned DNA
tagtattaatgccaagtttttgtttttttttcttaaaaaaaatctctatgtttgcaaatccattacaacttgtaccctcggtttcgcttctgacacgagaaataaataa

SEQ ID NO: 2710 - DNA, 103 bp, Anopheles gambiae
  source 1..103: mol_type = unassigned DNA
taaatgttctgttcgttatctaatgtaatgtattgtaaacaaattttgactcgagagggcttcatagtccatcgattaataaactaaactaaactaaactaaa

SEQ ID NO: 2711 - DNA, 253 bp, Anopheles gambiae
  source 1..253: mol_type = unassigned DNA
tcctttataatccttttccctgatactcttccctatcctcttttttctcatcctcttttttccgactatcatatctaatattattcactcttcttttcttacgtttgtattttatcctaatatctgtctttcatgtgctcaaaagttcgctttagtattaggaatttagataggttaagttaggaattagttagatttaggaattgtgaaaccatcaggctgacaatttgaataaacttgaaatgaaatgaaa

SEQ ID NO: 2712 - DNA, 160 bp, Anopheles gambiae
  source 1..160: mol_type = unassigned DNA
taattttattttcaaaatacattttctattcttgtgcacctgttctcccctatcgatttatgtaccttacatagtctataagcactaatttaagtacattcatgtaggatcttcaagatcccgatggattaatcaataaacatattaaacatattaaaca

SEQ ID NO: 2713 - DNA, 13 bp, Aplysia californica
  source 1..13: mol_type = unassigned DNA
tgatgatgatgat

SEQ ID NO: 2714 - DNA, 106 bp, Aplysia californica
  source 1..106: mol_type = unassigned DNA
tgatttgtctagcctgcacgcaatgcattattgtcgttcattaccagatagttgaacaggctctacttagagcctcaaacaactaaatcgtcaatgtcaatgtcaa

SEQ ID NO: 2715 - DNA, 197 bp, Aplysia californica
  source 1..197: mol_type = unassigned DNA
taaagttggcagcagaggaaaacagtcgaactaacatggagacctcacatcggtgagggggctcggtgcgtcagaaaagctgtagagaggaagagcccgaaacagcgacgcattctctcctgatgatctccatgctagagtccgggatacggagcgttcgacggtgagcagtgcatacggctgtttagactacgtac

SEQ ID NO: 2716 - DNA, 653 bp, Aplysia californica
  source 1..653: mol_type = unassigned DNA
tagagacacttgagagtgggactgatgtgaacaaagatatattgcacttgatttggagtctacataatttgataagtaggcaccacgtcagagtagtcctacaatggattcctgcccacactgggataccgggaaatgaaagagctgatgctctggcaaagaaaggagctagcctccctcagcctgaaattcctacgaattacaccacctgctgccaaatgatcaagtcaaacctcaaggaagagtggatgaatgattgggccacaggtacgacaggaaggaggatgtatggccacatgaataaaccactggtcaaagatccaatcaatgagttgaggaggggagatcaatccataatcttccaacttagaacacaacatgtacccctcaaccaacatctcaaccgaattggagtaaagcagtctgctgcctgcccactatgtgactacccctcagagacagtggaacatcatctgttcttctgtagaaaactaactgatttaaggggatgttttcttcccaagctaccccacacatctaattgcctctactcctcaagacaacaattagaacaaacatgcaactattaccgaatggcatcatgcagaagagttaacgctcagatgctactggatcgctaacaacaacaacaa

SEQ ID NO: 2717 - DNA, 10 bp, Aplysia californica
  source 1..10: mol_type = unassigned DNA
tgatgatgat

SEQ ID NO: 2718 - DNA, 25 bp, Aplysia californica
  source 1..25: mol_type = unassigned DNA
taaagggatttgaaaacaacaacaa

SEQ ID NO: 2719 - DNA, 19 bp, Aplysia californica
  source 1..19: mol_type = unassigned DNA
tgagaaaggcaatgatgat

SEQ ID NO: 2720 - DNA, 46 bp, Aplysia californica
  source 1..46: mol_type = unassigned DNA
taagctaaattgaccgtctgcatagacgaaaagagccatatatata

SEQ ID NO: 2721 - DNA, 99 bp, unidentified
  source 1..99: mol_type = unassigned DNA; note = Description of Unknown:Blumeria graminis sequence
tgaaggttgacagacttctcccagtagcaaggaagtggacggtatccgcactggacatgacagtgatagtgcacttcttgaaggtaacacaacatcaaa

SEQ ID NO: 2722 - DNA, 183 bp, Caenorhabditis sp.
  source 1..183: mol_type = unassigned DNA
tgatttctcttgtctttccctttcttcacttgtcgcttttgtttgacctcccattcgctccattttaggcatatcccccgtttctctttctcccccggtgaggcctcgtgaggggcacttgccaggttcttctgatgtatcatattgatttttccctcttttggaaataaataaataaataaa

SEQ ID NO: 2723 - DNA, 36 bp, Caenorhabditis elegans
  source 1..36: mol_type = unassigned DNA
tgaagaacggatcgtctaagtatctaagtatctaag

SEQ ID NO: 2724 - DNA, 40 bp, Caenorhabditis elegans
  source 1..40: mol_type = unassigned DNA
tgaaaacggcgctgcgccgcctgttgcacaacaacaacaa

SEQ ID NO: 2725 - DNA, 256 bp, Caenorhabditis elegans
  source 1..256: mol_type = unassigned DNA
tgatctaatgttaccttatcctcacttctatccatcatttattcttgccttttatacatcgatatttgtgttttttgcttcttctccaatgtagccattattttcttctcatctcttttttatttttgttccgttttatttatgtaatttatttatgtaaccacttgtgatggtttgtatctatttatgtgtgttttttttctacctcacgatatcttactatcgtaataaattaaattaaattaaattaaaactt

SEQ ID NO: 2726 - DNA, 59 bp, Caenorhabditis sp.
  source 1..59: mol_type = unassigned DNA
taacttaatgtaaaaattgacttgtattagtggctttgcccttcaatcaataaataaaa

SEQ ID NO: 2727 - DNA, 39 bp, Caenorhabditis sp.
  source 1..39: mol_type = unassigned DNA
tgaggtcgaacctcacaagtatcacaagtaagtaagtaa

SEQ ID NO: 2728 - DNA, 211 bp, Caenorhabditis sp.
  source 1..211: mol_type = unassigned DNA
tgaccactgatgaccgaacgtttacgcmaaatctatcctctcctctctcccaaaatktkttwwtttcacgtgtactctaaccacatatccctgcaaattcctctattcttgccactccgttttctttgawtcctcttstacacctcttctgtatttattacttttcacgtaccgcaatgggcgtatacaaataaataaataaataaataaa

SEQ ID NO: 2729 - DNA, 334 bp, Caenorhabditis sp.
  source 1..334: mol_type = unassigned DNA
taaattaattcatttcaattgtaggattgaaacatatttaatctttttttttctatttctatttgtttttcttcatacttattgtacatttttattgaatttttccccccttcatttacaaaattgtactgttttatctctttctctttcactatagcgcaattgtaatctagcttaaattatctccaacatgactttgtttgattattatcgaaggatcctcttgcggggtgatgtcgagtaattttatttattcattgtgccattcccacctctttctctgatctcgaaatgtttttttttctcaacccgtgaataaataaataaataaata

SEQ ID NO: 2730 - DNA, 183 bp, Caenorhabditis sp.
  source 1..183: mol_type = unassigned DNA
taaattttgtgcttgtgatatcatcccacccgtctttctctcatctatttgaccgcggatttttccaattggtcatcttacttatttattttctctccccttatttttataccgttgtcctcttttccatgtgccatatacatatttttatgcgagaaatgaataaacatattattattatta

SEQ ID NO: 2731 - DNA, 50 bp, Caenorhabditis sp.
  source 1..50: mol_type = unassigned DNA
tgaccgaagatcgtcaaggaatgagtagagttgcacaacaacaacaacaa

SEQ ID NO: 2732 - DNA, 43 bp, Caenorhabditis sp.
  source 1..43: mol_type = unassigned DNA
tgatcgaagaacggatcgactaagtaactaagtaagtaagtaa

SEQ ID NO: 2733 - DNA, 202 bp, Caenorhabditis sp.
  source 1..202: mol_type = unassigned DNA
taactactgctgaacggacgtcaccaagatcctttatcacttctaccccacctttttttttctgctctcattcttgatctgtttctacccaactccttattgctctcattatttccctgcacatacctttaatgtatctgtgtacacaatatcaacacgtcacattggcgtaaataaataaataaataaataaataaataaa

SEQ ID NO: 2734 - DNA, 170 bp, Caenorhabditis sp.
  source 1..170: mol_type = unassigned DNA
taattttttgtctacatagattttcctaacatctctttttaacttctttcgtttgtttctaaatcttccgtcatatcgtttcttatacgtgtgtaatagtttgttatttatatatgtgctgatgaataagtggcagctgcccttcaatcaataaacaaatacaacaaata

SEQ ID NO: 2735 - DNA, 231 bp, Caenorhabditis sp.
  source 1..231: mol_type = unassigned DNA
tagagcttattcttattctgtactcccaaaccacctttccccgcattaccacattgctcaattcttaatgccttcttttattcccctcataccggtcattctttttttttgttgccccacatctctcactttaacccaccctttgaatggtctcgtgagggactcattctcagcctcccgccccatatattgataattttttataagaataaaatacaaatacaaaataca

SEQ ID NO: 2736 - DNA, 70 bp, Caenorhabditis sp.
  source 1..70: mol_type = unassigned DNA
taaattataactgtttctttttttcttatttgtataagtggtgaaagtccttcaaataaataaataaatc

SEQ ID NO: 2737 - DNA, 361 bp, Capitella sp.
  source 1..361: mol_type = unassigned DNA
tagggcaactacaagatcttattcctatgtaaaacaccctagctactcttacactttttcttctctttcctatttgattagtcctcctagttcttctagctctatccccgctctttattctttaaccgttttgtgtctcacttatatgtttaccctgttttcggtactttctttaacaatttctatttcttttgtacttttataactttactgtactatgtttgtattattttttgtattgtattaccatcatgataatcattcaattctcactcatttggtggcatacatatgttacgttcagttatgaacttcgtatgtctcctgacccttgtcgaataaataatctatctatctatct

SEQ ID NO: 2738 - DNA, 95 bp, Capitella sp.
  source 1..95: mol_type = unassigned DNA
taaaatgtatcaaaataaaataaaataaaaggagctgatcgtaagaggctatttaagcctgaagatcagaagaggacctgtaagtacctgtaagt

SEQ ID NO: 2739 - DNA, 225 bp, Capitella sp.
  source 1..225: mol_type = unassigned DNA
taaaaagaagttaaagactttttttattcaataatgcttttaataacgcagaacagttttaagtggaaatgaacttggcttgtttttatgtttctatgatcttttatccaaatacattttcatatgttttattttgtgctttgaaacttttatgtattttaagcacttgaatataataacatttatttatttatttatttatttatttatttatttgtttattta

SEQ ID NO: 2740 - DNA, 161 bp, Capitella sp.
  source 1..161: mol_type = unassigned DNA
tgattttaccctaatttccttgacacatattctttgttgccattgtatttttttaagctggcagttcttataggttttcctgttctgccatgctgttgcatgcattgattttattgtacatattatttttgcatgcatgaagcttaataaataaaaaaata

SEQ ID NO: 2741 - DNA, 114 bp, Capitella sp.
  source 1..114: mol_type = unassigned DNA
tgatgtttacatgttccccctttttattttcaaattgtattagcgttctgagcatttttatggaagcgacgctttataaaataaattttcattttcattttcattttcattttc

SEQ ID NO: 2742 - DNA, 127 bp, Capitella sp.
  source 1..127: mol_type = unassigned DNA
taatgttattatcatcattaatggcttaattgtcatattcatcattcattttactcattattatctgtttggcaaaatcattccttcgggcgaataaaatcatcttatcttatctcatctcatctca

SEQ ID NO: 2743 - DNA, 101 bp, Capitella sp.
  source 1..101: mol_type = unassigned DNA
taatgattttcctttttacctctgtttgtacagcgcatttgaatgttctttgatattgctgaaaatgcgttttaaatgtaataaatgaaatgaaatgaaat

SEQ ID NO: 2744 - DNA, 89 bp, Capitella sp.
  source 1..89: mol_type = unassigned DNA
tgacatggctttgtgaagcgcatagaaatgcatcatgcatcatgttgcgctatataaaataataaattcaattcaattcaattcaattc

SEQ ID NO: 2745 - DNA, 366 bp, Capitella sp.
  source 1..366: mol_type = unassigned DNA
tagtatcatcctcgatctacaactaacatatgaaacgaactatttcactctgaatatgcgctgcaccacccactattttttcatttttttttctctccgcaccaaagctgaataaaattttaaattgcacaatttgaacaggcgactcacaagtagccatacttagtcgcctattgacatgaccctattctttttcgcttctgtatttccatttctctagtatgtatttccatatttcattgtcgcttcctgctttctttaccaacctccctttttctattttggcatcttatatttgctaatatttcattctttctgtcgtgtcaataaatgcaattcaattcaattcaattcaattcaattcaa

SEQ ID NO: 2746 - DNA, 26 bp, Capitella sp.
  source 1..26: mol_type = unassigned DNA
taaataaataaatataaattaattaa

SEQ ID NO: 2747 - DNA, 202 bp, Capitella sp.
  source 1..202: mol_type = unassigned DNA
tgattttattaatacgtcctcatactgtttttatcacttttgtgctcttaaaagtcgctcattttgtttttagtcacttttaattttagttactttgttcactttttatatccattcagtgttcatcttcttttactcagcgctattgagcatttttggattttagcgctatagaaataaattattcttattcttattctta

SEQ ID NO: 2748 - DNA, 251 bp, Capitella sp.
  source 1..251: mol_type = unassigned DNA
taattatgttcttttccatttatatatatatgcatatatatatttgtttatttgtttgtttgtttttttttttctcgtttttaaatttttttgtcgctctctctttgtgcaagactcgttaaaactattattttctctcttccttttctatgtacttttcatgtggcgcaaaagcgatcacgcttctgccactacgttattttcgcaccttttatgttgtgattgaataaaattattattattataaaaaa

SEQ ID NO: 2749 - DNA, 120 bp, Capitella sp.
  source 1..120: mol_type = unassigned DNA
taaatttcacataattttatatttcaatatgtttttcggactattctatgtgaagcgcatagcagtgttttaccttttgcgctatataaataaataaattgattgattgattgattataa

SEQ ID NO: 2750 - DNA, 82 bp, Capitella sp.
  source 1..82: mol_type = unassigned DNA
taaatattctgcaaatttatgacctgtcaagaggacctcctcatgacatgtactgaataaagttttctattgaaaaaaaaaa

SEQ ID NO: 2751 - DNA, 224 bp, Capitella sp.
  source 1..224: mol_type = unassigned DNA
taaaatccttcacaatcccccctgctaaaattatctatccctaacagctcatctcctaacgcttttgtgaatatcctgtttgttagtttgtttattcgttgtttgtttgtaaaattgtaaatatccattgcgggcacatacccatgttctgggtcagcccctctcactccacttgtgtttttttcttttctttttgaataaacacatttttgaatttgaattga

SEQ ID NO: 2752 - DNA, 710 bp, Capitella sp.
  source 1..710: mol_type = unassigned DNA
taacgagcagacgacgccacagcaccagtagcggccaactgagtgttacacaatggtatgacgctaattataacgcccacaccccacctctcttccaaaaaagcaatgttttacctttgcacagcctgatcaatatcgaaattgccaaatttatgcacctgcactcaaaaaatagtttaccacctcgactctctgctatcctagactcacatgctcaacctcatcagtacgccacacgctccatcctaccataccgtcctcccagaataacctctctagccactgcaaaaagttttttatctgaaggtatcagaatctggtcctccctcaaccctgaaactcgcgcacttccccctcgccgcttctccaagcaactaaaacgaaaatatctgaatgaactcaccacctctctctaacttacacatgtccatcaccattttttttctctctctctctctctctctctctctctctctctctcctcctcctcctcctcctcctcctcctactcctccatctacattgtttttgtttttttttctttttgcttgacaaattccccaaaagtttcaatctgctttatttggccccctggccccgtacagacgtttgtgtctcgccggggggcctcaggtcacgtttaatgtccaaatttataataccctgtaatattctgccctgaaataaacattcattcattcattcattca

SEQ ID NO: 2753 - DNA, 163 bp, Chlamydomonas reinhardtii
  source 1..163: mol_type = unassigned DNA
taacatcctggcggggtgcaggcctggcctgcacgcccgccttcacatgctcggtagtgggggcgtacaggaggcgggcctggcccacctcctcatctccccccactcccttaatccacaccacttgcctacggcagggtgtctctatttctatttctatttc

SEQ ID NO: 2754 - DNA, 375 bp, Chlamydomonas reinhardtii
  source 1..375: mol_type = unassigned DNA
taatttgctcgtgggtggtgggagcggtgtgcctctggtgtgtgcgctgtgggtgtggggcgtcgacgtgggcgtcgccggactacgtgcccggtgtacctgcgttgacgcctcgccggtttgattgcgcctcgtgcgctagtgcggtttgctgtacgttggtggggctttggcgggcttgggcttagcttcgactcgctgtgcagctgccgagacacgctttacgcgaagacctgttgcacggttgtggaaggtcggtagccaactggggggagggtggtttcctttcgggccggagatggtccctcttgacctgggtgcacgggcacccttgcttggtcggattgtcccttctttgtaatatcgcaaccataa

SEQ ID NO: 2755 - DNA, 141 bp, Chlamydomonas reinhardtii
  source 1..141: mol_type = unassigned DNA
tgagccacggctcccccacacctcctcggagtgcgtggtgaggtggcagcgcgagggggatgggcctcctcgccctagccaccttaccccgataatccacgccaggccccatgggccggcgtttgaattattattattatt

SEQ ID NO: 2756 - DNA, 392 bp, Ciona sp.
  source 1..392: mol_type = unassigned DNA
taaatattataccgtaactgtccaatgccttagcaatattgtaacttcattaatttagattttccatacctcgatctctttaacacattgtaaatcactgttatatattcattatgcattttgtttgttttctttttttagggttttgttaaagtttttttgtcattgtaacgtttttgcacaaatttttcacactgctattctgtttatttcttatttatttatctttatattttaatttacatttattataaggtggcacctgcttcgataaccgcatggtttctcggtgtctccttgttaaacttcagtttaatttattttcgtattgtttattattttgttttctgtgcgtttaacaaataaaatatgtttgattgattgattgattg

SEQ ID NO: 2757 - DNA, 326 bp, unidentified
  source 1..326: mol_type = unassigned DNA; note = Description of Unknown:Copidosoma floridanum sequence
taagcgctggcttgttgttgtaatttattgtcagtcgatagcacgacaggtgacgagtaagtcaaccaaacttacgaattctcgcgtacctgcggtaacaatttacatcaaaatttattgtattttgtgtttgagccttccagatcactcattgtgtgtttttaattttaattttgtagcctgatgaggctgacgcatattgtcagcgaaacgttgcgcattaataaatcaacgcaagaaaatttaaatacactttacttgtatttatttattttctcacatttcgcccccaacggatcactgatcactttgaatttccaaattca

SEQ ID NO: 2758 - DNA, 492 bp, unidentified
  source 1..492: mol_type = unassigned DNA; note = Description of Unknown:Copidosoma floridanum sequence
taaattaatatttgtgtttttatatcctttattgtaatttgaatttatcgcgcgttttcactgtatagattgaatatatatgtaacacatgttggtttcgtctatatatgtatgtaaaatttgtatttgataatttgaatatgtaaggtcagtcgactatgtgccctcgttgggtactgacgttgtttgaatcttcgaacaaaataatctttttgtaagtctctaatttgtaactgtatttaaaattgtttattattgttcttagtttttaaaatgttattagatgtgataacgtggatgtattgttacctcaagttaatttatttcgtgtatattttataaaattaggacttgaaaaggctcctacccaaagaggagagaaacgtcgtcaggggatataataaaaaattatatacaacagcaatagccattggttttattatttgatgaatttcgtcttgctcgctgttgttggagtcataaacatcataa

SEQ ID NO: 2759 - DNA, 520 bp, unidentified
  source 1..520: mol_type = unassigned DNA; note = Description of Unknown:Copidosoma floridanum sequence
taacaattttcataatttgataattcataacaatttatatccatcaatctctttttatcggttagtggccactttccttgatattgagtttgattctttaaagtaaaaataaacttagtttcataaattaccgctgattttgtactacaccaggttcaccactgttgtagtactacacacacatgttctcacgtagctttaaaaagaattcccatatattgtactatatcgcagttgagtagaataaacatctcacattgacgacactctgcgattattgtttaatattgtaagtaaagataaaacttttatacattgttagtgcgttttctgttgtgtacatctttatatacatatttatattaccattgctgtatattaatttttagtgacttgataaggactgccttggagtagtcgaaacgtcgttttttaaaataaagtcaatttgaacagcatagcccttagtacttgtcattatttattgtattattagctgttcttggaatcaaacaatatc

SEQ ID NO: 2760 - DNA, 553 bp, unidentified
  source 1..553: mol_type = unassigned DNA; note = Description of Unknown:Copidosoma floridanum sequence
tgacgagtgttgcttgataggtgtgccacttgatggccacgtttctgttggtccgtgtttccttgtacatacattgaccgtgggtgcacccttatgtggtgacaagaccttaacaccatattactatttttaatatcttccagttacatgtgctgagtcaggatgtgacttatattgtagataacttaactgtacatacattttgactgataaagtttataatattaagattatttaattattagtattccattgccgtggttatgactgactagtctttatcagtcatgctgcgtttggcattttcatgttcgcatctgcataggtgacttatattttcatttaatgtaatttgtcataatgttttttatattataaatattgtaaattgtacagttccctgaagagggagtcaggatgactccgaaatattggatcacattgtccaactaatatatgaaataaatagccatgctccaagattccaagttttttcatttaaatttccttaattatggcaaaggagcaagaagacagtagttttattatcaaa

SEQ ID NO: 2761 - DNA, 264 bp, Crassostrea gigas
  source 1..264: mol_type = unassigned DNA
taatttattcattcsaggatatacactttgatgtaacattgtgatttaatatgtaccataacccaaatataagttaataattgatacaccttgtataacgcgtgatgaactataattgttaatattaccaaggtgacttataggcccaatgggccgggtgcccaatattcatgtacaagtagttgttataaaatttgtatcatacggcacaattgtacataatatgcacatgtcactataataaataatttacttacttactta

SEQ ID NO: 2762 - DNA, 256 bp, Crassostrea gigas
  source 1..256: mol_type = unassigned DNA
taaattcctttttgcttttgctttctatactgtacattaacgttatctactatatatttgcaattactttgtaaatgtatgtctatgaatttaattattataaagtcaataactataagtaacatgtaatattacatgtactatgacaattgtatatattgtatgtattatcattaggagaggaacttgtaagttgtaagaacttgtttccgatccttttgtgttacttacacaataaaatatgttcaaatcaaaa

SEQ ID NO: 2763 - DNA, 110 bp, Crassostrea gigas
  source 1..110: mol_type = unassigned DNA
tgattatgtacactttgtttttcttactgtttatttaatatgtatatgttcatatgtataacctatgagacatttgtctcttggaataaagaacttgaacttgaacttga

SEQ ID NO: 2764 - DNA, 293 bp, Crassostrea gigas
  source 1..293: mol_type = unassigned DNA
taatcacaaatctgagtatttttgttgataacattttgcttatttttatttatttatctcgttcatccttgcatacatgtaacattaagtagataacattaactttcttattactacatttatcaaatatctacgtactggtgtaatttattactgtataagtacaaactgagacgtatttgcaataatattgtatttgttgtttaacatgtagggagagggcgaattaagtttttataacttgtgcccaatcccattgcaatatataatgcaataaaatatgttcaaatcaa

SEQ ID NO: 2765 - DNA, 228 bp, Crassostrea gigas
  source 1..228: mol_type = unassigned DNA
tagaccataattaatcacctaattgtctacggacttttccggtttttttcccgattacgacaaagagcacacggcgggtgtgaccggtcagcagaggatgctcactcctcctaggcacctgatcctacctctatctatttggaggtccgtgttgctctgctttgaatttgtatttcgttttatggatttttgagatggttgacggtttgttattgtcattttttcatt

SEQ ID NO: 2766 - DNA, 144 bp, Crassostrea gigas
  source 1..144: mol_type = unassigned DNA
taatatgtgtatatttatgttataattgtatttgcagtgacatataggcccaatgggccgggtgtttcattatctattttgtataacattttgtaattgttataacacatgtcactataataaattatttacttacttacttac

SEQ ID NO: 2767 - DNA, 175 bp, Crassostrea gigas
  source 1..175: mol_type = unassigned DNA
taactttagatgttgttcttttttgattcttttcgcctttacttatgtcaatttttcatatttatgtatgtacaatgtaatagggtctcctgtaaaatacccacttctgtactttactatgtttaatttgtaaaatctgatgagctgcaaagcttaaagaaataaagaatgaatg

SEQ ID NO: 2768 - DNA, 401 bp, Crassostrea gigas
  source 1..401: mol_type = unassigned DNA
  misc_difference 170: note = a, c, t, g, unknown or other
taaaatgtgtttataatagctgcaaggaaattgtaagcaaataatgacaaaaaaatataagtctacttttatgtatcctcttgcatatgtatgagtttttgatagatagtgttcccctctctttctccaccctctttcacccccccccacctcataactaaaaatactcnaactttcatgggtgataaaagcaagttttcgagattgtttgtgcatatatatgtctgtctgtcggtgtatacacctgtctgtacgtgtgcttttttatgtgactgtgtttatattatacttatattctaaatctcaaatgaagtgaatatgtgatgtgtatgcactgtaaactaaacatataagaagatgtaaataacttgtacatgaaagtttgaataaaaaaaaaaaaa

SEQ ID NO: 2769 - DNA, 192 bp, Crassostrea gigas
  source 1..192: mol_type = unassigned DNA
taagcgtaaatcaagtttatatataactactgctttgttgatctttttgatattttttcatccactttataccttttatatatatttatataacctgcctcccacctgtacccacaattattgtaaagtactgttaaattgtatgctatggcaatgtatgtaatgtatacgccaataaactactactactac

SEQ ID NO: 2770 - DNA, 209 bp, Crassostrea gigas
  source 1..209: mol_type = unassigned DNA
tagttgttttcctattatgatcctttatactaaaatctaacataagtagtgattctatagtctgttcttttttatttatattttttccctgtatgaaaatgtacctgtttgtctgtacctctgacgatttgtatttgtatgtattatatatatgttcctcttgtaccaaattatttggtctgagtgaataaactgaacttgaacttgaa

SEQ ID NO: 2771 - DNA, 207 bp, Crassostrea gigas
  source 1..207: mol_type = unassigned DNA
tgatcttataactactagtacaccgttgtttactatatacatgtcaattgcatatatgtatacgtccattctatccactgacctttatttatgttgtgtacacatattttgtattatatctttgtattgggagagggcggtctaagttatggaacttgtgcccaatcccaattgtatttttgtacaataaaaatatgttcaaatcaa

SEQ ID NO: 2772 - DNA, 426 bp, Culex quinquefasciatus
  source 1..426: mol_type = unassigned DNA
tagaagtgacccacgatggtactgtgacgaagagcacgttatgacggtcggccatcttcattatcggtacacatcgcatgggatcactttgggccgcatatgataaatttattcaaaagtaacgcgaatctgggcgcggtttaaccctatgggctcatatgtgcgtggaatagcaaatggttccaataccctaaatggataaaaatactgcaatctgattgataaaatgactcgacactggatttgttagagcgccttgagataggacacgagagaaatggatgggcatacacggaagtagagtcaagattacaggacactctcaaaacacgaacgacgaattatcgaaagatatctgctcgtaaaccttccatgctacaaaaactgtgtatgggtaagaggtgggccatccaaggaaaaaaaaaa

SEQ ID NO: 2773 - DNA, 63 bp, Culex quinquefasciatus
  source 1..63: mol_type = unassigned DNA
taaatttagttttaagtkcatcattggggcaaaataagtgcctgttgagaagaaataaacaac

SEQ ID NO: 2774 - DNA, 66 bp, Culex quinquefasciatus
  source 1..66: mol_type = unassigned DNA
taatgttagttttttaagattatacagcctgagcattttagatggaggcggtgaaataaataaata

SEQ ID NO: 2775 - DNA, 121 bp, Culex quinquefasciatus
  source 1..121: mol_type = unassigned DNA
taatctgtttttgtgtttcatgttgttagcatttgtctttagttaagttaagttttatcattaagaccacaagttgtcggatgattcaaataaacaaataaacaaataaacaaaaaaaaaa

SEQ ID NO: 2776 - DNA, 72 bp, Culex quinquefasciatus
  source 1..72: mol_type = unassigned DNA
taatttatgtattagtttgtaaggtaaaacaccattggggcccgagcctgttggtgtccaaataaataaata

SEQ ID NO: 2777 - DNA, 13 bp, Culex quinquefasciatus
  source 1..13: mol_type = unassigned DNA
taagtaagtaagt

SEQ ID NO: 2778 - DNA, 98 bp, Culex quinquefasciatus
  source 1..98: mol_type = unassigned DNA
tgatgaagtctgcaagtagtagacgaaatacgtatctgtcaagatattaaaaatatatagcggaattaaaaggaacaactcgtctctttgtattcaca

SEQ ID NO: 2779 - DNA, 54 bp, Culex quinquefasciatus
  source 1..54: mol_type = unassigned DNA
taagttgtagtctgtgcggcgagtgccgaagatgaaataaataaataaataaaa

SEQ ID NO: 2780 - DNA, 232 bp, Culex quinquefasciatus
  source 1..232: mol_type = unassigned DNA
tgacaaaggtttagaccggtttatttttagtcagttttatttatttatttatttattttttacattgtgctagtttagtttgwtagcttaagtttgattgtatatatcctctatgtcatttggattgtaaaatctgttgataataaaaaagaggttttgtgcctatttgagaaggacccatcggtaggcgttccactcaaacgggcttttccctcatataaaacataaaaca

SEQ ID NO: 2781 - DNA, 299 bp, Culex quinquefasciatus
  source 1..299: mol_type = unassigned DNA
tgagttttgttttggtttttgattaagcaatgccttgtattacacactcttttataactacatacacagctgataatcagtcttaaatttattactgaattctacttaaacaagtaatttgtcgtattatcgacatttttatatctttagcttatttcgttttagtttttaatttagttgttagtttttagttttaatgaaacataaggtccttatcatttaagtcaatgtatacaaaaaaggttgtaccttcggtatattgttgaaaaataaaatacaaatacaaatacaaatacaat

SEQ ID NO: 2782 - DNA, 109 bp, Culex quinquefasciatus
  source 1..109: mol_type = unassigned DNA
tagaaacatccaaagttaaattatctctaccgagcttatttgtcgtcttattagcaagtggtgaaatgtaaattcaagaaaaatgttgtaaaataaagtgaaaaaaaaa

SEQ ID NO: 2783 - DNA, 45 bp, Culex quinquefasciatus
  source 1..45: mol_type = unassigned DNA
taggaaacagtctgttcaagacgaagataaataaataaataaata

SEQ ID NO: 2784 - DNA, 21 bp, Culex quinquefasciatus
  source 1..21: mol_type = unassigned DNA
tgattggtatggtatggtatg

SEQ ID NO: 2785 - DNA, 507 bp, Cyprinus carpio
  source 1..507: mol_type = unassigned DNA
tgaacccccccaccccccctccctctaacatacgatgtcatgcaccagtcactttgtgcagcagtggtctgctcactacctcattcaccatggaactgacgtcattctaccacctcatcagtcagtttaaataaaataactgctcttgagccctttgtcactttgtcacttttaatcagactgaataagctatttttttatgcactaaaaatctttttatctgcactgtttgttcactggtttgcactctatctgccatgtgccttgcgctgcttttatttaaccttatttttattttattttttctattatgtcttttttacattcccttattgtatagttttatcttatattttatatttgatctagattttaggctctactgttagtgttatctgtatgcaccgggggtctgagagtaacgcaatttcgattctctgtatgtatgtactgtacatgtggaagaattgacaataaagcagacttgacttgacttgacttgacttg

SEQ ID NO: 2786 - DNA, 32 bp, Danaus plexippus
  source 1..32: mol_type = unassigned DNA
taatgctgggataattgccaggaagaagaaga

SEQ ID NO: 2787 - DNA, 344 bp, Danio rerio
  source 1..344: mol_type = unassigned DNA
taaattgagggtgtttctggccaaaattattttaatctttttaacttgctgctaggatatgcacttgccactttatacacttggacattaaattgtatgccttcctggctcacattttattaacttttaaatttgaaaagctgcttggaaatgcacttgccactttatatgcacatcatacgcacttttaatattgtattgtaactcttcatttgattttatatttttatctctttttaattattgttgttgttttagataaataggactgcactgaagggaagggcaaatgtaaatttcgttgtattttgtacaatgacaataaagattctgattctgatatt

SEQ ID NO: 2788 - DNA, 619 bp, Danio rerio
  source 1..619: mol_type = unassigned DNA
tgactcttttgcccccccaatacaccccccactctcctctaacttaaactcctcgcaataactgcactgtttaacatttgcacatttaaaatttgcacattcactgcaccacattgaactgtttacttattgaactgtacatacccactgcatatgggcatttgtaattatgtacacacccactatacatatacacttgtaatcatgcttatttatctgcatactactgattattaatagcaacctgtacatatattcatatattgtaacatatacacttgtaatcatgtttatctatccctgtacatatattcatatattgtaacatatacacttgtaatcatgtttatctatctgcacactactgattattaatagcaacctgcacatatattcatatattgtaaatctgttcatagcttatccaacctgtatataatgttcatagtacatccatctgtaaatatcaccatagttttctataactgcactttataacttattcctgtatcctgcacttgctgctattgcactgctggttagacctaaactgcatttcgttgcattgtacttgtacatgtgtaatgacaataaagttgaatctaatctaatctaatct

SEQ ID NO: 2789 - DNA, 391 bp, Danio rerio
  source 1..391: mol_type = unassigned DNA
taatatattcaaaaaacatttaaaaatctggtttatagagaatcagacgtgtcatcattccgattaaaatgaacctagcatgtttccaattgtgccyaccatcttaatgatctgttgtttaaatgtgtttcaactatttttatctctattacaaaatgttggtgttttagyttaatttgtaaatattctcttttaacatctayatraccatgtctattttagtactttttaactatgtttgatwgattgtataattcttgtattgttttttttaggttgttcagggacaacagataaaaaatagccttckggctaattctggtgcatttgcagaaatgctaattaatgtacactgtccctgccaaataaacaaataaataaataaataaat

SEQ ID NO: 2790 - DNA, 242 bp, Dicentrarchus labrax
  source 1..242: mol_type = unassigned DNA
tagggctggatcaggtgagtcctgaaccatcccttagttatgctgctataggcctagactatcgggggatttcccatggtgcactgagctcctctcttcctctctctttctgcactcattcatgtcccattaatgcatgttactaacttcacttcttccccggagttcttgtgctttctcgtctcgcaggttctcatggatcctggtggagcctcctgccatggtcctgcttgactgccatt

SEQ ID NO: 2791 - DNA, 388 bp, Drosophila sp.
  source 1..388: mol_type = unassigned DNA
tgaccaaaaagacgatttaagattgtgttgatgggtttccgcattaggattattaggattcccacaatgttttggagcaatttcttgatctgcagcgaagtgtttgccaaatgctgtatcagcaatttcagcatacgttaactgagagacataattagcgtcaaatgtattgacttatgtattcttatgttaccttgcaaaccatttacttaatctcgtttaaaaattatctgattttgacaaaattaatgataattgttataagccgaggtttgataattaaccaaatgcaatccagttgggctttccagtttcgaatccgaatgaatttagttgtgttcagaagaattattgcacaactaaagatgttatgaaaaaatagattcat

SEQ ID NO: 2792 - DNA, 16 bp, Drosophila sp.
  source 1..16: mol_type = unassigned DNA
taaaggaaaaaaaaaa

SEQ ID NO: 2793 - DNA, 222 bp, Drosophila sp.
  source 1..222: mol_type = unassigned DNA
taggtttagtttataactccacgtcacttggcgcagacgtgtcaaaatgtatgtcaatatttaaattgtaacaaaaaagtgtattttgatgttgattgttttttgttttcgattagttgccctgaagacggttgccgaggagcaaccgaaatatattggtcaaaaaacataaattgtgtttttaatatcacccagaccttgagccggcaaaacaccaaatat

SEQ ID NO: 2794 - DNA, 23 bp, Drosophila sp.
  source 1..23: mol_type = unassigned DNA
tgatggccaattattattattaa

SEQ ID NO: 2795 - DNA, 152 bp, Drosophila kikkawai
  source 1..152: mol_type = unassigned DNA
taggggtcacagcgcccgcgaagcaatgccaggcggcggtaccgctgggcgtccgattcgtattctttctgttaattgttaagccatccatgtttatgtgtagtgtatgtatatattgtagagtaataaatataacgaatataaaaaaaaaa

SEQ ID NO: 2796 - DNA, 514 bp, Drosophila kikkawai
  source 1..514: mol_type = unassigned DNA
tagagccctttcatttttccacaaaatagtgacaacccatgagccttcttacttgtttaataaattaataccggcagcctcgcaaaggactaaaaattttatatgccctcgagtccaaatgctcaactccgagaggcagttctttgtcaacgctatccgtctatggaaccaattaccccatgaacttaaaactattaggaatgcaactcaatttaattccaaagtaaaactatttttaagaaacaacgcataacaaacaaataaacaaacagcaaacttcatattaatacgtaattaaagatataaaaataaataaaataaaataaaataaaataaaaataactaaaaataataatataaaataaaataaataaataattagttcatataataattaatgtactaggtattaagtagaaatcctgtctaattttaactcaagtgaccagggcattaataataagtattttatacttgtagcactgggctaattttgtcaaaataaataaataaa

SEQ ID NO: 2797 - DNA, 136 bp, Drosophila kikkawai
  source 1..136: mol_type = unassigned DNA
taattataacatattccacacacatatctttgttaatacactgtagagcggaaggcctcggtagccattgctcattatcctttgttaacttttagtttataactattagttagcattaaataaataaataaataaa

SEQ ID NO: 2798 - DNA, 68 bp, Drosophila sp.
  source 1..68: mol_type = unassigned DNA
tgatgtgagtcgggtactatgtttatgttggcagatatttgttaactttaatgtaataaataaataaa

SEQ ID NO: 2799 - DNA, 138 bp, Drosophila simulans
  source 1..138: mol_type = unassigned DNA
  misc_difference 73: note = a, c, t, g, unknown or other
tgagcaaatcctgatcgtcctcgcgaagcaatgcttcacggccataccgcggggagtcctggatttgccctcntaaatgttattatgttgtatagtatatagtttagaataagggttcaataaacgaattaaaaaaaa

SEQ ID NO: 2800 - DNA, 1401 bp, Drosophila sp.
  source 1..1401: mol_type = unassigned DNA
taacaaamgtcgacacaaaccgctccccaaaaatgcagctcattctacaaaataggaataaacaggctacatggaagattcttaaaatctacactaaagccatggatgcgggttatttcactgaaacaataatacttaagcgccagcaaagtgtcttcatctctatcctgatgacctgcaaaacccggacgaagtatccctccgacgacgcatccctgctgaccccgacgaagcgcaagtgaaggatgtcatccactaggactggcaaagaagtatctagaagcagagggacacgtgaaggatcaacgtgcggcaaaaacatgatgaatctaagtagactcattgcagcagcgcatgcataatgtcacttacctgaaccttttgctgcaaatcccttgaaatgtcctgaaataacagctgcaatctccccgaaaaccgtactcaatgacaaaagacgacccgacttgtcgcaatagataaactaactttttggcacttagaacacaaaaaacatacaaggttttgatccagtctctttattgggattcccccacgtcctcacagaccctaggcgtgttgctgccgacccggcaaaagatcgaaatcgtaacccctgaaattgaccttttttttcccttagaattaatatcaacgaaatctttgttaaagatcgaaataatttaatcaaaacataaaacagagtattatataataatatataawaaaaaattcacaatgttttgaagccgtctcaacgtcaagaagcccactcgattttattgacccttggcgcggcmctgccgacccgacaaaaggtcaaaatcgtgacccttgaatttcgactttttcctggtagcaacgattatactgacaatatccctgaaaaagaataacagatcaataaaagcttaaaactacgcaacctactactcccctactaggcgcaacataaaacgaagatttggcacctaaaacagtaaaaacctaaaatgttttgatgtcgtttccatgwtgggatgccccctcgtccttctgaaccctaggtgcgccgctgctgacccggcaaagggtcaatctcgcgacccttgaattcgactttttcctggcagcaacggtaaacagacaaaatccctgaaaaattataaaacaaattataaaacaaattataaaagcataaaaccacgactcggcgaaatgaawaacgacgattttggcacctaaaacattaaaaacctaaaatgttttkatgccgtttccatgctgggatgcccccccgcccttmtgaattccaagcgcggcgctgctgacccggcaaaaggccaaaatcgtgacccttgaattcgacttttcctggtagcaacggcatactgacaatatccctgaaaaagaacaataaattaa

SEQ ID NO: 2801 - DNA, 55 bp, Entamoeba histolytica
  source 1..55: mol_type = unassigned DNA
tgaacaataagttgaaaggtattaaaccttaatttaatatttattctttattctt

SEQ ID NO: 2802 - DNA, 74 bp, Folsomia candida
  source 1..74: mol_type = unassigned DNA
taaagaatttcatttatatatctattgtagttatgctaatattatggattacaattatgtattatgataaagta

SEQ ID NO: 2803 - DNA, 372 bp, Gasterosteus aculeatus
  source 1..372: mol_type = unassigned DNA
tgactataacactccaccggtcactccccctcatactgcacatgccactttaactgcaattcatcactttgtcgtcactcgtcactttgtctcttgtctgttacttgttcgttagtgcactttatgcttaatatttttctttttaactttttaatatttaaaattttttaactttattcccttgttttatactaacccatagccttagccttattctactaacccattgcattagcatttcattccactttattttattacttgtgcactgttgtcttgtctgtctactgtcgcgcactaaccgccaagacaaattccttgtatgtttgacatattttggctaataaatgtttcctgattcctgattcctga

SEQ ID NO: 2804 - DNA, 39 bp, Gasterosteus aculeatus
  source 1..39: mol_type = unassigned DNA
taagcggttgaagatggatggatggatggatggatggat

SEQ ID NO: 2805 - DNA, 87 bp, Gavialis gangeticus
  source 1..87: mol_type = unassigned DNA
tgatcccagcagtctttcctgcccacgtgcaggggggctggacctgatgatctgtaaggtcccttccagcccctaacaactatgaaa

SEQ ID NO: 2806 - DNA, 91 bp, Gavialis gangeticus
  source 1..91: mol_type = unassigned DNA
tgaccccagtgctcttcctgccatggcagggggtcggactagatgatctgctcaggtcccttccgaccctagaaactatgaaactatgaaa

SEQ ID NO: 2807 - DNA, 91 bp, Gavialis gangeticus
  source 1..91: mol_type = unassigned DNA
tgaccccagcatccattcctgcccaaggcagggggtcggacttgatgatctgtttaggtcccttccgaccctagctactatgatactatga

SEQ ID NO: 2808 - DNA, 174 bp, Gossypium arboreum
  source 1..174: mol_type = unassigned DNA
tagaccgaacggtcttgtaataatgtagcccatttaatttgtaagactatgtgtagtgaggctaaaaattgtttttttgatatggattatccttcggaaatccatgatgctgttattagtgatgttacttaataatatgtgttgacccttgtggtcgtttttgctcaaaaaaaa

SEQ ID NO: 2809 - DNA, 338 bp, Harpegnathos saltator
  source 1..338: mol_type = unassigned DNA
tagcagggaggggggtaaggagggagggtggatgtcccctccctccttgacaggagacaccagaaggccaaccggcggggcaacccgccggggaccgcgccctggattcccttcgtggaacagggcgcggtacacaggtggcgaggggctcccggaagggagccctggggccggggggttggggagggaatacgggagtagttcccctgactcccctcctcacggtccgacaggtagacatcccgcaggggttttagtcggtaagagtccgacataaccccctcccccccaagggggggggtatccatgatggatttcccctgcgtgaccaaaaaaaa

SEQ ID NO: 2810 - DNA, 322 bp, Hydra vulgaris
  source 1..322: mol_type = unassigned DNA
tatttcaagttatttgatatttttgtcgactgtgtgatgaatattatttaaacaatatatgctgaatactttatattataatattgttcaatattgagaatgttatatatccatattataaaatattatgttaaaacttgcttaacatctgaagaatattctaacgcttatgtaatttttaatatttgtaaattttctaccttttaattcgttatatagattgtaaagggcttcatgataagatcatgtgatcttctggaagtcctaccagtaatatattcaatgtaaatttaccttgttcatatttttctggaaaaaaaaa

SEQ ID NO: 2811 - DNA, 98 bp, Hydra vulgaris
  source 1..98: mol_type = unassigned DNA
tctctatgactattatgaaactgttaatagcaatggctcataatagattcaacatggcgttgaatctcaaggagcataaataaataaataaattattt

SEQ ID NO: 2812 - DNA, 411 bp, Hydra vulgaris
  source 1..411: mol_type = unassigned DNA
aacattaaaccgatacaacacgcgatctaccggaagatttaaaaaacctttccgttcatcaaaacttacgagctttgccatttcctatcgtggcccaatgctatggaaccattttacaagtctgagtggtaaacttaaagaagccaatacctctcaaaaatttaaaaagaacataatcgaacttattgccaatcacgattctttacatgattttttctaacaatacacgattatttccaatttttattatcaaaggttactgatgaaaagactttatcttcttcaggttctccggtcttgtaactattataaataatgaaatgtacttgtatttaatatttctaaatattttacggaaattatctttaattgtaaatggttgcttgacaaaaattgaaataaaaaaaaaaa

SEQ ID NO: 2813 - DNA, 523 bp, Hydra vulgaris
  source 1..523: mol_type = unassigned DNA
aaacaatttaaaggtttaaactaaatcacttaaaaataaattaaatctttaacactttctttagcttttattaaaatggtttcaaaccattagtataaaagataacgaaaataaaattgtctttttcgttcatatttttgatgatattaaataatcagcccaaatacttatgtttacatatattgcttttttttttttttaattaaacaacacattttttttgtgtgtttttataactttcatgactttttgtcgtttttacttttttatttttaaaattattctgcttgaagattgttagcaacaaattattttattgctgaagtttttgatttgtttttgtttttgtatttatactgtctttttgtcttttatcatttattgtgcatgtaaatttttgtgtgacggggctcggtgataagacaacctgtcttcttcttgctccggccaggattttcttttattgtaatttcttttttgtaatatttatcaacggcaaattaaataaataattaaaaaaaaa

SEQ ID NO: 2814 - DNA, 585 bp, Hydra vulgaris
  source 1..585: mol_type = unassigned DNA
atatttctaccaactaatattgacattctttactatatatgtcaattcgtaatccttcagtttttaatttgatatttttaacattttgaaattctctacttatctatctacatctaatttctctggttttctatctgccatttttaaactttattattaaactatctatactaatattattaattttagtaccaatgggttggcattctttatttatctatctatttatctcttttcattcaaaaattctctatttctcaactattctacttcgtactaaatctttgttgttgccatcactctttactaaatttttgttgctgctgttattgtctttatttatgaaattcttctcttattataattgttattatttcgttactattattattattgttataattattatttttgttgttgttgttgctattattattcttatcacaatcattgttattattgttattattgttattattattttaytgttattattgttattactattattattgttattattgttattactattattgttattattgctattattagtattattaataacagttattattatta

SEQ ID NO: 2815 - DNA, 419 bp, Hydra vulgaris
  source 1..419: mol_type = unassigned DNA
catatattttatagtttacagtatttgttttcagtatttttttatttttttatttcttcttcttcttatttttcttgtttttaatattttttgtttttgaatttgttacactaaaaaaatatgagctttgtttttattgaatttttattttatttttaaaaattaaattgtttttataatgagtgactataggggctctatgaaaaggttgtgatgttaaacacatcatccttaccttctttgagtccctgactgattagaacagaatatacataatataaaataaaaaattatgaaaaaacgttttttatcatgtttatctttacgacgtgtattttatgtattttttacatgattatatgaaaattgttattgtaactgtttaatcagcaaaataaaagtwtatataataataataa

SEQ ID NO: 2816 - DNA, 539 bp, Hydra vulgaris
  source 1..539: mol_type = unassigned DNA
atcttatacctttttacaacttattatttataaccctaacgcagtgcttctattcatcttttaatttttctcatttctatcgtgatatattactaattttaatatcaattattaaatttattattataaactgatatgtttctatagtattctcttatcactgttgttgttattattactatattttatatcgtaatgaatattattgtaattgttattattgttgttgttattatttttgttgttattattgctattattattgytattattattattattattattattattattattattattattattattattattatagtatattctttttataatcgctactattattttttttatcactataatcactactattacttttattattcctacttgtattataattattattattactatctccatcttatttttatttattttgacaggtgtttactttatattagtacaaattactatttgtaaatatccttgatgtaacaactttattcagaatatatwtgatttgattt

SEQ ID NO: 2817 - DNA, 416 bp, Hydra vulgaris
  source 1..416: mol_type = unassigned DNA
tcaaatacaggaaacacagaataaaaaatcctttacaaacgaagcgtttgatgcatgcaacacacttgatttaaatttcatacagtgcatgttaaatggcaaaaaaattaaattgacgcaacccgtcgtagagctacaaactaatgttatgctaatattgaaagaaacgttccagttttggaatttgaaagaaaagagagaggcgtttaaaatcttgatggaggagaatgttcctagaactctgtcccaataatatgtggaaaacaaaccggctgtttataagcatttattgctaacaactacaagagagcccgtgttgttttagctgatttttaatttattgtttgactatttaaatattattttacctgtaatttattaccgggtgataaagagaaaatataatataataataa

SEQ ID NO: 2818 - DNA, 1475 bp, Hydra vulgaris
  source 1..1475: mol_type = unassigned DNA
aaactcaaaaattatggtataaaaaatacaaatttagcttggtttaaaagttacttgactaatagaaaacaatatatttcatatgatggmggaaaaactgaatatatgacaattacttgcggtgttccccaaggatcaattctaggaccacttttatttctaatttatataaacgatttaaataaattttctaacattttaaactcaattttatttgcwgatgatactaacttattttattctaataaagatattaatattttatttaaaacagtaaacaaagaacttataaaaactaaccgaatggtttaaatcaaataaattgtccttaaatataaataaaacaaaatatactttatttcatcgtcttcataaaaaagaaaatattccattaaaacttccaaatctttttattgataactcattaataaaaagagagcaatcaataaaatttttaggcgtkattcttgatgaaaatwtaacatggagggamcacataagtataattgaaaataaaatttcaaaaaatatwggtatattgtataaagcaaaacagtttttaaatcaaacttgtttaaaaaacttatatttttcttttattcattgytatctaaattatgcaaacattgcttggtgcagcactaatgcaacaaaaataaaaaaactgtttagtaaacaaaaacatgctataaggatwattacaaatgtagatcgtttctctcatactaaaacactatttaataaacttaatattctaaatgtatatcaactaaacctttatcatattcttatttttatgtttaaacttgataataaaatatcaccaattttatttaattcattttttaaaaaaataaatcatatataccctacaagattttcaaaaaacaattatattcaatccaaaacacattattcagcaactaaattctcaattgcaaatcgaggtcctaaattatggaatacaatattaaataatgagcttaaaactaattcttctttaaaccaatttaaaacaaaacttaarcaaaaacttttgataaatgaaaatgaattaaatttcttctaaaaagctttttaaattagcaaacaaaaataaaaattaatctattaattactctttaatattaatttaatattttaaacaattgtcttattgaaatctatttattatcttataagttttatttacgacgattttttaagttttattattttttttkaatttctttttattattttcttttttattartacttacttattttactaatcaattattattataaatttttcgaattacwaaatagttatatattttattttttattttgttaacgttttacttatgaatgcattttggggcttagtgataagacgaattttgtcttcttctagccccagtcatgtaaatatttgtttttataaattacattgtaaattattttcaacggcaaataaataataaaaaaaaa

SEQ ID NO: 2819 - DNA, 444 bp, Hydra vulgaris
  source 1..444: mol_type = unassigned DNA
aaatttatgtaaaatgtatttttcaaatcttcagcatattgagtattaaaatgttagtatattgtatatttgcattatgttatattgtattagtatattgcatatttgcattatgttaaatctttgcattatgtcttttttaaggttccggtgataagatccttctgatcttctttcggaaacctagtcttatattgttagtacgctgaattgtatatacatatatatatatatatatatatatatatatatatatatatatatatatatatactcattttttttttcttttcttgtagaagtcttaaatatttttatgtatcagacttatattattatatatcacgacttatattattatatatgtatcagacttatattattatatatcacgacttatattattttgtatcacgactaacattgtaaactaaaaaaaaaaaa

SEQ ID NO: 2820 - DNA, 487 bp, Hydra vulgaris
  source 1..487: mol_type = unassigned DNA
ttttttgtttctttttttaactttatatttaacactgcattaataaattttataatttaacaatttataaacagttgtttaacacttttgttaaaggtatcttaaaactgtataacaaaacctttaacaaaaagtttaacaattgtgctaaagatatcttaaaactgtataacgcatctatgtatttataacggatttctttttctttttttctttaaatttgtttatgttttcaattcttaattcttaatwatttgttatcttcatgtatgttaagtatatattcctattgaaagtttatttattttgagaatattttattaatacgaaatattaacacgaaaattttttagcggttctcgacgacaagaccttacggtcttctacgagtwcccgcgttcttttatttcttaatatcatttatattattatatcattgttaacgaatatttattaaatacaaagttgtaataaagaacaaaaaaaa

SEQ ID NO: 2821 - DNA, 104 bp, Hydra vulgaris
  source 1..104: mol_type = unassigned DNA
cgttttttattatttagtgactgaactaacttgttcattaattaatttataccggctgtcatagatattgcctggcgctttatctcaacagcattaattaataa

SEQ ID NO: 2822 - DNA, 152 bp, Hydra vulgaris
  source 1..152: mol_type = unassigned DNA
tacaattttgttgtaacttgtccagcacttgatacaatttaacatttcagtaaaaaaaaaaaaatgtttttgttaatgtatactcagtgttagtggccttcgggtccttctgttgttttcaaataaataaataaataaataaataaatatat

SEQ ID NO: 2823 - DNA, 974 bp, Hydra vulgaris
  source 1..974: mol_type = unassigned DNA
taaaggaatgtcaaagttatgattttaaaaagtcttcattttatttagccaaaaggaaaacaaaatacgaatataaaaatctaactgtcttaactctttacaaattattaaacaaaccaacaaaagtttagactataaattttataaatggaaagattgttttgaaagcatgaaaaatataaatgaaaaagattggaaacgtttctttataaatcttcaaaaaagtaatactaacaacaaagcgtgcgaaattctatttaaaacagcacactttttgttgccaaccaacgataaaatgtttgattttaaaattagaaaagacaaactttgcccacagtgcaaacttaaaaatgaaaatactgcccacatgatgtatgaatgtgaaaaagtacagccactaatattttatgttctagatattttagaccagctctaccctactgaataccctcataataacaattttaaatttattttatttggatacgaaaaaaacgcagcccagaggctttttggcagtttattattagaaagttttatttgtgaaatatattttaacagaatgaaaagtcaattcgaaaagaaaacattcactaagaaatatttgctagaaaagtttgatagaaaagtcaaaagattatttttaaatgagttacttatgctgaggcaacaaaataaacaagaaaaacacataaacgaaataagaaacatttttaaaaatggaagattaaatttgatagcagatgttcgtgactatttcgtataattttcgttttttctttttcttttttcttttgttttttcgatttttattttttattttttatttattttttagttttattttatacgggtccaatggacatctttgtaaacgttttttttcgttttttcgttttttttttaaaccttgtatttattatgaggacgtcagtatggcaattagccggatgacggaataaattacaatacca

SEQ ID NO: 2824 - DNA, 537 bp, Hydra vulgaris
  source 1..537: mol_type = unassigned DNA
agtaaactamaataaaaaaaaataaaaaaaaacagattcaattatatcaatgatatatgataatatgaataagaaaagaaagaaaaaggaaaaaaaaaaaaaaaaaaaaaaaaaaaagaataagaaatccaagtgatgatgtcacaagtgatgatgtcataagtgatgatgttacatattcatttagtgttaattatgagattttattttttcaatttcttttatattcaatttttttttttttttttttttatattaacttatttcttaaacattttagcaactgttaagcatcttaacgcttcttaattaattcttattttttattttttttattatattagttattttctatttcatttctaattgtttcttttatatttatatttgtatgttacggttatgtagaatttttaatggggctcggcgataaggcgaaatgtgccttcttcttgctccagccatcaatttatataaatgtatatgcaatgtaaacattttttaacggcgaaataaattacactaaaaaaaaaaaaa

SEQ ID NO: 2825 - DNA, 76 bp, Hydra vulgaris
  source 1..76: mol_type = unassigned DNA
tggggtgtttcccctgctcgctgtatgtgtacattctatgtaaatttacggctacaactataataataataataaa

SEQ ID NO: 2826 - DNA, 189 bp, Hydra vulgaris
  source 1..189: mol_type = unassigned DNA
ctggtttttgttttataactatggtcttatatataattgtaatatatattttaaattaactagcatttgtattatgtgattgtagggcacgttgtcagagtccttcatattttatggacctgcgtgtcctttagaacatgtatcactgttctaataaattttaatctaatctaatctaatctaatctaa

SEQ ID NO: 2827 - DNA, 293 bp, Hydra vulgaris
  source 1..293: mol_type = unassigned DNA
cttttcttaccgagttgttgacatgtggaacaatatgacctcggaggctgtaaatgcaaataacattttaatgttcaaaaataaaattaaatctttcgactttaacaaatatctattgtaaaaggaacaactatttgtttctttatagttttgttattttattttttttttgtagcgatatttttaaatttctttgggcacgttgttagtgtccatctttgtatgggccttcgtgtcctttagaacatgtatttatactttgttctaataaatatcaatcaatcaatcatcat

SEQ ID NO: 2828 - DNA, 512 bp, Hydra vulgaris
  source 1..512: mol_type = unassigned DNA
agactctgaaatatgttgttatgcttttattattactactytcttgatacctactagttttattattaactttttgttctcatatttttattgttattattagtattgatattaataatattcttctatctttattagtaaattgttatttttatttataacataataagtattattattgcttttttaattttttcttaagtttatttactacttatactatgtaattgttattaccactattattgctattatctaatattgattgtataatatctttattattattgttagtattattactaataatattccttttcatcgtcatcttattattattgttaatattatttctataattattatcaatactattattattgttattataatcacttttattgtaatgttgcaggtttttactttagattagtacttgtactatttgtaaaagtccttgaaattttacaacttatttcagaatatatattgaattgaattgaatatatata

SEQ ID NO: 2829 - DNA, 317 bp, Hymenolepis sp.
  source 1..317: mol_type = unassigned DNA
taaagcccgaacaaaggagaagcagtggacagcggcactctccaacatagccgactggcctagactcgaagctgttgcagaatttagactgcgtaccggacacgattgcctggcgaaacatctccacagaataggagtatacgcccaaccaacatgccccctatgtgaccttcaggaggaaatggagaagacccatctgatacggtgtccagccctacagacagcgacagaaacccagagatactgggaagccagaagtcaactaaagggctaatgataactattataaagcctgccatttgatataataataataa

SEQ ID NO: 2830 - DNA, 111 bp, Ixodes scapularis
  source 1..111: mol_type = unassigned DNA
tagtcacgaccttgttttgttgcctgcatttatccttgatgacgagcggtgtaccactatttaggccttgtgctgtttttggacacccaacaaaaataaagattattatta

SEQ ID NO: 2831 - DNA, 167 bp, unidentified
  source 1..167: mol_type = unassigned DNA; note = Description of Unknown:Locusta migratoria sequence
tgactgtgttaatttattctttgtgtgctgtatgcatcttatataccttattttatgtctcttttgtattcttgtatgttttacacatttttgtattttttgtatgtatagttgtataagacctgctaaatgatgtgcactgccatacgataaataaataaataata

SEQ ID NO: 2832 - DNA, 484 bp, unidentified
  source 1..484: mol_type = unassigned DNA; note = Description of Unknown:Locusta migratoria sequence
tgactgcaacatcaggtctacccaggccaaaaacagacctgtataaagtgacagatgatgcaatttcatggctggatggtttagacattaatatataaggaccatgttcgctgcttatctttcttaattcagttaacataaattgtgtaaatttactgctcatttcattgttgtttttctattacttattttagtttcctaacttaatgttcctttattagtgttcattcaattgttcatcttactgtacgatgtatatatctttcataaatttgtattaatattttataaatatttttttccaaattccactgcatcacacatgtaatggactttttactgcatacctgtatacttctctgtaattaatgcacttaaattttgatataagctgtttgttgtctctgcttcccacctggagaagtgtcattgtgtaatgtatcttcatgtccaagtgtttatgtcatacgataaataaataaat

SEQ ID NO: 2833 - DNA, 799 bp, unidentified
  source 1..799: mol_type = unassigned DNA; note = Description of Unknown:Locusta migratoria sequence
tagaaattggtcttcaggagagggacctccgattaagttacaccagaaggtacttgggctttggaacactgagtgggttgactcgcctgccccaaacaagctccgtgcagtgaagctttctacagctccatggaagtcctccctgagggcctctcggaaggagtcagttgtcctttgtcgcctgcgtattggtcacacgtggatgacacatggccatctacttcgacgggaggatcctccacagtgtcgctgtggcactttattgacagtggtccacattctgttggactgtccccttttagctgccttacgacagtcttttgacctgccagctgcgcttccttttatgcttggtgacgacgctgctacagctgatcgtgttttacgttttatccgtgcagctgggttttatcatttgatctaaaggtgggtacctcagcctgatctctcaggcacccatctctcacagatttttactcttcttattttgtgttgtctgacctgcttttactcgtatgttttagaatgtgcagagtggctggctcatcctttattatcctcgtgatcagccagccacaatattctgctgtaactttttagtccagttatgtttatttcctctttgtgttttctttttggtgttccgagctagtgttccttatattgtgtacccattgtgtgtttctcttctgtgtgattcagcgctcgttttttcagcttgcattacactgtattgtctttgctcgcaacaggggactgatgaccagcagtctagtcccctctaaacaacaacaacaac

SEQ ID NO: 2834 - DNA, 100 bp, unidentified
  source 1..100: mol_type = unassigned DNA; note = Description of Unknown:Locusta migratoria sequence
tagtttgttacacgtgtaatattatatgtatctttgttattaaaacatcaaataactgtaaattttgtgatgtagccatacgctaaataaataagaaata

SEQ ID NO: 2835 - DNA, 87 bp, unidentified
  source 1..87: mol_type = unassigned DNA; note = Description of Unknown:Locusta migratoria sequence
taaaatatgtagaacgcctggttaggtgtaagagagggcctgaaggccctaatcttgccaggttaaataaatgagtaaataaataaa

SEQ ID NO: 2836 - DNA, 103 bp, unidentified
  source 1..103: mol_type = unassigned DNA; note = Description of Unknown:Locusta migratoria sequence
taaataattgtcttgtaaatatgatgtattcacataacatgtaaatattgtacattagtttatacattgtaagtgcttctgacacgaataaataaataaataa

SEQ ID NO: 2837 - DNA, 248 bp, unidentified
  source 1..248: mol_type = unassigned DNA; note = Description of Unknown:Locusta migratoria sequence
taacagtcactatcgatatttttgatgtttggtcatctttggttgtgttgactctgcagtgacttgtactgtgtgtgttatcttccttgtttaccctttgcaaaccgaggtattaaatacgcttgcacattgcttccttgagtgcagttgtgccttgagaatggcagggtgtcctcctgccgaaatatcggcggttgtcgacgacgtcacccggcagcatacccgtaagttgtttgaacattcattac

SEQ ID NO: 2838 - DNA, 103 bp, unidentified
  source 1..103: mol_type = unassigned DNA; note = Description of Unknown:Locusta migratoria sequence
tagatgtttgttgtgaatacatgtaatgtaatatatgtaatgaatgtaccataatgtaatcagacactgaaatgtacttaaatgccatacgctaaataaataa

SEQ ID NO: 2839 - DNA, 666 bp, unidentified
  source 1..666: mol_type = unassigned DNA; note = Description of Unknown:Locusta migratoria sequence
taaattgtaatgccttattttactagttataaaatccttgtgtaatcacaactgttttggctgcttatgtgatataaacttaatgtcttattttactagtaaccatagtttaatttaaccagttaaaattttaacatatatttacagatgtttcattcaactttgtcacacgcttccatgttccagacattggacctgtttaagataattttttggtcaagtttaatttaaccagttaaaattttaacatatattcacaacgcttccatgtttctagacattagacctgtttaagataagatacgttttgatcaatatttttcagccaatttctattgtttcactttatatttcttaggataacgtcataatctattatattgtcacgtattttatcaatgtcaggaatttacaccacaacttgaattgtaatatttcccgcaggttagttataaaccaaaacactagtctcctttgaaagttatatatctagcaagttaagatctttgaaacttaaacttgtaatgtttacctgatgatggcgtaacagccgaaaaccggttcgtaaaccaataaatttgcagaatatctcacagttatcttgtgtatttcattcataatgtatcaaatattctgtcaagaaccgacggaacagtcagtgaatat

SEQ ID NO: 2840 - DNA, 339 bp, unidentified
  source 1..339: mol_type = unassigned DNA; note = Description of Unknown:Locusta migratoria sequence
tgatatagacgtacacagaattttaaattgtaacattaccattgtgatatattgagtcactgttctatattgtactgtacaacaatgagatagaggactttgaccattsatgtagatgtatacagaattttaattgtattttttctaacaaatttactattgttactacttttcattgtactgtattgtattaggaaaatttaaaactaagtatatgataattgtacctatgataaacactgcaaattactagctgtttagatatgtatttaaatgtatatgacgacaccaattacatgtaaacatgtttaaaggtgaataaaatattctattctattc

SEQ ID NO: 2841 - DNA, 377 bp, unidentified
  source 1..377: mol_type = unassigned DNA; note = Description of Unknown:Locusta migratoria sequence
tgagtcctctgggtggtcttttagatcattatctatgttccacttgacgcgtctttcgactacagcttttcttgtgtacgctatgtggttggcttttccctttttatacccatggtcggtcaaccacattcattggctctgtcatttttatctcgtatttgttactgtgtgtctggcgtcttttgtatcgtctcttgttgactctgtcaatatttcattgacggtgcgttcttttattctgcgctattttaaatctagctcaggcgcatttatcgacgattatgtttttctgcgtgtcgcctagctatgaagtgggggactgatggccatagtagtctagtccccctaaaaccccccataccaaccaaccaaccaac

SEQ ID NO: 2842 - DNA, 425 bp, unidentified
  source 1..425: mol_type = unassigned DNA; note = Description of Unknown:Locusta migratoria sequence
taaaatagaattttgtaatgaagaactgtgacaaacatatatatgtaaatttgtattactgtgttaaagtgttctaataatatatgtgaaattgcattaatcctataacatttaatacttatctgtaaaattaattacctgtgtttcatggtattcatttattaagtgtgtttcacggtgtatattcatttactaagtgtaccagtacttaattttgagtcaatcatattgtgtaaaacctttcaccattatattcatttattacatataccagaacataagtcataaattgaaccatattttatgtaggcctaactacgcttttttgttttgatttaatgtcaatcatattgtataaaaccttttgtaaatacctcatgacaacatcgattgcatggacatgcttaaagatgaataaataaata

SEQ ID NO: 2843 - DNA, 106 bp, unidentified
  source 1..106: mol_type = unassigned DNA; note = Description of Unknown:Locusta migratoria sequence
tagtactgtaagagccttgtattgttagaatagctgtataagaacaatgtaattaactaaagaatatttgcctttgtatatgccgaacgagtaaataaaataaata

SEQ ID NO: 2844 - DNA, 62 bp, unidentified
  source 1..62: mol_type = unassigned DNA; note = Description of Unknown:Locusta migratoria sequence
taattaaacaatgtataaagtgtgtaaagatagcgatgtatgccatacgataaataaataaa

SEQ ID NO: 2845 - DNA, 441 bp, unidentified
  source 1..441: mol_type = unassigned DNA; note = Description of Unknown:Locusta migratoria sequence
tagttcctgcctctaccacccttcccttcctctccctgccactctctatccttacattcgtctcccatcccgccacacatttcattcccttcccttccttttccgcactgtccgtcagacagcactggcgtattcccccacccatgccacacatcccccccccctcctctcctgcttccctctccttgccacctcctcacccccaccactggttgctctcgcctaggatgccatgctgggtagcgcagatcggccacagcggccggagacggcggtcgtgtcgtgtgtgtgtgtgtgtgtgtgtgtgtgtgtgtgtctctaacgacgaaggcctaaaggccgaaagctataatgttgttgtctgttatttgtgcctttctgcggctcatcggacatctctgtggtgagtaagcaacctatccttctcaaaaatattgttga

SEQ ID NO: 2846 - DNA, 15 bp, unidentified
  source 1..15: mol_type = unassigned DNA; note = Description of Unknown:Locusta migratoria sequence
taataataataataa

SEQ ID NO: 2847 - DNA, 414 bp, unidentified
  source 1..414: mol_type = unassigned DNA; note = Description of Unknown:Locusta migratoria sequence
tgatgcgacgggtagcatacctcgcaggcgcacaccgaattcgaagccaggagagtagcgtggccacgataacattctgtagtggtcaccaamagcagaggagatcgccatgaaagtgctaggaacgcgcatggcgggcgcggaccacctatggaacgcctgggacggccgccactagagagccgcagggcgcggaccgacgagggatcaccagcgtcagataccaccgccagactggagcacattgggcgcggaccgcatagaaagcaccagacgccgcctaggcataaatatgggacgcggtcggcttgtcgatcagtctcagggaacacctgatgaagacgccgagttacggtgtcgaaatatcgtgtttggaagacgcggatcaccggcagtacacccgattccacgaga

SEQ ID NO: 2848 - DNA, 178 bp, unidentified
  source 1..178: mol_type = unassigned DNA; note = Description of Unknown:Locusta migratoria sequence
tgacgtcacagcccgcagtgcagctatataaggacgacagcagcaatcactcgacagtcaaccacttgacaatggccgaggagatctcggccgaaacgtcgtggacagtaaaccacatgacgcggctggaagcccgagaaaattttatcaacataactcgcgcgaaacaatgcattca

SEQ ID NO: 2849 - DNA, 269 bp, unidentified
  source 1..269: mol_type = unassigned DNA; note = Description of Unknown:Locusta migratoria sequence
tagccttgtttcgacccatcgttttgccgattttctccaccggcgcgctactagttctattgcgcctagagggcctctactttggtttcgcgcacgcgcggtgggtcgtcagcggtgtataaaggggccgctgtttctcgttctgcctcagtttccggcgagtaagtgtatcagcgcactcacctgaagatggcagccagttggtctgccgaaatatcgtgtctagttgacgacggtatccggctgcacacccgagatgaatattatca

SEQ ID NO: 2850 - DNA, 107 bp, unidentified
  source 1..107: mol_type = unassigned DNA; note = Description of Unknown:Locusta migratoria sequence
tagtggttttgtaatttgtttatatataatctcttttgttttgtattatagttgtactcttgtctttgaccttttgtatgcaacgcttttgacacgaataaataaat

SEQ ID NO: 2851 - DNA, 454 bp, unidentified
  source 1..454: mol_type = unassigned DNA; note = Description of Unknown:Locusta migratoria sequence
tgatgcttgtggcgtgcaaatcactatacgccacattttaattgagtgtattttatatcgtgctgagagggcagcggctaatcttggtcgtgccctacccactgttttagctgacgacgaggcgagtgtgacgaacgttttacaattttgtgaacgttcccgactctggcctaagctcttaggctggaggttttagtgtgttacaggagggctcgctgatgcctctaacatcagcgatcagcgtccctctatactccgacattttcttttaaggacttgtaaggttggatacttcagtctgccaccttacatcgctgatttgcaatatgtgttcgtgttgttgccaagacctacattctattgcctgttcttatttatttactgttgtctaattcttttgtcagggcgctaaaaaccttgctgttgtgcgcccaaaacatcctatcctatccta

SEQ ID NO: 2852 - DNA, 179 bp, unidentified
  source 1..179: mol_type = unassigned DNA; note = Description of Unknown:Locusta migratoria sequence
tgacgtcactggcggcggcgcggctatataagcacggcagcggccgcgaaatgacagtcatccacttgacaatggcagaggagttctctgtcgaaagctcgtgggcagtaaaccacatgacgcggcttgtaacccgagaagatttcattaatggatatcgccgcgaaaacatgcactca

SEQ ID NO: 2853 - DNA, 147 bp, unidentified
  source 1..147: mol_type = unassigned DNA; note = Description of Unknown:Locusta migratoria sequence
tagtattttctctggtttgtttgtttgcttgcttttattatgcatatttgtacatagtttttgtatttgtaattcttctatatatgaaaattttcaaataagactgtagcatgaccatgtaagccatacgaataaataaataaataa

SEQ ID NO: 2854 - DNA, 564 bp, unidentified
  source 1..564: mol_type = unassigned DNA; note = Description of Unknown:Locusta migratoria sequence
tgatgttgtacttcgtgcagtgtccgaaatatttcttccgacttgatccaaagcatttgtattccaaaagccaatttttaactgttttgcttattaaaactttgttactcgtttattctctctactaatattgtattgccaaaatgacgcctcagccatctctcatgttaaacaaagcattttgtagcaattgttttttcaatactgtttctctctgtacagtagcctagttgtaattgcggctactagatggcactactgaggtaacgtcttcctgttcacaactccacttagcacacgccagtctgatgcctccgtgcaggcgtgcagcccatagtggctagctttttctaaaaatttctttttaaattttgtgacgtaagctttacagctgagttgtatattttattatgtgacttgttttattttataatttctgatgaaggcaatcatagtcattgccgaaaccaggttaaataatttttaatttgcgaccgagggctgcwtttttatcctttgacgttgtaacggtcgctgacaatagcagctatgttcaaaatttta

SEQ ID NO: 2855 - DNA, 272 bp, unidentified
  source 1..272: mol_type = unassigned DNA; note = Description of Unknown:Locusta migratoria sequence
tagtgactgaaattaagtgtaacagattgagatggctgggccatgtagagcgaatgtcggaggatcgagctgttaaaaaggtctacaaggaaatccaggtgaaagaagcaaagggaggcctcggaaacgatggctggaggatgtggaaaacgatttgagaaagatgggagtaggagatggaggaaacgagcagaaaatcgtcaggattgggctgcgatcatcagagaggccaaggccctacatgggctgtagcgccaaggagtaagtaagta

SEQ ID NO: 2856 - DNA, 85 bp, unidentified
  source 1..85: mol_type = unassigned DNA; note = Description of Unknown:Locusta migratoria sequence
taaatagtataaggtggttcgatgaaccctctgccaggcacttaaatgtgatttgcagagtatcccatgtagatgtagatgtaga

SEQ ID NO: 2857 - DNA, 19 bp, unidentified
  source 1..19: mol_type = unassigned DNA; note = Description of Unknown:Locusta migratoria sequence
tgagaacgagagaagaaga

SEQ ID NO: 2858 - DNA, 191 bp, unidentified
  source 1..191: mol_type = unassigned DNA; note = Description of Unknown:Locusta migratoria sequence
taagctaattcatttttttctttattgattcttttcactttgtcttaagattgtcgtgtgcataggactacttaaaaattttctattaccattcttgtgtaaaaattaatgtattgacttgttccatgaccatggagtctcactcctcaattgggtcctatggaacagaaaaaacaataaataaataaata

SEQ ID NO: 2859 - DNA, 584 bp, unidentified
  source 1..584: mol_type = unassigned DNA; note = Description of Unknown:Locusta migratoria sequence
tgacctctctctgtagattgccgccgcctcctccctccccctcccgtcccccgcttggctcaccccctcctttctccacctccccgggagctccttccttccggtttcccccattctcccctcccccacctcccttccccttcccccgcgccttctccatcctcccccctccccctgcagggccagtacagtgctagtgtttttaagtgttcagtgcttcgtgtgtatagtgtttcgtcgcccagtgttttttaacgttgcgtacacgcctgtgggaaaccagtgttcagtgttttttacctcaatgtcgccgtcatgttatgtctcgtcgtctgcagtgagtgttttttagccaccgtggcaatgtcttgttttaacaaccatgtatgttctgtccactgtcatgttgtcttttaacattctcccatattttcatcttgtaattgtaaaagcgccattttatcacctttaattttatattctgttttgtccattgtttaccattcgctcggctgtagagcagcatcatcggctgctgccagcctgcctgtattagggcattaaaattcaataaaggaaaaaaa

SEQ ID NO: 2860 - DNA, 263 bp, unidentified
  source 1..263: mol_type = unassigned DNA; note = Description of Unknown:Locusta migratoria sequence
tagtgatgttttatctctgacaaggactatctctgctgataacgtgacagcttggccacgcccacttttcacagtatatatggcgctctcagacacccgactcatcagtcggcaagactcaacgcaagtaagaagacctccgaagatgtccggcgcagctctggacgaaacgttaggagaaactgaaaagttttatggaccacggccttataacccggaagttctaccagcaactatgatccggtcgtgaaagccttcatgca

SEQ ID NO: 2861 - DNA, 104 bp, unidentified
  source 1..104: mol_type = unassigned DNA; note = Description of Unknown:Locusta migratoria sequence
tagtgtaaaaccttatgtactaggtgtattcatttctgggcgtattagtatgttggaggtaaacctctgtaatgaggacaatctcaataataaaataaaataaa

SEQ ID NO: 2862 - DNA, 435 bp, unidentified
  source 1..435: mol_type = unassigned DNA; note = Description of Unknown:Locusta migratoria sequence
taaacaatcccactgccaatcatagataatagcgcaacaaaattatcaaagataaaatatcccaacatatttcgttcaattttaaataaaagctttgcctcatagatatatattctctgtgcaaataatgtaagcatattacatctctgtagagctgtcaagtaaatgtcaaaatccgtaacttgataaagatcttgcatgacagcacaatattataagttacgtgatatataatacaacataacagaatgtggtatgtagcatttcttttacatctgtataaaacaagtaggcagcatagtataaatattatgaaaacttatgtattgcaggcataacacctgaagatgactattaagtcgaaataagcttatmgtgtaactaatacgaattaaaatatacagtgttgaaattatataattgttattattaaaa

SEQ ID NO: 2863 - DNA, 30 bp, unidentified
  source 1..30: mol_type = unassigned DNA; note = Description of Unknown:Locusta migratoria sequence
taggagatacaggaaataagtcaagtcaag

SEQ ID NO: 2864 - DNA, 256 bp, unidentified
  source 1..256: mol_type = unassigned DNA; note = Description of Unknown:Locusta migratoria sequence
taaaccagtggtgaatgcccgaaacgagcctttgggggatcaataaatgacatccaccatgcatcacctgaagggctcaactggatcacctgttggacttagaatctaagaacttgtgtaatgtgtacataatttaatataacactgtacatatgatcctgtacatatattgtccttgtcatacatatcttacaatgtatacaattagaactatgtacttgaaccaagctctgtatcatcattcgataaataataa

SEQ ID NO: 2865 - DNA, 805 bp, unidentified
  source 1..805: mol_type = unassigned DNA; note = Description of Unknown:Locusta migratoria sequence
tgaagattggtctccaagacagggatttcagactgcaactgacccgtaaggttctgggatttggacctcggaatgggctgccttgaacgaaccgaataagctgcgcgtagtcaagcccccacagccgtgtggagatcctccctgcgagcctctcgtagggagtctgtagtcctctgcagactacgtattggmcatacgtggttgacacacggccaccttctacgcgagaggacccaccaaattgccgttgtggtgcactattgacgtggtccacatcctggtggactgcccacttttagccgacttgaggcagtcttttaccctgccttctgagcttccattgattttatctgacgatgcctctatggttgaccgtgttttaggttttattcgcgcagctggcttttattggtctatttagtggtggggcctatttgcccgccttctcgggctcccacccctccagaacaataggccgttgtccttttacggtttatgacttgtttttcaattaaggattttagtgtgtgcagagtggctggctcatcctgtattatccttgtgatcagccagccacactcttctgctgtcctattttagttttctgtctatttggtcaactcctgtctgtcctctgttatatgtcgtcattttaccattgactgtctctctgtacccggagtatactggacgtggagtactatgcgacaaaagggaaacttttaaaagtgaactcttagctgggaacaggggactgataacccagcagtttagtcccctttaaacacccaacaacaacaacaac

SEQ ID NO: 2866 - DNA, 190 bp, unidentified
  source 1..190: mol_type = unassigned DNA; note = Description of Unknown:Locusta migratoria sequence
taagatgcaaatgtatgttgtcaattatcatcagcagtgatatgaacatgtaaatttactaaatataatattttatttgtctgtaagtgtagatgatgtacttaagattttatgtttgtattgtatacaaatatgatgacaacatccatacaatttttattgtatacggatggataaataaataaataaa

SEQ ID NO: 2867 - DNA, 488 bp, unidentified
  source 1..488: mol_type = unassigned DNA; note = Description of Unknown:Locusta migratoria sequence
tgaagtgacctgacgcggctccgaatcgggcactgcccattaacgcacaagtttttattgtcaagaagatcctcctttttgtgatgcctgtggcgtgcaacttacatagccacattttaatgagtgcatttatatcgtgctgcgagggcagaagccaatcttagtggtgatctgccctccattttagctgatgacgaggcgagtgtgaaaaggttttaagattttgtgaagcgtctgcactctggcctaagcttttaggttggagattttagtttgatgcgagtggctggctgagttcctccttgtgtgtcagccagccgtgctaatctacctagtcctctcttggtaactgtgatatgaatgtttttatggcctcatttaactagcttgtctcttatcttgtttgacactcgtctcactctgttttcgtccgggtgctaaagacctcgacgtctgcgccctgatccataatcaccaccacaccacca

SEQ ID NO: 2868 - DNA, 214 bp, unidentified
  source 1..214: mol_type = unassigned DNA; note = Description of Unknown:Locusta migratoria sequence
taacattacaattacctattgtacatgacatttatcctacattttagcttataaattttattactctctggacatggccagctttagccgaaaagtcttagccctacaaaatacatgttcatgtaatatctatgaagagcctaacaaacctatctatccgatgtctaatgtacgtataaagtttgatgcttctgacacgattaaataaaataaa

SEQ ID NO: 2869 - DNA, 178 bp, unidentified
  source 1..178: mol_type = unassigned DNA; note = Description of Unknown:Locusta migratoria sequence
tgattcaattgtactatatgttgtatttgtctatctctgtttttatagttttaaatctgtactttatattttatctctgtatttgactactgctttctgtaaaagcacttactttgtagtttaaattatgtgctggcttctttcagttacatttgtgatgtagttcgtacacgaataa

SEQ ID NO: 2870 - DNA, 75 bp, unidentified
  source 1..75: mol_type = unassigned DNA; note = Description of Unknown:Locusta migratoria sequence
taaaagtggttcgatgaaccctctgccatgcacttcaatgtgacttgcagagtatctatgtagatgtagatgtag

SEQ ID NO: 2871 - DNA, 554 bp, unidentified
  source 1..554: mol_type = unassigned DNA; note = Description of Unknown:Locusta migratoria sequence
taaagtacaatccatcctaccgtaatatacttccaaatatgcaacaaaacgcgataaattatagtagcaccgcaatattatccctatattacaatatagacacaaacaatttattacacttaaaatagttcggaatgaaattaaaatttattgtacgatatttgtatggtactgtttatgtcacactgcatataaccaacgatattgttacaaacaaaattaagcaaagaatatttaataaaaacatctttggatcaacagctctgtaaattacaccaaagtaattacaacaaacagcgtgacctaaacagtaaccaaatataaatgtatatatgaatgtaagtaattacaacttgtacagtcaatataacattgccatattaatgtattttcatgtaaaacacactttgttctctgtaataggtggcttagaaaatgggcaaagcccgaaactagtcgtcagcatttcaaataaaagcagctttggtgcatatataaaaatgtcttttctacaatatttaagagctgcaaaacgcgacatatcaaaaacattt

SEQ ID NO: 2872 - DNA, 128 bp, unidentified
  source 1..128: mol_type = unassigned DNA; note = Description of Unknown:Locusta migratoria sequence
tgagaatgtcctccgcagtcggggacgaaacgttgggtttcaataataaatccacaagaccacggcataatagcccggaaatttttagtaattttgaccattccggccgtgaaagtttacattttaca

SEQ ID NO: 2873 - DNA, 81 bp, unidentified
  source 1..81: mol_type = unassigned DNA; note = Description of Unknown:Locusta migratoria sequence
tgacagagatatgttttatcttattaattagacactagtatatcttactaaagtattatatgtagctgacattataccata

SEQ ID NO: 2874 - DNA, 176 bp, unidentified
  source 1..176: mol_type = unassigned DNA; note = Description of Unknown:Locusta migratoria sequence
tagacatgctaaaaactacttaataaatgtaatatagtaatgactcatttttgttgtgatgtgccatatatactatgtgtatatagaaatctgtatacttatgtaaaaaacctgtaagcaatatcctatatcaataatttgatgaagtggatgcttaaataaataaataaataaaa

SEQ ID NO: 2875 - DNA, 137 bp, unidentified
  source 1..137: mol_type = unassigned DNA; note = Description of Unknown:Locusta migratoria sequence
tagctcttccttttgttgtattttaccctatgtttttagctgttttcatataggcttattatccttcggtatatctcagttttgattcgggcgctaatgacctcagcagttgtgcgccctaaaaccacaaaaaaaaa

SEQ ID NO: 2876 - DNA, 270 bp, unidentified
  source 1..270: mol_type = unassigned DNA; note = Description of Unknown:Locusta migratoria sequence
tgatgttccttatatagctaatcaaaattgagaatataagttttgttgcaaacattgtactatatacctcataagtattccccctataaatattgtgctatgtatcccttgttttgttgtaaacattgtactatataccatacctacctcatagttcataagtattccccttataaatattatgctatgtatcccttgtaaccaactgacgtattcagaaaaatgatacttgtatcatttgatgttgaataaagtttatttatttattta

SEQ ID NO: 2877 - DNA, 175 bp, unidentified
  source 1..175: mol_type = unassigned DNA; note = Description of Unknown:Locusta migratoria sequence
taggagccgtacgcacaactaggatcaccaagacgacgcaaaccgcaaggacaatcaacaagccaggacacagaataccagcacccagttattttggaggcgtagctcaccagcttggactccaccgaccatcggaaactcatatgtttccgtcattgcacgagcgagcgagcga

SEQ ID NO: 2878 - DNA, 156 bp, unidentified
  source 1..156: mol_type = unassigned DNA; note = Description of Unknown:Locusta migratoria sequence
taaatgaagcaggacttaaatggcttaaatcactggacctggctctgtgacgggagatcctattcacacataatttttaatcccctgaacgcaagtactatgtactgtagtaacaatagtttaatatggtggctgacaagaaccatacgataataa

SEQ ID NO: 2879 - DNA, 203 bp, unidentified
  source 1..203: mol_type = unassigned DNA; note = Description of Unknown:Locusta migratoria sequence
tgactgacagcagcgccctctgttttgcctatatatacgacgcttactcgcgctctcgttgcagtacgccgctttacctccgaggatgccttccgcagacgagggcgaaacgtcaggggaaagtttcatgtatggaccacggcatctcagcccggaagctttaagtaatgacgacacctgccgtgaaagccttcattctatga

SEQ ID NO: 2880 - DNA, 59 bp, unidentified
  source 1..59: mol_type = unassigned DNA; note = Description of Unknown:Locusta migratoria sequence
taattgtatgtatatattcttgtatacttgtgaaaaccatacgataaataaataaataa

SEQ ID NO: 2881 - DNA, 23 bp, unidentified
  source 1..23: mol_type = unassigned DNA; note = Description of Unknown:Locusta migratoria sequence
tagcgccacaaaagaagaagaag

SEQ ID NO: 2882 - DNA, 29 bp, unidentified
  source 1..29: mol_type = unassigned DNA; note = Description of Unknown:Locusta migratoria sequence
tagttccggacacggaaagtaagtaagta

SEQ ID NO: 2883 - DNA, 214 bp, unidentified
  source 1..214: mol_type = unassigned DNA; note = Description of Unknown:Locusta migratoria sequence
taatttaaaggtgaactgatgtagtgctggaaacagagaagtggactgtgtcttttcactaaatttctaatacttaaataccacatgttatatttataaatgataaatttgtaaaattttctttctttcttatgttatataaaattaacaacatgacttgtgtctaatatcattgtaaatatgatctacagacaaataaattattattattatt

SEQ ID NO: 2884 - DNA, 66 bp, unidentified
  source 1..66: mol_type = unassigned DNA; note = Description of Unknown:Locusta migratoria sequence
tgacaagaagaggatcaacccatgacaagacctgccgcaaggcagaatacaattgatgatgatgat

SEQ ID NO: 2885 - DNA, 76 bp, unidentified
  source 1..76: mol_type = unassigned DNA; note = Description of Unknown:Locusta migratoria sequence
taaattttaaaatttattacatggactcaaactagatgtaaaggatggtgttctggacacgaaaaataaaataaat

SEQ ID NO: 2886 - DNA, 334 bp, unidentified
  source 1..334: mol_type = unassigned DNA; note = Description of Unknown:Locusta migratoria sequence
tgaacagcaacaggttaaccaaacagatttttaaatatctctgggacaagaagtcaacaatagctggattcaagaagttaggaaagatttggaaagaaacaatataagtgaaaaagatgcaacagaaagagaaacttttaagaagaaagtgttaaaaatggaaggattccaaggcaggagggagaagaagacaggagtaaagtggtctgaggagagaaaaaggatgcatagtgaaaagatgaaagaatactggaggaaaaagaaagaagaacaaaggaggaaacattgaaattggtgcgtggtccttagatggccgaaacgaagaaagaagaaa

SEQ ID NO: 2887 - DNA, 31 bp, unidentified
  source 1..31: mol_type = unassigned DNA; note = Description of Unknown:Locusta migratoria sequence
tgacatggattcggacacgaaaaagtaatgt

SEQ ID NO: 2888 - DNA, 477 bp, unidentified
  source 1..477: mol_type = unassigned DNA; note = Description of Unknown:Locusta migratoria sequence
taaatgaacaagttcaagcaatacatacagcttttttaaaaactttgtggacctattataacaaaagtcgtttattttaaatttcaacctctgtcttactgtgcaaatgatttcgtgacacctgaatgtacccactagcttgtggatgatctttggaatttagaggtctttgttttcatgtgcatacgtgcgccccactcgtgttgttgactccgtgcatttcgctagtgttatgcgccgccagtgctggggtctgtttgaatcctgacgaagcacagtatgctgaggacctttctgcgtagacacggttacaagggaagtaaccacgttttcttttattacgttttagatttttattgtctcaggttttaagattcttgtatagattatctgatgatgagggcttgacccttgaaacgcgtcatattttagtgtttttacacgatctctgtggttgagcctacttgacaaaataat

SEQ ID NO: 2889 - DNA, 363 bp, unidentified
  source 1..363: mol_type = unassigned DNA; note = Description of Unknown:Locusta migratoria sequence
taatgggaagcctgatatttcaggcacccaccattcaaacggttttaatcttttcgtcctgtcagtccactttgactggcagtttagtgtgtgcagaatggctggctcatcctatattatctttgcgatcagccagccacattcttctgctgtgatattttatgttgttgtctgtttggtcaactactttgtgttttcctttaaatgttgtctcttagcacgcattatcactctgaccgtctctgcattagacgtggagtactttttaccgctaattaaaagatgtgctctcttggctaggaacaagggactgataaccgttgctgtttagccccctttcaaaaacccaacaacaacaacaac

SEQ ID NO: 2890 - DNA, 243 bp, unidentified
  source 1..243: mol_type = unassigned DNA; note = Description of Unknown:Locusta migratoria sequence
tgatgtttattatcgatattctgaccggtttcatctttggtcgtgtcggcgctgtgtgcttgcttgctcggtgtgtgttgtctttcctgtttactcattgaaaaccgaggttttaaagatcgttgcacattgcttcctcactgcagtttcgccttgaaaatggcagggtggtctcctgccgaaatatcggccgtcgtcgattttggtacctggcagcatacccgtaagtttttcgaagttgtt

SEQ ID NO: 2891 - DNA, 314 bp, unidentified
  source 1..314: mol_type = unassigned DNA; note = Description of Unknown:Locusta migratoria sequence
tagaaatgtaggtctatgataaagtgtgtagagaaaatgtaaatttactattagttattacgatgtatttatttatataaaaaatgtaatcatgctgtgtaaaagtggcaaatatccattttattcaatatgtagagtaacaaaaattctagcagtgaaaaacattatgtggtaaatcgtaccaagtaaaatgttaatctacttttaatattacaacacaagaaaagaaatatgttaggccagaaatggtccaatatctattgtaccctgtacagttctggattcacaggaccaataaataaataaataaataa

SEQ ID NO: 2892 - DNA, 81 bp, unidentified
  source 1..81: mol_type = unassigned DNA; note = Description of Unknown:Locusta migratoria sequence
tgaggatggcgggcagttgcgccgctgaaatattgtgtcaagttgactttagtatccggctgcaaacccgagaagattaca

SEQ ID NO: 2893 - DNA, 246 bp, unidentified
  source 1..246: mol_type = unassigned DNA; note = Description of Unknown:Locusta migratoria sequence
taattcataatatttatgttggccataaaagtaataaataaaaaaaataaataacctctgtattattaaattgtcatgtttatttttgaactaaattgtattaatgcataacaacaaattgtaataacctctgtattattaaattgtcatgttattattttgaactaaatttgttaacaacaaattgtaataacctttgtaatattgactaaagtggtccaatgaaggccataaaataaataaata

SEQ ID NO: 2894 - DNA, 114 bp, unidentified
  source 1..114: mol_type = unassigned DNA; note = Description of Unknown:Locusta migratoria sequence
tgattttataactacattgtatgtatatattattattttaaactgacgagtctcctgtacactaaatcaatgatttaacttgtatgttatgagacaataaaattctgattctga

SEQ ID NO: 2895 - DNA, 27 bp, unidentified
  source 1..27: mol_type = unassigned DNA; note = Description of Unknown:Locusta migratoria sequence
tgaccgaccggacacggaaatgaatga

SEQ ID NO: 2896 - DNA, 84 bp, unidentified
  source 1..84: mol_type = unassigned DNA; note = Description of Unknown:Locusta migratoria sequence
tagaaacctttctttacatctgcataatttttctttttaaattaatatgtaggtattttatgatgtctctgacacgaataagaa

SEQ ID NO: 2897 - DNA, 335 bp, unidentified
  source 1..335: mol_type = unassigned DNA; note = Description of Unknown:Locusta migratoria sequence
taataataaattacaaataaaaagtgttgtttattttataactatgtacacagtatggtactataactttgttactgtcttgaacacattgtaatacatctgtatgtttattgtctgatatctatttatggtagtgtacatatctgataactataatgtaattgtttattattcttgacattcatttcatattattttcttctatcttatgggattttctaagtcatttattgttgctattttgttttatcattattactattttatctaaccttgacgacaccgattgcatgtaaaaatgctcaaaggtgaataaagcatctaatctaatctta

SEQ ID NO: 2898 - DNA, 59 bp, unidentified
  source 1..59: mol_type = unassigned DNA; note = Description of Unknown:Locusta migratoria sequence
taatctaatataggtgctggaaaaatgtactgacattgtaaaaccagaataataaataa

SEQ ID NO: 2899 - DNA, 59 bp, unidentified
  source 1..59: mol_type = unassigned DNA; note = Description of Unknown:Locusta migratoria sequence
taattactcaagttcaatcgctctctttaaagggaataatcgaaataataataataata

SEQ ID NO: 2900 - DNA, 231 bp, unidentified
  source 1..231: mol_type = unassigned DNA; note = Description of Unknown:Locusta migratoria sequence
tagtattaatcctattagagttaagtcaataccttttatttacatccttttacatgtaatcaacctgtataaattatgttattaactgtttatctgtaaaaatcattgttatgttataggtaactcacatgtaaagaaatactgtatgtgtaaaaccctggtccgatgtaagagagggcctgatggccctaatctgatcaggctaaataaacaaataaataaataaataaa

SEQ ID NO: 2901 - DNA, 72 bp, unidentified
  source 1..72: mol_type = unassigned DNA; note = Description of Unknown:Locusta migratoria sequence
tagtggtactcaaggtaccctccgccacacaccgtcgggtggcttgcggagtatggtgtagatgtagagatg

SEQ ID NO: 2902 - DNA, 96 bp, unidentified
  source 1..96: mol_type = unassigned DNA; note = Description of Unknown:Locusta migratoria sequence
taattctgtatatatgctgtatatttctatacatttgtaacttgactttgtcaattgctgtaacagctaaacaataaaatttcatttatttattta

SEQ ID NO: 2903 - DNA, 263 bp, unidentified
  source 1..263: mol_type = unassigned DNA; note = Description of Unknown:Locusta migratoria sequence
tgactggctcatccattattatcctagtgatcagccagccacatcttctgctgtgatttttagcacagttgactatttggtccactacttttgtggtttcccttttccttttatatgtcatttagcacacactgccttcctgtacttctcgtgtactggctgtggagtgcttcgtcttcaactgtaaatcacatgtgtgatctctttgctgggaacaggggactgataacccagccgtttagtcccctttaaaaacaacaaca

SEQ ID NO: 2904 - DNA, 16 bp, unidentified
  source 1..16: mol_type = unassigned DNA; note = Description of Unknown:Locusta migratoria sequence
taaagtaaagtaagta

SEQ ID NO: 2905 - DNA, 242 bp, unidentified
  source 1..242: mol_type = unassigned DNA; note = Description of Unknown:Locusta migratoria sequence
taattttgtacataatgttaatacattctagtgaatttgtgaaaagtgacatttgattgttatatacatgtcttacacatgacataacttgtattaaattaaatatgtatatgtttgctcttgcacattaggagataagtgaaaatgaatatataatgctattgacgtatcctatattacacgtacatgtattgtacacaatgtaatcctacaggatcaaataaaaattcaattcaattcaa

SEQ ID NO: 2906 - DNA, 255 bp, unidentified
  source 1..255: mol_type = unassigned DNA; note = Description of Unknown:Locusta migratoria sequence
tagcagaaactagcagcgtcctacagaattagtcacctctttccatattttatgtttctagtttgtaatttgtgtattttaattgtatatttattgaattttgcattcttggattgtaatttgctcaatgtaattgtacattgtaaacatatatttagtgaatttggtgtccctagattgtaaattgtttattataattgtatatttattgatcgaaagatatgtcttagtcctgcacacgtaaataaataaaaa

SEQ ID NO: 2907 - DNA, 430 bp, unidentified
  source 1..430: mol_type = unassigned DNA; note = Description of Unknown:Locusta migratoria sequence
taagattttattgctgacgcttggacaggatgggtgggtttgtggccctccctgcgagcagcagggtttggagctctcccctcccctccccctgacgacttccatttctccttttaacttggttttaattcacgttgtttccccctttttacatttttaggcttctcatttaggagcatacactgttctcctgtatctgcttgtcattaattaacggggattctagatttgtcgcgacgttccttgcagaatcccgctttttctattggttttagtcctgttctacttgattttaacccccttttagttcctctattttactctcgtcacggtcttagccgaccacaccctggcttgcactccatacagaggtcatgggactgatgacctagctgtttggtcccatccacccatcaaccaaccaaccaac

SEQ ID NO: 2908 - DNA, 57 bp, unidentified
  source 1..57: mol_type = unassigned DNA; note = Description of Unknown:Locusta migratoria sequence
tgagggaagttgtgtaaacgtaacccatagatggctgtaacgaaaataaataaaaaa

SEQ ID NO: 2909 - DNA, 152 bp, unidentified
  source 1..152: mol_type = unassigned DNA; note = Description of Unknown:Locusta migratoria sequence
tgagcctgctatggacaataatgacgtatatgtgtgaaaatcatgagtatatatgaatgtataattagtacttagtttttatttgtaatctagtatatgtagcctattaattaactacagatgtagctcagacacgattaaataaaaataaa

SEQ ID NO: 2910 - DNA, 795 bp, unidentified
  source 1..795: mol_type = unassigned DNA; note = Description of Unknown:Locusta migratoria sequence
taatttccactgtctgtgaccgagacaccactaaaactgcctattttagttactttcatgcataatgttgtatggcatagttttctggggaatcagccactttccaaaaaaaatattcattgcacaaaagagagcgatcaggataatgagcggagtccaacctagacattctgtagaaacctttttagaaaattggggatctgacaactgcatgtcaatatatctactccctactgtgctttattgtcaaaaatgtgcacttgtacaaaactaatgatgttaccatactcacaataccaggaggaagctagatctccattatgaattaaaaaacctaatactgtacaaaaaggagtccactatatgagctgcaaagtgttcaatgctcttccactatcctgaaatcacttgtccatgagcctcccaaatttaaacaacagctcaaacaatatctatagataagtccttttattcagttgaagaatatttcaatttgtgttaacaatttattttttaatttacaagatgttatttttggtagcatgtattgtaattttgtcaatatactattcttgctgtgagatctaccttttttatgtaattttattcttttaattttttgtgtaatgtaatttttgtaattttaatgtgtaatttttgtctatacctttaatgtgtaatttgtctattgcaagagggattctgtatgttccttttgtaacaatttgacacgtcctacatccagtgaatgtctcgctgtattggatccatgggattaaataaataaataaataa

SEQ ID NO: 2911 - DNA, 248 bp, unidentified
  source 1..248: mol_type = unassigned DNA; note = Description of Unknown:Locusta migratoria sequence
taatgtaaacaccaatcctggacttccttttccaccaataggaagaaataaagcaaacaccaatgataagagagctgaaaccaccaatcataactggcaacatttaatatttaagacaccagctttccctcatccagcagtaaacgtaacacccagaagatggccgcttgcaatagtggccgaaacgtcggtgaaatatttgatatattgacgatgcggtccaatacccagaagagttttatcaacaa

SEQ ID NO: 2912 - DNA, 71 bp, unidentified
  source 1..71: mol_type = unassigned DNA; note = Description of Unknown:Locusta migratoria sequence
tgaaagtggttaatgaaccctctgccaggcacttaaatgtgatttgcagagtatctatgtagatgtagatg

SEQ ID NO: 2913 - DNA, 202 bp, unidentified
  source 1..202: mol_type = unassigned DNA; note = Description of Unknown:Locusta migratoria sequence
taatgtgacaatcaaaatttaatttataacctacactcttttattgtacatatttatgttaaaaagctaatcatgtaacaatatatattttaatatgtaacatttatatatgttaacttttgtaccataatgtatgcaatgacgatgccttatacaacatcacagttgtccacaggcaaaataaatcaatttcaatttcaat

SEQ ID NO: 2914 - DNA, 393 bp, unidentified
  source 1..393: mol_type = unassigned DNA; note = Description of Unknown:Locusta migratoria sequence
taaaagaatccgttgaaatacgcattgcggaaaatctgatgaaccgtgacagcggctaccagctgaataatgcgtggaatcccgtcatctccgagatttgttctagacgaagacgccagaagactccgataactgcggcagcggcactatcgaagacagctgatccttgcagttccaccagcgagggcgctgccgccgggcggtgtggtccttctgtcaccgtgtcttcgacgcatgcgcggtaataccaccagcgcgctatataaggcggagcggagagcgtcttcgtcagtccttgttggctcacctgaagatgactggcaggtgtccagttgaaatatcgtggaatgaagtttacgacgaccggctgcaaacccgaaatctttttgaaca

SEQ ID NO: 2915 - DNA, 111 bp, unidentified
  source 1..111: mol_type = unassigned DNA; note = Description of Unknown:Locusta migratoria sequence
taatatttctgtctgtttatagttcgtagtttacatgtatgtaagtaatctctgtatgttatacctttataaacttctgtacacatgatgcttctgacacgaataaaaaaa

SEQ ID NO: 2916 - DNA, 15 bp, unidentified
  source 1..15: mol_type = unassigned DNA; note = Description of Unknown:Locusta migratoria sequence
tgatgatgatgatga

SEQ ID NO: 2917 - DNA, 85 bp, unidentified
  source 1..85: mol_type = unassigned DNA; note = Description of Unknown:Locusta migratoria sequence
tgatgatgatggcacgttacgctatcgaaaattcgttccacaacgatcaatccatccggctgcacgcccgagagatcttcactca

SEQ ID NO: 2918 - DNA, 677 bp, unidentified
  source 1..677: mol_type = unassigned DNA; note = Description of Unknown:Locusta migratoria sequence
taaaacacacacacacacacactaaaacgaaagcaacatgattcaaaactcccgcccccaccacagtcagctgttcttaacactactcccagaattcaactgcccaccatcttgttttcataacataaacattgagtgaaagtgaaagtgacacagtgcctgtccacaacacgaaaacagcgcatatccaccaaagtaagtgacaaaaacttgttataaacacatagacattttgttatagaagcagtagctacagtaaaatcaaaccaaaacacaaaaactacgtcctgtattttcgtaaaaatcccgatatttacaagctaaccattcaccccattaaatacacacgttttggtttgcagatgacaaactgtcaaaaactmtcagtgacgttttgtgagttgaagaaccacaaacacaacacatgtggtattaaggtaggcctagcatacctataaaaataagaaacgatttatattagtctcacaattatctgtagttttcacagttaatgtacaaaaagtaacaatcattccattgttaatttgacagacaataaacatcccactgatgatgctgcaacgccagcgaaacatgtatgggagaaactaaaaaacatttgtgtttgctcaaggcggaccatacctataaagcaaatttatttgtaagcaaacacg

SEQ ID NO: 2919 - DNA, 187 bp, unidentified
  source 1..187: mol_type = unassigned DNA; note = Description of Unknown:Locusta migratoria sequence
taaaaaattcaggcatttgcaggatttgaggacagaactagaccgagaacgaaatcatcgtggacagaagagcgaagaaagatgcaaagtatgagaatgaaagaatactggaagaggaggaagaacggaagaaaggaagctgatgtgaattaacgtggtccaaagatggccgaaacgaaagaagaag

SEQ ID NO: 2920 - DNA, 166 bp, unidentified
  source 1..166: mol_type = unassigned DNA; note = Description of Unknown:Locusta migratoria sequence
tagttgcccacccattctacaatttagaagaatttctcaactgtaatataatattgtaatattactgacaagctgttatctcttttaaattaacaatttatgttatctatgtgacgttgtctattgctgtaatggcctaatgacaataaaattaattattattatt

SEQ ID NO: 2921 - DNA, 28 bp, unidentified
  source 1..28: mol_type = unassigned DNA; note = Description of Unknown:Locusta migratoria sequence
tgatctggacacggaaatgaatgaatga

SEQ ID NO: 2922 - DNA, 390 bp, unidentified
  source 1..390: mol_type = unassigned DNA; note = Description of Unknown:Locusta migratoria sequence
taatggtgggttcgtatgcctgatcttcaggcatacaccgcttatagttttaatctgttgtcacttttgtcttgtcagtcctatttccgactggcagttttagtatgtgcagaatggctggctcatccattattatcctagtgatcagccagccaacaacatctgctgtgattttwagcatagttgattatttgttccacctctattgtggtttcctttttctttttatgttgtaattttcgcccacactgtcttcctgtacatcttgtgtactggttgcggggtgcttatttttaaccgtaaatgaaatactgtgatctcttagctgggaacaggggactgatgacccagtagtttagtcccctttaaacacccaacaccaaccaacca

SEQ ID NO: 2923 - DNA, 298 bp, Lottia gigantea
  source 1..298: mol_type = unassigned DNA
tgacccccctctctattttctagctcattaagtataatatattctaatccttatatatagatgtttatcttttcagaacctatwaatactcttttcttttagaactggtaacaagaaaactttcatattatagacttttgtttattgtagattactcgtggttgtttttttaacttaatactaactatgctaacttcaccttatcttgtattgaacatttatctctttatttgtgaccttggccagtgctttacatagaagtttttaggaacttcttcactcttaacaccaataacca

SEQ ID NO: 2924 - DNA, 98 bp, Medicago truncatula
  source 1..98: mol_type = unassigned DNA
tgagttggatccaaatttggtgtatgatagaacactatggcgtcatttgatccatgtagccgaccccacttagtgggataaggcttggttgttgttgt

SEQ ID NO: 2925 - DNA, 41 bp, Melopsittacus undulatus
  source 1..41: mol_type = unassigned DNA
taaaacccttcccaaatcttcgttcgcgaagtcaagccatg

SEQ ID NO: 2926 - DNA, 18 bp, unidentified
  source 1..18: mol_type = unassigned DNA; note = Description of Unknown:Mesobuthus martensii sequence
tgattatgatgatgatga

SEQ ID NO: 2927 - DNA, 33 bp, unidentified
  source 1..33: mol_type = unassigned DNA; note = Description of Unknown:Mesobuthus martensii sequence
tagaaatgggaaggagcttgatgatgatgatga

SEQ ID NO: 2928 - DNA, 39 bp, unidentified
  source 1..39: mol_type = unassigned DNA; note = Description of Unknown:Mesobuthus martensii sequence
tagccccaacggttacccaaccatgggaagatgaatgaa

SEQ ID NO: 2929 - DNA, 29 bp, unidentified
  source 1..29: mol_type = unassigned DNA; note = Description of Unknown:Mesobuthus martensii sequence
tgaaataagaaatctgatgatgatgatga

SEQ ID NO: 2930 - DNA, 16 bp, unidentified
  source 1..16: mol_type = unassigned DNA; note = Description of Unknown:Mesobuthus martensii sequence
taggattggattggat

SEQ ID NO: 2931 - DNA, 222 bp, unidentified
  source 1..222: mol_type = unassigned DNA; note = Description of Unknown:Mesobuthus martensii sequence
tagccatcattgtggtgggaaaatttcccaggactgtatctgaggtccttcagacagctctcaatacagtctctaagtggtgtgatagggttggattgtctgttaatccagctaagactgtcattgtaccttttacacgaagaagacaattggcggggctaattgaaccatcattcttcggcaaaaggttgcagttttctacccaggtcaaataccttggtg

SEQ ID NO: 2932 - DNA, 1497 bp, unidentified
  source 1..1497: mol_type = unassigned DNA; note = Description of Unknown:Nasonia vitripennis sequence
  misc_difference 70: note = a, c, t, g, unknown or other
taaaagaaaatataatacaaatagagaaaagagcaaacgaaagaacgwaaagagcaatcgaaaggaaacnagagcaatagagaagaggaaaggaaaaaacaaayaaggaaagawagaaagaaccagacgaaggaackaaatagagcgcagggacatttagagagcaggggagacgacggaacaggaggaacagtggatgaaacaaaagtcactaggwawggacaagaaaacgatacaggtggaragaggaacgtggacgagacagaaaagaaaacacgtggtgagccacagatagaaaagaggttagtaaagataaaacaagtagtgaaaggagaagataaaaaagtgaaaaggagaagatgtacggagacaagaagaaagaaagagagatgagggaactgagagaggaggtrgaaggatggaagataaaggcgaggtttgagagagaaaaaagagaagccctggaaaagaaaatgcaggatgtgagagaggacgtggagtttttaaaggggaagatgaaaaacatgcagaaagagatagatgagatgagagaagggcttgcaggtaagaaaaatagagtggagacggtaaagaaaaggcaggagatgagaagagggagaagagtaataggagaagagagaattttgagagagagaaaggctgatgcggccagtacagatataggaaaggggacagcaggtgcaaggtgtgggaaagaggcctgatagtacacctaaacaattggacggaggaggattctataaaagactggctggaggatataatggaaggagtggaatgggagatggaagatacaaggacggaggacacgaaaaaggtaatttttaagagaaargaagacatggaattgatatgggagaagagggcggaaataagagaaggaggcaaaatcaggctggagcagtggctatcmttcgatgagagaagggccaaagcgctgattatgagagagaaaaggagaagagaagaggatgagatcgaggagggcgaggtctcgcacaaaaaagaatgggtagctgaaatagaaggcgaactgtacaagtgggacgaaaagaaggagagaattgtaaaaaaaggaaaagggatagaackgggagaagaggrcagatataagaaatggaggtcgggggagtcagaggaggaagaggaagawtatcagacaaagatggagagaaaggaagagtagagtttactcacaaacacacataaacacacacaaacaatcaaacacacacacacacgtacgacttatacacacgcacacacacacacatgcacaaacrgacacgaaaacargaaaagmaggagarcrcacayacacayacacacatrtacacasgaacattacctacagagacacacataacacaccagattaggttaaagtaggattaaagcaagaggtatgtaaatatacgaatgaataaatattgtaaacacgaatagtgaaatacaataaagttattattattatta

SEQ ID NO: 2933 - DNA, 183 bp, unidentified
  source 1..183: mol_type = unassigned DNA; note = Description of Unknown:Nasonia vitripennis sequence
ctcgtacacactccacgcacacgcacacacctactttctcgctcattccaccttcactatcgccayactytcacactatacatactctaaacatacctcaatctattgttatttcttttcttactttgtaatgctgtaaacttacaatcgtacaatataatgtacgcaaaataaaactaatct

SEQ ID NO: 2934 - DNA, 91 bp, unidentified
  source 1..91: mol_type = unassigned DNA; note = Description of Unknown:Nasonia vitripennis sequence
gggatgtcatgacgaagggtggtacaatgggtttacagcctaagtgccagggatctcggaggtccccccttcatagtaataataataataa

SEQ ID NO: 2935 - DNA, 31 bp, Nelumbo nucifera
  source 1..31: mol_type = unassigned DNA
taatgaaagttaccgtttcctataaaaaaaa

SEQ ID NO: 2936 - DNA, 142 bp, Nelumbo nucifera
  source 1..142: mol_type = unassigned DNA
taacttaactgtttcttttttccttttctctcttttgagggtttaagttgtattcggaagataagagtgtttgtcttccttgctgtaattattcttgtgatgtttcaatgaatttaatgaatctgttattgatcaaaaaaaa

SEQ ID NO: 2937 - DNA, 45 bp, Nelumbo nucifera
  source 1..45: mol_type = unassigned DNA
tagtttcatatctttaataaagtttcttgttattgatcaaaaaaa

SEQ ID NO: 2938 - DNA, 839 bp, Nelumbo nucifera
  source 1..839: mol_type = unassigned DNA
tgaatgtgcagagtttattcaggttcatgccgagtgggccaacaaaaagggccaaggctatgtggagatgtatgagggctgcagtatgctggactgtttgggaggagaggaactcacggatattctcagaaaaggagagaaccttggaagtaatattggaggtaatccatattagggtgatacattggctgaaaactttggccttgtttgcagacttctcagtagatgagatggtaaaaaactggaaggaaattgcagaattagcctcagctaagaaggcatcactctcttgctggagtcccccacctaatggctttmttaaactgaattttgatggcagcagtatgggtaatccaggtccatctggaatagggggagcaataagagatgaacatggaaatctgttagctatgttttcaggaccaattggggaaggagactccttgagggctgagattcttgcagcccttgaaggggttcgaagagccaaggagatgcaaattagaaagctgatcattgaaggagattctgaagtggtggtgaactggttaaaagaggataactcaaggatatggaagtacagcaatgaaaaacgaaaatttaagtggctggctaaggatgttgaaattcagtacaaatgggttaagagaagtgcaaactcactggcagatggtttagctaggcaaggggttaatagaaactctttgttttgggctttattgtaattgtatttgctgctcatagactgtttagggagctaagattgtttagcccccttgctttgtaattcttcttaattttaatgaatacatttcacagttattgataaaaaaaaaaaa

SEQ ID NO: 2939 - DNA, 11 bp, Nematostella vectensis
  source 1..11: mol_type = unassigned DNA
taacaggtaac

SEQ ID NO: 2940 - DNA, 497 bp, Nematostella vectensis
  source 1..497: mol_type = unassigned DNA
taataatacctattgatatatatatgcatgaaaagatatatttatttttatttaacatttacattaacaattaacatattttttactagtttctgatctttagggtgcatgccatggatgcatggagcggctgccaaactagcgggagttggctcaagggtgaggcaaagattctttgtttcgcgcttgggttgattcttgttggttggctgtttcatgcatttatggcattcactctattgatgataattttaatttcatgtatatataattaattatttaattttatcaaatatctaatttcaataattttcaagtaatatatatttatgcttcattttcaatttaacctaaattatttttccgatggccgataattattattattatatttttcttttgtatttacatattgtattttctttttcaactcctagtatagtcttaactgttttttaggagtataactattaaagattaaagattaaagattaaag

SEQ ID NO: 2941 - DNA, 139 bp, Nematostella vectensis
  source 1..139: mol_type = unassigned DNA
taatagtataacgctatatgtgctggccctttgccttaattcagtctgtaatactgccatggcaattgaataaaacccctatctatctatctatctatctatctatctatctatctatctatctatctatctatctatc

SEQ ID NO: 2942 - DNA, 38 bp, Nicotiana sylvestris
  source 1..38: mol_type = unassigned DNA
taatattaatatatgtttatcttttaaaccaaaaaaaa

SEQ ID NO: 2943 - DNA, 1446 bp, unidentified
  source 1..1446: mol_type = unassigned DNA; note = Description of Unknown:Notamacropus eugenii sequence
cttggtactggctaagaaatagaatggtagatcagtggaataggttaggtacacagaagtcaatgacyatagtaatctactgtttgataaacccaaggaccccagcttctgggataagaactcactatttgacaaaaactgctgggaaaactggaaaacagtatggcagaaactaggcatagaccaatacctgacaccatataccaaaataaggtccaaatgggtacatgatctagatataaagggtgatactataaacaaattaggggagcaaggaatagtttacttgtcagatctatggagaagggaagaatttatgaccaaacaagagatagagaacattatgaaatgcaaaatggataattttgattacattaaattgaaaaggttttgcacaaacaaaaccaatgcaaccaagattagaaggaaagcagaaaactgggaaagaatttttacagcaagtgtctctgataaaggcctcatttctaaaatatatagagaactgagtcaaatttacaagaatataagtcattccccaattgataaatggtcaaaggatatgaacaggcagttttcagaggaagaaattaaagctatctatagtcataaaaaaaatgctctaaatcactattgattagagagatgcaaattaaaacaactctgaggtaccacatcacacctatcagattggctaacatgacaaaacaggaaaatgataaatgttggagaagatgtgggaaagttggaacacctaattcattgttggtggagctgtgaactgatccaaccattctggagagcaatttggaactatgcccaaagggctataaaaatgtgcataccctttgatccagcaatactacttctaggttgtatcccaaagagatcataaaaatgggaaaaggacccacatgtacaaaaatatttatagcagctctttttgtggtggcaaagaactggaaattgaggggatgtccatcaattggggaatggctgaacaaattgtggtatatgaatgtaatggaatattattgtgctataagaaatgatgaacaggtagacttcagaaaaacctggaaagacttacatgaactgatgctgagtgaagtgagcagaaccaggagaacattgtacacagtaacagcmacagtgtgtgakgactrtttttgatagacttagctcttctcagcaatgcaakgatccaaaacatttccaaaggactcatgatgcaaaatgctatccacatccagagaaaaactgtggaatckgaatgcagatgaagcagacttttttttttattctgtgtcttcttttacaacatgactaatatggaaatatgttttacatgattgcacatgtataacctatatcaaattgcttaccatcttagggaggggggaggggagggagggagaaaaatttggaactcaaaattttaaataaaaa

SEQ ID NO: 2944 - DNA, 451 bp, unidentified
  source 1..451: mol_type = unassigned DNA; note = Description of Unknown:Notamacropus eugenii sequence
tgatgggctggccacgttgttcgaatgcaaaatgtatgcttgccaaaaagactattttatggagaactcgcatggggcaggtgatcacatggtggtcagaagaaacaatacaaggacactctcaaggtctctctcaagaactttggatttgactgtgcaacatgggagacactggcacaggaccactcagcatggtgtgcccacatcagaaaaggtgctgtactctatgagcaaagcagaattgagatagcacaaagtaaacacaggatgtgcaaatttggaatatccaccccaaatattcatatggactatctgtgcccaacctgtggtagagcattctgagctcatattggtctgatcagccacagtcggacacactgaaatttcactttatcatggtgatgtcattttggtcctctttgaagatgaaggacaacaaccaacctattat

SEQ ID NO: 2945 - DNA, 189 bp, Oryzias latipes
  source 1..189: mol_type = unassigned DNA
tgagttgatgtttttattggttttatttttttattggttttattatttttatttaatgtatcgatttttattgattttattctgttttagtttgttgttttgtttttattctgcgttgttaagcactttggtcagcttctgctgttttaaaagcgctttataaataaagttgacttgacttgacttgac

SEQ ID NO: 2946 - DNA, 37 bp, Papilio sp.
  source 1..37: mol_type = unassigned DNA
taagggataagggcaagtggatgatgatgattgtaga

SEQ ID NO: 2947 - DNA, 18 bp, Papilio sp.
  source 1..18: mol_type = unassigned DNA
tgacaatgatgatgatga

SEQ ID NO: 2948 - DNA, 29 bp, Papilio sp.
  source 1..29: mol_type = unassigned DNA
taaggagatgatgatgatgatgatgtatg

SEQ ID NO: 2949 - DNA, 128 bp, Papilio sp.
  source 1..128: mol_type = unassigned DNA
tgaaaatgtacatacatactttattaaaaaaaaaactttttatatttaactttaactatttatattgttattaataagttgtaaatattgtaaattgtcagcgaataaaggctttatctatctatcta

SEQ ID NO: 2950 - DNA, 49 bp, Parhyale hawaiensis
  source 1..49: mol_type = unassigned DNA
taacgccgcctggacctcgtccgaagtatcatcaaaggtatcaaaggta

SEQ ID NO: 2951 - DNA, 198 bp, Parhyale hawaiensis
  source 1..198: mol_type = unassigned DNA
tgatggctctgtctttgctggtgcgggtattggcagctttaaacgatctgtacacagagctattctgtgatctcggatcttcttttttttcattcttttgttttcttcacccgctgggctggttgcgtgggggtttgttaacctcatggagtttctccgttcccacgtcgccagtctggtgtgatttaataataataa

SEQ ID NO: 2952 - DNA, 96 bp, Parhyale hawaiensis
  source 1..96: mol_type = unassigned DNA
taatggcaatagctcatagagggccggggcgtaagttccggtgtctctttgggaatgggcctattggttcgtctactgccgcctatctaatctaat

SEQ ID NO: 2953 - DNA, 17 bp, Parhyale hawaiensis
  source 1..17: mol_type = unassigned DNA
taactacaacaacaaca

SEQ ID NO: 2954 - DNA, 526 bp, Pelodiscus sinensis
  source 1..526: mol_type = unassigned DNA
tagatgggattggtcctgcctagagcggagggctggacttgacgaccttctgaggtctcttccagttctatgattctatgataaggggatggttggatgaaataacatgatcttggtaactaattgaccattcatttccagttggaaataggtcaatggagggatgataggagttgctatagggaactttctgggtgtctggctggtgagtcttgcccacatgctcagggtttagctgatcgccatatttggggtcaggaaggaattttcctccagggtagattggcagaggccctggaggtttttcgccttcctctgtagcattgggcacagatcacagctgaaggactctctgcatgttggggccttcaaagtatttgaaggcttcaatatctgagacataggtgagaggattattctaagaggggtgggcgagattctgtggcctgcactgtgcagggggtcagactagatgatcataatggtcccttctgaccttaaagtctatgagtctatgagtctatga

SEQ ID NO: 2955 - DNA, 11 bp, Pelodiscus sinensis
  source 1..11: mol_type = unassigned DNA
tgatccttcgg

SEQ ID NO: 2956 - DNA, 182 bp, Pelodiscus sinensis
  source 1..182: mol_type = unassigned DNA
tgagtctgtgtgtgtgtgttcctcctctcgagatgtttttagcaggttttatgtccctctgggtctcttttggggtctcgtattttaaatttttatatatatttgtattgtgtttttaaaaattttgtaagccgcctcgaatattttaaatagagaggcggggtaaaaatattttaaataaa

SEQ ID NO: 2957 - DNA, 381 bp, Petromyzon marinus
  source 1..381: mol_type = unassigned DNA
tagctgccttataattgtacagccatttccatttcttccagtgggttgtactcgctctcgtgcagtgcaccaccgcttcccccgaaccccctgcagcataacaaaaggcggcttaacttagccccccccccccacccacgtcccttcctggctcctcccccccccccttaacctgtatataatctcgggtgtctcagagctcttcacttgatacagctattttgctgtgactgttccacctgaagacggaagcttgtgttgcctccgaaacgtcgtgatttaatttagttgttttcatttattttattttacctacgtgactttaccgaaaaaaaccaaagagtatgaatccttgcagtcacgaaagcttcaaatctagaa

SEQ ID NO: 2958 - DNA, 432 bp, Petromyzon marinus
  source 1..432: mol_type = unassigned DNA
taacctgctgtgatgtttccatccttcctgcgattttagctgactctctgagttgcattattaggttggatgtctttgtattgacgggctggatgtccttctcgctcagtcaccgatgctgcgacatactaggcaagtcaccgatgctgcggcatactaagctcgtgcattgacatgctaatctctcacaatacaatagccacttccacagcctcagggagaccatctctagccccgccctcttaccctgaggctgcacccatctcaggcctacataagaccttgtttcagtagctttctctctctcacctgaagacggtcgcttgtgttgcgatcgaaacgtcgtgatctattaattttctatctacgtgactttaccgaaagaaccaaagagtatggattcctgcagtcacgaaagcttcaaatcaagat

SEQ ID NO: 2959 - DNA, 618 bp, Petromyzon marinus
  source 1..618: mol_type = unassigned DNA
taactggctgtgatgcttccatcctacctgccgatgttagcagttatttccgactctctgagttacattaccttgttaaatgtctttacattaacaggctaaatgtctcactaacatagctgctgctcccttttcctcgatgcggcggtggcgctcgttgtttaataggctgaatgtctctcattaacacagccgctgctgcgggagccgtctcacattgacatgctaatctctaatctcgagcaatacaatggcttcttcagcaccgtagccgtggggttacattaacagattgacatgctaatctctagcaatacaatggccgaggtatacctagctctgcgatcttacatttacttgcaaattccatctctagccccgcccacttacccttgggttgtacccatctcaaacctatataacctctggctgcagtagctctctcgctatatttcttcctgcctcagcagtccgcctgctgtattttttcacctgaagacgattgcttgtgttgcgatcgaaacgtcgtgattttattttattatttttctatctacgtgactttaccgaaagacccaaagagtatgaattcctgcagtcacgaaagctttaagtcaa

SEQ ID NO: 2960 - DNA, 249 bp, Petromyzon marinus
  source 1..249: mol_type = unassigned DNA
taattattaagtaatactgtttacaattgactgtaaaatagggatgtgcaatgacaaaatgtacctttatgtgggtatgtgggtatacttgggcagtttttatatataaaatttattgattatctttttttattttatttttatttcttgttttatttatttaaatttatgaatgatgcactgactggtgagcactttaaatttcgttgtactggtgacaatgacaataaaggatctatctatctatct

SEQ ID NO: 2961 - DNA, 496 bp, Petromyzon marinus
  source 1..496: mol_type = unassigned DNA
taactgactgtgatgtttccatcctacctgcctatgtcagctgttatttccgactctctgtgtgtctttctctctctctctgtgcatctctctccgatctctactccagtgacccgggtgctgccgcggggtccactttctgccccccccccccccccccttctctctccccccctgcagccgatctctccagtgctgccgcggtggtccactttactccagtgacccgggtgctgctgcggggtccactttctgccccgcctcctcccccccccttctctcctccccccctactgccgaggcctatataacctcgtgccacggcagatctctcgcctacttcagcagttttttcttgctgtggttgtcccacctgatgacgattgcttgtgttgcgatcgaaacgtcgtgatctattatttttctacctacgtgactttaccgaaagaaccaaagagtatggattcctgcagtcacgaaagcttcaaatcaagat

SEQ ID NO: 2962 - DNA, 60 bp, Petromyzon marinus
  source 1..60: mol_type = unassigned DNA
tgacgatcattaagaaaaaataaaaactgttgcttttcacaatgccatacgaaagaagaa

SEQ ID NO: 2963 - DNA, 404 bp, Petromyzon marinus
  source 1..404: mol_type = unassigned DNA
taaactaattttcaatggtacagtatattttttcaagtagtggtatcccaaactttcacagcagcttatttcccttcacaccaacattatgtaaactcccccccccccccccccgcgccggtccatcatgtacctcctacgtacatcatgctcatttttatgctaattcctttgtcaaggcgtttttgtttcctcccacacagcttaaaggacgcgacctgggcttggctgtcttcactccaacgctgtcctctggacagtccggtcccttcacctgatgaaggccacttgtgttgtggccgaaacgtcgtgatttttgttgttttattttttacctacgtgactttaccgaatagaaccaaagagtatggatccttgcagtcacgaaagcttcaaatctagaa

SEQ ID NO: 2964 - DNA, 778 bp, Petromyzon marinus
  source 1..778: mol_type = unassigned DNA
tgacttgatttgtgttttcttgtcaacctccaccgtcagcagtgtgggtgtgtggagcgaggtgcaaatgattgcctggcggccctttgattggtgtagacccactgcgttggcgttgttttctcctacattaacattagctgccccgcccatgctgctgacacacttgggctacgcccatctctaaacctttataaacagtttgcctttagaggctaaccccccttttcctgatgacgaccgcttgtgttgcgatcgaaacgtcgtggtttttgtttttattatatttaattactgaaagaaccaagaataagtctacattatagactgccagtacgctcactcagtttaataaccattgctacagtctacatcatagactgccagtacactcaccagcttaaaaaccaggctacagtctacattatagactgccagtacactcaccaaggttaataaccaggctacagtctacattatagactgccagtacgctcaccgaggttaagaaccaggctacagtctacattatagactgccagtacactcacccagcttaataaccattgctacagtctacattatagactgccagtacactcaccaaacttaataaccaggctacagtctacattatagactgccagtacactcactccgattaagaaccaggctacagtctacattagtggtttttttgtttttatttttatttttattcactttattttttattattatttttctatctacgtgactttaccgaaagaaccaaaga

SEQ ID NO: 2965 - DNA, 916 bp, unidentified
  source 1..916: mol_type = unassigned DNA; note = Description of Unknown:Phanerochaete chrysosporium sequence
taatgcgattcgataactgctggccgcaatggtcagaggatatttacttagcggcatacactttggttcaaacccaaaacccctaacctaagccctaagcctaaatattcattagcgtctccctcacaggcctaaaccccctggagcggagttgtacccgttgaacggtacagccagcagttatagagtattttgttgtacagcgtcattatttaatggatgcagtgagcgcccgccttcgtggcgtgggcgcttcggtgatcgccgtgatggccgcgcacgtgtcccacgtgttcgtctcgtggctgctaatagcgtctgtgatcatgtgatcttcgacccagggctgcggttaactctggattcgatgcgcatgttaatagccggcccgaatccgggtcggctccgaactgactccgctaggttcgggagactttcgccggggtggctgcgtgccggacttcgtccgggcactttgtggcgttgatccgatcagatcgagatctcgagacttcgaaaggtgacttttcggtagtccgctgcccgctggggtgttgttggccccttccgcatgacctgtacattcaaaaccttcatactttcgccgagaaagagtcccttaaggggatttgttgctcccgacctcggggagacgtttctccgcgccaatcgcattacagccgatgagagacatttcgcctctcgtcggcccgccagtcccttcgggcctggcggttgcaaggggtatatatcccagtaggaaaccgctgatgagtcttcacgacgaaagctcagcgcgacacaacagtgtcggctgccttcggttttcctgtgaagcattccgcgctcgccgctcgctacgctcgcgtctcgcgccccccaaaccctaaaccctaaaccctaaaccctaataccc

SEQ ID NO: 2966 - DNA, 439 bp, Rhodnius prolixus
  source 1..439: mol_type = unassigned DNA
taggatgcagctaaactccatagttgcgattttagttcttaattactcacacaagtactatcataactacactactaattacaccactctaagctcacatcaaataacgaagtcacattcagagaccattgtgttgttctaggaaggaatgtcagtacgcagcgctcaagatatccttatctcatggaagccacgacgcagaatgtagtagaagagtggctggcatgacgaagaaagaagggaaagaggctgcgctattcctcaaattgaatattggaaaagatagggctggtttttttccaccaacatattggtaaattgaggcgctgggagccaactgtaattgttcatgccaatatgttggttttttccagccctcatataaagtaattggttaatgtgcaaacaagaccactataacaataaataaataaataaa

SEQ ID NO: 2967 - DNA, 48 bp, Rhodnius prolixus
  source 1..48: mol_type = unassigned DNA
tagtttatgtttactaaaatttacttatttattaaaatatataatata

SEQ ID NO: 2968 - DNA, 118 bp, Saccoglossus kowalevskii
  source 1..118: mol_type = unassigned DNA
tagtactgtaagtttttgttgttctgaatgttttgttttgttattgttatttttggactttactcaagatttcattggtacgttccaaataaaaaattctatctatctatctatctat

SEQ ID NO: 2969 - DNA, 165 bp, Saccoglossus kowalevskii
  source 1..165: mol_type = unassigned DNA
taatagttgttagtgttatctgttttaacattttattgtattttttatatctgtatttcttgttattgtgttgttgttgtttttgattattgaccatggttaatgtattcccaattcattaatttgagtcaaataaaatatactatactatactatactatacta

SEQ ID NO: 2970 - DNA, 61 bp, Saccoglossus kowalevskii
  source 1..61: mol_type = unassigned DNA
tgaatccggccaccctcgtcttcggggaccaaaccggatttaaaactctggactactacat

SEQ ID NO: 2971 - DNA, 157 bp, Saccoglossus kowalevskii
  source 1..157: mol_type = unassigned DNA
taattgtaatacgtattttatatataccctttgatttgtttgtaattttgaaacttttgttgtttttgtttatttgtgtttgttttttctgatctgtatccttaccatacagcacccactgatggtgcagttgtgtaataaagttattattattatt

SEQ ID NO: 2972 - DNA, 318 bp, Saccoglossus kowalevskii
  source 1..318: mol_type = unassigned DNA
tagcaactccatcaaattagtctgcaggtagttttaatgcaatggcatatttagtagcttagtagttttattgttatactaattttcatgtattttttcctccattcttagttacatgtattcaatgttttattcgtgattctggtggattgaactgtacttccgtcttgctttgtactaaacaataacattagcttatgtttaatgtgctatttgtgatattagttgtgtgaagtattatttctgttcttgttttacaaccataaaattactctctgtagtagattttcgtgttgaataaaattattattattatta

SEQ ID NO: 2973 - DNA, 207 bp, Saccoglossus kowalevskii
  source 1..207: mol_type = unassigned DNA
taattaatataacttattaagataccttttctgttttgttttttctaaccatttcttgttcttcgtttttatttgattttattatgttttcactwtgtcttcatttgtatttttcgtcttgccattctatatgtatttgaaactttattgtatttkaaaaatccagatcctgaacaggatatgatttcaataaaggcattacttact

SEQ ID NO: 2974 - DNA, 169 bp, Saccoglossus kowalevskii
  source 1..169: mol_type = unassigned DNA
tgaatttaatgaactacacgattgtattgttgatatattatttcaagctctctttcataacctttatttgtgaatgtaatcgttattatttaaggtgacttataagtccactgggctgggcagttctctgagctgcaggtcactataataaattacttacttacttact

SEQ ID NO: 2975 - DNA, 334 bp, Salmo salar
  source 1..334: mol_type = unassigned DNA
tgatgtattgttgtctctaccttcttgccctttgtgctgttgtctgtgcccaataatgtttgtaccatgttttgtgctgctaccatgttgttgttatgttgtgttgctaccatgctgtgttgtcatgtgttgctgccttgctatgtgttgtcttaggtctcttatgtgtgttgctctcttgttgtgatgtgtgttttgtcctatatttatattgtattcattttttaatcccagcccccgtcccgcaggaggccttttgccttttggtaggccgtcattgtaaataagactttgttcttaactgacttgcctagttaaataaaggttaaataaa

SEQ ID NO: 2976 - DNA, 427 bp, Salmo salar
  source 1..427: mol_type = unassigned DNA
taataacaagataaacaatgtaaaacatacggggtctgtaaaatgtatataggttcagaacttttgtgaaatagcacagttacaaatagaaatcaaactggatggacatcagaaatagaggaaggactaaaaacaaacaaaaaataactattgtaaaatagactgtgtctgtaaaatgtgtataagatgaataaactgaaggtaaaagccgaagtgtttattagtttactccaattgggggatcggtggtagggtttgcggggaataataataaaggtatattctttaaaaaagtatgtatgtctatataggtatgtgtatgtatatatgtgtatatgtatgcatgcgtgtatggatatatatatttaccccaaaaatatatgggggattggaaatgatgcagacaattacattgatggaagcaata

SEQ ID NO: 2977 - DNA, 186 bp, Salmo salar
  source 1..186: mol_type = unassigned DNA
tgagagatagaatgatggtcaaagataaaagtaaaaatttaaaaaagtaaaaaaaacataataaaaagtacatttgaatgacactaagtggcagtgtttttacaactaatgccggtttgcctgaggctgatgccgtgccggtgtttgtacacgtgcatatacacacactctcattcaaataaacac

SEQ ID NO: 2978 - DNA, 338 bp, Salmo salar
  source 1..338: mol_type = unassigned DNA
tgaatttgcactttttaacgcactctcaattgtmatatggtaatctacctttgggcagcatgtgctggccccgccacccgagcagttgggaggggaatagggtggaataagggggggataaaggggggtataagtgggggggttacatcgacccttttttctttctacctgtccttgttctgtatgtcttgttttgtaatatttgttttgtgcccagaactctgggtcttttggttaatgtctgttctcttatgtttagataagaactgtaaacttgtcttttatacctatacaccattcttgtgtatgtgttcaataaaaaatatttgaacaaaaaa

SEQ ID NO: 2979 - DNA, 349 bp, Salmo salar
  source 1..349: mol_type = unassigned DNA
tagctgtgtattgccgctttccatgttgtctgttgtctgtagcttgtgaggtgtggaaacactttgttgtttttatggattttgtcttgttgctttttgttctatgttgctctgtctgtatgctacatcttgcttgtcctatgttgctctgtctgtatgctatgtcttgcttgtcctatgttactctgcgtgtgctcactgttcaatgattgtctatattgtaattgtttttaataacctgcccagggactgcggttgaaaattagccggctggctaaaaccggcacttttactgaaacgttgattaatgtgcactgtccctgtaaaaataaaataaactcaaactcaa

SEQ ID NO: 2980 - DNA, 374 bp, Salmo salar
  source 1..374: mol_type = unassigned DNA
tagccggctaccacccggttactcaaccctgcaccttagaggctgctgccctatatacatagactggaatcactggccactttaataatggaacactagtcactttaataatgtttacatactgctttactcatctcatatgtatatactgtattctattctactgtattttagtcaatgccactccgacattgctcgtcctaatatttatatatttcttaattccattcttttacttttagatttgtgtgtattgttgtgaattgttagatactactgcactgttggagctaggaacacaagcatttcgctacacccgcaataacatctgctaaatatgtgtatgtgaccaataaaatttgatttgatttgag

SEQ ID NO: 2981 - DNA, 250 bp, Salmo salar
  source 1..250: mol_type = unassigned DNA
tagtcactttaaccatacctacatgtacatactacctcaatcagcctgactaaccggtgtctgtatatagcctcgctactcttattttcaatgtctttttactgttgttttatttctttacttacctattattacacacatacttacctttttttccgcactattggttagagcctgtaagtaagcatttcactgtaaggtctacacctgttgtattcggcgcacgtgacaaataaactttgatttgatt

SEQ ID NO: 2982 - DNA, 209 bp, Salmo salar
  source 1..209: mol_type = unassigned DNA
tgacctagatagtttgtgtgtatgcattgatatgtaggctacgtgtgcctttttaaaaatgtatgtagttcgtcgagctgttcttgtctawtgatgttctgtattatgtcattctgtattatgtttcatgttttgtgtggaccccaggaagagtagctgctgcttttgcaacagctaatggggatcctaataaaataccaaataccaaa

SEQ ID NO: 2983 - DNA, 356 bp, Salmo salar
  source 1..356: mol_type = unassigned DNA
tagtcaaatggctacccagactatttgcattgcccccctcctccacaccactgccactctctgttgtcatctatgcatagtcactttaattaactctacctacatgtacatactacctcaactaaccggtgcccccgcacattgactctgtaccggcacccccctgtatatagtctcgctattgttattttactgctgctctttaattacttgttacttttatctcttattcttatccgtatttttttaaactgcactgttggttaggggctcgtaagtaagcatttcactgtaaggtctacacctgttgtattcggcgcatgtgactaatacaatttgatttttgatttgatttg

SEQ ID NO: 2984 - DNA, 149 bp, Salmo salar
  source 1..149: mol_type = unassigned DNA
taggctggatcatgttgttgtattgtattgttgtatgttttaattatgtaatgtattgattgttgctgccttcttggccaggtctcccttgaaaaagagactctgggtctcaatgggcttttcctggttaaataaaggttaaataaaaa

SEQ ID NO: 2985 - DNA, 683 bp, Schmidtea mediterranea
  source 1..683: mol_type = unassigned DNA
  misc_difference 366: note = a, c, t, g, unknown or other
  misc_difference 525: note = a, c, t, g, unknown or other
taactctgatacttttacttaaagattaaaacaattttatagcaaaaaaggaaaaccttcaggaatgaaaatcagagtagaattgtatttaggtcttgaagttgtttgtggagggttgtttgaaggcttttttgttgcgtttttaagaggaaagctttttcatatacatctttcataagactttaaaaactcaggaactatttattaatttgctctgaattttataaaaaactttctttagttttaattttattaagaaatttgaaagacaaaaaaaaatgacgttagaagcagttatttaacataagatatagaaaacattttaaaattttaaagttttatataaaaaaattaaagtttataaanattaaattaataaatgttaaattaaacaaaaaagagaggaaaaaaatttattttaaaaattttaaattgtatattttataaaagatatttaaatttttaaaattttaggtttaaaatgttttaaaattaaatttaaaccaatcaaaaagcaaaaaagtnaattttaatgaaaatcagaaggtatttcggcatttttctcattgtatatagtagttccgaaagaaactgaagaggattatttaataatcgaaacttttttcaaaaatataattattacttcgcagcaagggcttattttgttaaataataataataat

SEQ ID NO: 2986 - DNA, 78 bp, Setaria italica
  source 1..78: mol_type = unassigned DNA
tgatttgtggctcttgttgggtttcaactctagcctaccccaacttgcttgggactgaaaggctatgttgttgttgtt

SEQ ID NO: 2987 - DNA, 277 bp, Solenopsis invicta
  source 1..277: mol_type = unassigned DNA
taggccctcaagccctgccgggggcgcccatcgctagggcgcccctggcgagccgagtcggccgccaaggccgaccgggtccggggggctccggaagtatgctgcacgcgttcccggagccccccagtcatggaccagggcaggacacccggagaggttttagtgggtaggccctcgccggcacgtcgccggcgggggagagccccacataaccaccaggcctcccccggggcctggggtatgcggtaacgcatttcctctccgtgaacaaaaaaaa

SEQ ID NO: 2988 - DNA, 306 bp, Strongylocentrotus purpuratus
  source 1..306: mol_type = unassigned DNA
tgaagtggccggagtggcaatgcctaaatcgaatgcggacgagaatggggcggtgtaaggtcaatatggcaagatggggctatgcccatgaaggagatactctctgcgactgcggagagactcagacgatggaccacctcttgcagtgcggcggaacgggttgcacagatgaagacctgtcccttgttaatgaaacggccattgcagcaatcgagcgatggaagaacttaatttaatttaatttacttctaagttaaggaactttacattactatcttgatctaaggagacacgaacgaacgaacg

SEQ ID NO: 2989 - DNA, 660 bp, Strongylocentrotus purpuratus
  source 1..660: mol_type = unassigned DNA
tgattgtatttaatatactctgaaacaaattaaattgtcaaattacaatttcatattccttagtatataattaattcataaatttgaggtctgattttttaccaagttagtcaatgtattttttatgacatgaagaatgcgatgcatatctatatttatattttaatatctctaatgttcgccttataatattcatatttgtcttgcaatgtatctttgtattttatcagcatgtacataattgttttccctctctgtccatctgtcccctttctcccccctctctctctctctctctctctctctcttctctctctctctcttttctctctttctttctctctctcctgctttcccatctctctttcttttttaactcaaatttttaaattgaaatattgtataagattaatggtatatagtatatacacgctcttcataattatgtagattgtagtgtgacatcttgaaatgtatacttgcttttttccagcaatttactcatgtgcaattcagttactttttactgtgatatctcttgaaatgtataattgtcttcaccatcaatgttttattcatgcgcaattcagttacttgtaactgcgatacatggaaatgaatcaataaataccatttatctatctatctatctatctatca

SEQ ID NO: 2990 - DNA, 48 bp, Strongylocentrotus purpuratus
  source 1..48: mol_type = unassigned DNA
aaatgaaggcggtcattgtcgcttcgcgacagacagctactactacta

SEQ ID NO: 2991 - DNA, 395 bp, Strongylocentrotus purpuratus
  source 1..395: mol_type = unassigned DNA
tagtataacaaaaccgtgacttatttattctttatcatgcaactgcttactgcacctgcacttgcaccgcaccctcttgatcactcagtttttcgaagagagttatgtcgccaattctttttacgaggccgccatccatctccagcctaaccgctcacgatggtggtctcctgcgttctaaattacctctctaatttattgaaaatatttcatattatgttattgtatgcttcgtacatgtttatcgtatgatataattgtacatgattttttatttaattacttttgtaaacattttattcattgtatttgttattgttcgaatttttgtactttgaatttgaatttgtatatttttgaacgcagaaataaaatcaatcaaacaaacaaacaaa

SEQ ID NO: 2992 - DNA, 170 bp, Strongylocentrotus purpuratus
  source 1..170: mol_type = unassigned DNA
taaattccggcaacgttttttttttactggcactatgtatatatacacctctcacctgcacacctggacatccccatgtcgccacacacatgcactcgcacacatctgcaagaatcttcagcagtgaaggaggcagattattttgaagaagaagaagaagaagaaatata

SEQ ID NO: 2993 - DNA, 42 bp, Strongylocentrotus purpuratus
  source 1..42: mol_type = unassigned DNA
tagatgatgtactccctgatattctttgcacgaacgaacgaa

SEQ ID NO: 2994 - DNA, 141 bp, Strongylocentrotus purpuratus
  source 1..141: mol_type = unassigned DNA
tagaatacccgacgcagaactgagccagacacttaccaagaagacacccaactacgagaaggaagaaaatgaaattgaactggaagcccgactgctgagaacacagcattcttccagaatctcgggtaaaggtaaaggtaa

SEQ ID NO: 2995 - DNA, 585 bp, Strongylocentrotus purpuratus
  source 1..585: mol_type = unassigned DNA
tacagtctttctttaggtcaagtatagttttgatggtttgtttgttcttttgttcattttttttttttttgttagtatactttttgttttgtttgtcttattacattatattccattatgtttttgtttgtccaatggacgattatggcgtattttgttagtctgcatatatcttaacaatccaatcacaactcacttacatgtacaaaaatgaaacttataatttcttttttagttaagacaataatgtatttaaaaaaaaaaaattgtaaaattattttttgtttttatctttctttttcttcgtgtttgtatttagattgttcatgtggtattttccacttttcatgtatgcttgccatattgtataatattgtatttatgtttagcataggctaggtttagatcattcctatttatcgttatacttttatattgttgttttgttgtattctgtattctttgtattattaagctatgtttgtattctttattatgtatcattatcatgacatgtacatgtgttgtactctcataccccagaagggggtcgaatgagtcaataaattctattctattctattc

SEQ ID NO: 2996 - DNA, 1033 bp, Strongylocentrotus purpuratus
  source 1..1033: mol_type = unassigned DNA
tgaactttgtataaactctaatagaaggggcaaacagactttagtatgactgattttaaatgatatttgcatgtttttaattactcactttgaaattaaaataatgttttttaaaacatatagtttgggattattactattgcctatttccaatgcatgaaaccttcgggcgtagacgcggaggagtggtctattgttagtgaggaggatgtctgttgttgttttctttgttcatcccctcacttcaatagataacctaccgtgcctgcgcctgccaacatggttatgttttaggatcttgtttattacatcccagcctttttaaatagatttaattcaccttagctaaactggatcatgtttttttttactctttactaattaactggataaatcactcgagcattataatacatgtaccatatttaaagcatgacctatagtatttattcattcacaaaaaatgtgatttcatagaaaattgaacgattaatgctaaacatagatttatatttttgtaattttccacacgcaacactactattttcagagttgaaatgttctaaaccagttaattgccatgtacagtattacgcatgtatttcttgttaagtatgtaatgttttaatcatgtaaaagttatcattttcttatactccctccccctttctttctctcctccgccatacctgtccttttgtattcattatttcactgtgaattgtgctgtatattgtatgcatgggtgttgatccgttgcgtcgtgctattcatcaggggggtatatgatcttactgtttcgtgccccactggtgactggggtggcgcagcggttcgacgccggtgccaagagttgcattattatctatagtagtttattattagtaagtgcaattttaccttgtaataattaattctgtaatccattgcgcaatttagtttttagctacgaagcatggaattaatgaacatttattgtttacatgtttgatttgatttgaataaaccatttatctatctatctatctatcta

SEQ ID NO: 2997 - DNA, 121 bp, Tetraodon nigroviridis
  source 1..121: mol_type = unassigned DNA
tgatgaagccttttggatagaaggcgaaacgttttccaaaaagaaaattgaaaagtccagatgaacacagaatcttttctcggataactatgacctggatgactgagaacctacacagaca

SEQ ID NO: 2998 - DNA, 120 bp, Tribolium castaneum
  source 1..120: mol_type = unassigned DNA
cttatgtcttaaaattatttttatgttattgttatttctgtgtataatactgacgtttttcgtatcaattttgttactacatctgtataaattgatagaaataaattattattattatta

SEQ ID NO: 2999 - DNA, 275 bp, unidentified
  source 1..275: mol_type = unassigned DNA; note = Description of Unknown:Trypanosoma brucei sequence
taataaacgaataacaaaaatcaaaacaaaaggattgctaattgacatcttttggagagtccggggtggggggcttctcgccccatctgctgtattccgttcaactgcggagctacaacaaaaattatagagggtgtgttaggctgaataaaaaagggagactctgccacagtcgccagaccgatagcatctcagggctctacggtgatggctgatggccgcgccagtggggggaaactctcacgaaggcacgaagaaaattccaaaaaaaaaaa

SEQ ID NO: 3000 - DNA, 399 bp, Xenopus laevis
  source 1..399: mol_type = unassigned DNA
tgaccttactatataccacaacgttacacacccttgtataaataaatagccattggatacaattgttctctatgagcacatctgcactttatcatgttctttatcatgttcttactactatcatatcacaatgatacacccatcatgtctgacgtttagcattatttacttaacatattacatctgctgagtgtgcactgtcttgtcctgtccctgcactgtgctgtcctgtcttgcaggagttgcatatttttgcacttgcactttttgtctgttgtccggtacatctatgttgtgtgtagcaccatggtcctagaggaacgttgtttcgtttcactgtgtactgtacaaacgtatatggatgaaatgacaataaactcactcttgactcttgacttg

SEQ ID NO: 3001 - DNA, 330 bp, Xenopus laevis
  source 1..330: mol_type = unassigned DNA
tgaactggcacttatataacagtgtaacaaactgtaacccacagcaccttaatacccctctgaattgtgtctgtatgttaccctcccatttagactgtaagccctacggggtagggtcctctagccttttgtttccttgacactgagcacttaatctgtattgtaattatattttatatttatgtgaattgtatttctaataatgcacttattgttactttttattccaatgaccccttgtttgttactactaatttattgttttgctgtacagtgctttgccctcaaggagcgctatacaaataaaaatatacatacatacatacatac

SEQ ID NO: 3002 - DNA, 309 bp, Xenopus tropicalis
  source 1..309: mol_type = unassigned DNA
taacaccttcatcaatgagaatcttggtaccattgtgattggatcataccttcttacacctgtcagtttcagctaacacctaactgaacaagttcaatggaaccattgtgattggatgtctgtgactctactaccatcaagagtttaaataccggggaattccctaccagtcatttgaactgaagaagccactcggatgagtggtgaaacgttttcaagaaaaactcagaaaagtccagttgttttagacttaattctactagatactgtatatcatgacctggatgaatgagaatcttcatagacata

SEQ ID NO: 3003 - DNA, 263 bp, Xenopus tropicalis
  source 1..263: mol_type = unassigned DNA
taacacctgctttgaagagttgcatgatacttgggtaatcctttcaaagtaactccacagcattcacacctctgtgagtttcagatgtcacctttctgaagagttacatagtgccattgtgattggattagtggaagagtatatatgctgaggacttcccataccagtcagttgaactgaagaagctgctcggatgagtagtgaaacgtcttcaatgattactaaacaagtccagttgctttaaatttatttatactagatat

SEQ ID NO: 3004 - DNA, 317 bp, Xenopus tropicalis
  source 1..317: mol_type = unassigned DNA
taaaacattattttgcctagtcctgcgcttaagggcaaatgcccatacctggtgcactcttaccttccaatttgtgcctgtatgttacccaaccacttagattgtaagctctacggggcagggacctccttcctactgtgtctcataccacatggcacttattccctgtgcatttatatatatttattgtatttatttattataacacttgtcctccctgtgtgtaattttgtattttgtaagattgtacagcgctgcgtacccttgtggcgctttataaataaagttatacatacatacatacatacatacataca

SEQ ID NO: 3005 - DNA, 148 bp, Zea mays
  source 1..148: mol_type = unassigned DNA
tagagtttttatagatgagtcagtctatgctagtttcgttcaggccgccgtaaggcgtcagttgtaccccggtctattttagaccttgtttatttcttcttttaatataatgatacgcagctctcctgcgtgttcgagaaaaaaaaaa

SEQ ID NO: 3006 - DNA, 153 bp, Zea mays
  source 1..153: mol_type = unassigned DNA
tgattaggccttttcccttttagtgctctcaaaagcttttcccctcccctttctctctctttctctttttggtgacatcttgttgggtttcaactctagcctaccccaacttgcttgggactaaaaggctatgttgatgttgatgttgatgtt

SEQ ID NO: 3007 - DNA, 166 bp, Zea mays
  source 1..166: mol_type = unassigned DNA
  misc_difference 41: note = a, c, t, g, unknown or other
tagctagcattgtggtaattcgtgttagtttcttctttagncatggatgggtttctgtatgcctgttactggccgccgtaggcgcctcttttgttttcttctgtaactgtccttcttctttaatataatatcgcgcagttctcctgcgctttcgagaaaaaaaaaa

SEQ ID NO: 3008 - DNA, 3999 bp, Zea mays
  source 1..3999: mol_type = unassigned DNA
tgatgataggcctcatttggaattgtcagggtttagggaatagttctaaggttcagtttctgaaagaactcattagagatgagaaagttgactttattggtttgcaagaaacccaaaaaagtcattttagtgattcttggttgacttcgctggctggtagtaaaccttttgcctggttttctgccccgcctaatggtagatctggtggtttattggtgggttttaatactgatgtgtttgatgtgagagaaaatgaaattggtgaatttatgattcgcaccttgatttttcatagagaaaaaaatctcatctggaactttgttaatgtgtatggtgctgctcagaaggagaacaaatgcagattcttgagtgagctttcgtctttttgctcgagaagtcgtgctcctttgcttgttggtggtgattttaatattattagaaaagcagargagaaaaacaagcctggtggtgttaataagtggagcttcctttttaacagtatcattgagcaaaatgggcttgtggagtttgacttgaacaatagattgttcacttggtctaataatcggattgaccctacttttgaaaagttggatagatttctggctagtcctgagtgggatcttgcttataataatatcaatgttcgtggtttgaatagatccttttctgatcatgttcctttatgcattcaaacggatgttatccctactggcagtagagttttcaaatatgagttatgttggaaggttagaccagattttcacaaaaaagtgatagacaattggtctattcctgtgaaggctaaaggtagtattgacatttggaaaacgaaaattaaacgtttgaaacaaatgctcaaaggttggaatattaatgttgaagggcattacaaaaaatgaaaaaagaattgttggcaaaaattgacatctttgacaaaatcagtgaagtggttggtctttcagaaaatgacaggatggagaaacttgacctggaattgactctcaaaaaattagttgatgaggagggaattaagctcaaacagagagctcgtgataaattcattttggatggcgatgagaattctaaatattttcatcttttagccaagtgtaagagaaggaagcttaaaattgtgactcttactcatgaagacaaagttgctcaagatgatgatgaaattaatcatttggcgacttctttttaccaaaatctgtttggtccttctcaagaatctagtatttctttgaatcatttgaatatgaaaatgttggatgatactgacagagattgcctgaccagaccgtttgacatggaggaaattagagaagtggtgttttctatgaaacataatagagctcctggtcctgatagcatcccagctgaattttttcaggagttttgggacacgattaaaaatgatctgtttaacctctttcaagattttcatgatggcactcttaacattgagagacttaattttggaatggtgactcttattcccaaagttcctaatgctattgacattaaagctttcagacctatttgcttgcttaatgtgtgttacaagattattaccaaagttttgaccaacagattggccagttgtatcaataatgtgattagtgattttcagtatggttttatcaaaggtaaatacatcatggatggagtggtctctctccatgagattattcatgaggtgaaaaagaagaagcagagtggggtgatttttaaggtggattttgagaaagcttatgacaaggttaattggaactttcttcatcatatgatgattaaaaaaggttttggtgacaaatggtgtgactgggttatgagaactgttagaggtggtaaagtggccatcaagacaaatgacagggttggtccctattttaccactcacaaaggtgtcagacaaggtgatcctttctccccctgctttttaatattgctgctgatgggcttgcttgtatgattcaaaaagccaaagatgaaggtattattaggggactcattcctcatatcatccctaatggttgttgttgtttgcaatatgctgatgataccatttttttgcttcaagatgatctggagggagccagaaatcttaagtttattctttgcttatttgaacagatgtctggtctcaaaatcaattttcataaaagtgaaattttctgtttaggtgaagctgttgataaggaaatgtggtatgctgacatttttacctgcccttataattgtcttcctatgaaatatttgggggttccgattgatgacaaaaaactttgcaagtccttgtggttacccacagtagagaaagttgaaaaatgggttcttggcaaggaaaattccttagtttgggtggtcggttagtcttgattaatagcagtcttaccaatgtccctttatacatgctctcgatgtataaagctcccaagaatattttgaagaaaatggatctctttagaaaaaggcttttgtggcaaggtggccatactacaaaaaaatatcatttggctgattggaatatggtttgttctccgagaggtcagggtggccttggggtcttggatctgcacaagatgaatgaggcgcttcttgctaaatggatttggaagttggaaaatacgaatgggctwtggcagaccattatcagacataaatatgttaaaggaaggcctattatttcattaaaaaaagacaaagtgattctcacttttggaaaggtattctggatgctcgggacaatttttacaaatattgtaaaaaaaggtaggcaatggcaataataccagcttttggcacaatatttggtgtgatttagaacctctgtcttctaaatatcctagtttgtttgatattgcttatgataaagatatcacagtggaaaaagccttttcttctgattttagagctgtgaattttagaagaaggatttatggtgctttggaagatgattataataaccttattacacagtgtaataatattactatttctgaggaggatgataaatcagtttggcttctgggtaataaaggtttttctgttaattctttttacaaagaaatcaaatgtgctcagattcctttgccttctagtttcttgtggaagactagactcccacataaaatcaaagcttttttgtggcttgttatgcataaaaagattttaaccaaggataatttgttcaaaaaaaattggaagggcaatctggattgtactttttgtggattttcagaatccatagatcatttgtttttcagtgctcggttgctagatttacttggagaatagtctactcggctcttggcttaatttctattcccaacagtgtggatgatctgtttggctcttggattaatagttttaacaaaactgaaaagaatctggtcctttttggttgtggagctgtcatttgggcgatctggcgatgtcgcaatgattgttgctttggaactgacagaattgatgatccgactaatgtgattttctcttgttgctattggcttgatacttgggctatccgtcagaaaaagaaggaaagaaaattggtggaacaaggaagcctcaaaatcagaaggatggcgtgtgagatctacaacaagactcgtggttggaagccagtcgacagacggatccaatgaagattctgctgtgtttggctattttggttcatcaactttgtgtttgctgtaatcccccctcgcctcggtagcttcaggctactgaaaactttgggctatatcggggytgaagttgtttagtttcgtgctactctagtttgatctttgcgatctttgtttttggtcagctatgtgctgattctgtgctgcttctggtagtttggttcgttcaggtttagttccgtcgtagctgatagttgtgtgtcttgtcggcttttaaattctggttggctctatggtcttgtaagaacttgtgtctctttctatttcgtaatgaaatagggggttatcccctctgtcaaaaaaa

SEQ ID NO: 3009 - protein, 908 aa, synthetic construct
  source 1..908: note = Description of Artificial Sequence: Synthetic polypeptide
MPNLKTLTKELRQEIVSYLYPLPSISSNLAFRLAIHIFTKTRFSSHINFISRCLQHKVIPKGFRSNFHASIFSNVSNFNLKYLHEIQRTQNTFSHNIMRSTIRAMCSKRNELNKQIIECRSQLSNVCPSVLLRSIHAKIQALNSKLFHHLEQTKKHKLENLTNSPKNRTEPLENQNHHTVVTIPENLPLSNAEKSVLSKGLNFVPISKKSDEFTTRQDVEKFLRRVQLKAFFHNKEDKSDNTEKDAFETLTAKKSKWTPPEGQFASIDYFIKKCRHDVHKLKSNCNTKLSNLSKEEWTALINLKNRKDLVIKAADKGGATVVWRTDLYQQEAIRQLSDPTFYTKVNKDLTPANQKIVKDTIQELIRKQELPVTAQNLIITTPRTSCIYFKPKIHKPNNPGRPIVSACSCPTELISSYLDKVMTPIVKSLPSYIKDSNHALETFGNFNFSGENKIIFTMDITSLYTVIPNNEGLQALKYFFNQRPIKKPSSETLLRLAELVLTLNCFSFGDNYYKQINGVAMGTKMGPSYANLFVGFIENKFFSNYHGPKPDLYKRYIDDCVGATSSTKEELNLFINSVNSFHPALKYTWEISENSLAFLDIKLSINGNGLSTSVHYKPTDSHNYLLHSSSHPQHVKNAIPFSQFLRLRRLCSDDTDFNNKCEEMCQFFKKRGYPDSAVTTGKHRAQEIDRETALQTSQNEETDRIPFTLTYHPQNLAIKNVILKNFKILSNDPETKHIFSLPPLISFKRDKNLGNFLVRSAFKFNNKPGTFTCKRTRCKTCPFISNTVNISGPNRSVKVTDHFTCISSNVIYCITCTLCKKIYIGETGRRLADRFREHLRDAEQNNTDASKPVARHFNLPNHSHHNMTICGLYLHHGNTESRKNLEQKLIFQLGTLSPHGINERLSFH

SEQ ID NO: 3010 - protein, 690 aa, synthetic construct
  source 1..690: note = Description of Artificial Sequence: Synthetic polypeptide
MRLAEYFFDENSNNRTANEHDTPFHNKSTWNPPNDRERALNTFLDAVKLDITTTKPKPTQDNLTVTERQAIGQLKQRQDIIIKPADKGSGTVVMDKTWYIDECNRQLTDTKFYQRLDEDITADIQKRVTFYVNRMHKDKLINDKTKQYLIQSDVKPGRFYILPKVHKPGNPGRPIVSSNSHPTERLSHFVDYHLQPLVHKLPSFVKDTNDFLNKLLTIGNLPANSLLVTLDVSSLYTNIPHNEGINACERFLRTSSHKTIPTSTLCDLIRMILTMNNFSFNDNHYLQIHGTAMGTKMAPSYANLFLGFFEANALKNAPFQPHTWLRYIDDIFMIWTEGLDNLKIFIDYLNNIHSTIKFTSSHSSTNIPFLDVNVSLTNDGNISTDLYTKPTDKHQHLLYSSCHPLHTKKAIPFSLALRLRRICSTDATFHTRTAQLATYLLKRGYNRNFVNKQIRRAADIPRQLTLQTKDINKPKRIPFITTFNPSLPHISHIIKKHFNLLLSSNRCKSVFQHPPVVAFRRSPNLRDLLVTAKLSPNSTNPQLPCGSFRCGKNCATCPYISHGLTTYTFFSTGETRPIKFNFTCETKNLIYMIQCNRCNLQYIGETKRRLKDRFNEHRRTIDNPNNKSKPTTAAEHFLSSPNHTANDMILIPIEKIFSNRDSIRKAREAFLIQKGRTIDPDGLNIREETY

SEQ ID NO: 3011 - protein, 795 aa, synthetic construct
  source 1..795: note = Description of Artificial Sequence: Synthetic polypeptide
MTPGFKPFTILRSLGRQSERLANNYISYASNVRRIRQQLWFNHRCKDLRLVPSGLRLKSPLNTQEAIQIVKATCRRLIRARINDCHRRLNHYNNRLQQRLDKLKQLIPTNLLDVIRDIADQRAKKTTEQYRIKTELKLTRLQRTKNKKRHKTDENWVRNISSRPLDKTETQVLSYGLKHSVTPKRIPTETIVSSVEAVLSRQRDLSEPTKDNIRSRIASTIQSASLTDNNLTKDERQALKRLRNDNDILILPADKGRVTVVMDKTDYHDKMDELVNDKQTYEVLKRDPTPALQRKLNSKLLQLKKADAIDIRRYNRLRCPVPQPAKLYGLPKLHKPNVPMRPIVSFCGSPTYELSKYLTTILKPLTDESRHKLQSTETFIDAIKTAQVPDDHKLVSFDVKSLFTSIPLQLALDCTETAINNSTLQLPLLTNDLMDLLNLCLTSTYFQYNGQHYKQLHGTAMGSPVSVVVAEIVMQNIEEQALASYKRTIPLWLRYVDDTFTTLHKDEIDDFHEHLNRQNAHIQFTKEIEDNGKIPFLDCLVIRDNNRLQTTVYRKPTHTDRLLDESSYNPSSHKATTIRTLTRRALLVCNSHDSLADERKYLDNVFSKNNYNCDFVTRNTYRTEPNETNTNLTPTTTVTIPYIKGTSEIIARILQPYNIRVAHRPITTLRKLLTNVKDKDQPRDRQGAVYKIKCCDCQATYIGETGRNLNTRLTEHRRATRNGDINNNIAEHHLQTNHRIDWDSATCVTYNTNYYQRIVLESWFTNLEQTPINRCLQLPAPYKRLIDDINRQTTH

SEQ ID NO: 3012 - protein, 1286 aa, synthetic construct
  source 1..1286: note = Description of Artificial Sequence: Synthetic polypeptide
  VARIANT 490: note = Any amino acid
MPGPALGGAPLESATRTLCPPNGFSQTYFSTAAPSPLPVVGSTPGPTLGGALSGSVSSTFLGSTNSKETSLSSFPVPALPTSHNFILQWNLNGYRSRLCDLELIIQNNQPWILALQETNNISADEMGRTLGGQYAWTVKRLANQRHSAAIGILKGIPHKILDLPSDLPIVGIQLLGSPSVSVACAYLPGGNIPNLHGQIQNCLQALPEPRIFLGDLNSHHPVWGSPKADKRGSTLINAFEEEDMLILNDGSPTFFNGHFSSEIDVTAVSLSFARNIQWSVSSDLHGSDHFPIRIALTTGASIPKNTRRPRWKYDKADWAEYDLLIRSALRNSPPDNMADFISTIVESAKATIPRTSSTPGRKALRWWSDETKTAVKARRKALRQLRRLPLDHPDRQSTLENYRKLHLECRNIIGDAKKATWESFLESMNASQTTSELWNRVNALNGKRKTTPLTLQVQGNAISDPEAVASELGKYFASLSAIESYETHFXNSVKPSTSAINNFIIPPNTADPEMEQPFSARELSFALSRSNGRSAGPDEVGYPLLKNLPSVGKLALLDLYNKIWANNDFPPAWKESLVVPIPKANIPTRDPTKFRPISLTCCAGKVMERMVNRRLRYHLEANGLLDFRQHAFRQGYGTSTYFAGLSDVLKEAYDKGNHAEVISLDISKAFNRTWTPLVLEQLAAWGIGGRTLHFVRNFLADRTFQVVIGNTKSSTFPEETGVPQGSVLAVTLFLIAMNGVFSRLPKNIYVFVYADDIVIVVCGSTPTMTRIRAQTAVKSVAKWASDNGFQLSASKSIRCHICPSGHRITGPDITIDGQPIPLRKTVRILGVIVDRALSFRQHFDTVKSACRSRLNLIKSISRPHRSNNREIRFRVARAIVDSRLVYGLELTSIAMDRLVEVLSPIYNSYIRIISGLLPSTPSDSACVEAGLLPFRIFIRSSICCKTAAFLSKTAGEDRVFLLDEGNRALSTAANLSLPPVTRVHWLGDRSWRSVPPKIDNKIKNSFSAGSNSAALRRSVAELLQTSYSDFALRYSDGSLTSAGVGIGVAGDIPDVSMSLPSQCSVFSAEAAAAFIAATTPSDRSILVLTDSASVISALQSDSPTHPWIQAILKYALPDTVFTWIPGHCGVPGNEMADHLARSGLSGQRYTSEVPFMDLKRWIKSTFRQHWEDSWYRTRTLFLRKIKNSTTTWSDLPILKDQRILSRLRTGHTLISHNMGGGPFHKECESCHIPASVDHVLCACPMYEHLRQIHGLSDNIGEVLRDDATTIAALLSFLRDANLYSSI

SEQ ID NO: 3013 - protein, 955 aa, synthetic construct
  source 1..955: note = Description of Artificial Sequence: Synthetic polypeptide
  VARIANT 261: note = Any amino acid
MKLEILGLSEVRWPNFGEHRIPSGQILLYSGLRGEHAPRHRGVGFLLSAQAYAALMKWEPINERIIVARFRTRVRNLTIVQCYAPTDAAELQDKENFYSQLNAVVDKIPKGDIKIYMGDFNAKIGSDNSSYEPVMGRHGLGEMSENGELLAEFCGNNDMVIGGSLFPHRPVHKVTWVSRDGFTENQIDHICISRKWKRSLLDVRNKRSADIASDHHLLIGEVRLRIARIRRQEERVGRRFNTRRLEDATVKRSFVEELETXAANISEGGSVEEQWTAIKNAFITTSENNLGELRTRRKQWITDETWRKIEERREAKAAIERAKTRGAKALSRQRYSALEREVKRSCRRDKRAWADSLADEGEKAAATGDIRLLYDISRRLSGAKMNTTMPVKDTTGQLLTDPTDQLKRWFEHFEQLFQVSTRPPTPQHDPPRVRRISRVNTEAPSLHEIETAIQSMKSNKAPGVDRISAEMLKADPAISAQLLHQLFRNIWDTATFPADWMQGVLVKVPKKGDLTVCDNWRGIMLLCIVLKVLCKVILNRIQEKIDATLRRQQAGFRAGRSCVDHIVTLRIILEQVNEFQESLYMVFIDYEKAFDRLNHENMWGALRRKGVPEKIIGLIEAQYEAFTCRVLHNGVLSEPIRVVAGVRQGCILSPLLFLIVIDEILIGAIDREQNRGLLWQPITMEHLNDLDLADDIAILAQRRSDMQSKLDDLAERSSAAGLNINVNKTKSLDVNTAGPSSFTVAGQTVENVENFQYLGSQLASDGGTKIDIGARIKKARAAFASLRNIWKNSQISQRTKIRIFNSNVKSVLLYASETWCVSAENTQRLQVFINRCLRYIIRAWWPHNWISNADLHRRCHQQPIQTEIRQRKWGWVGHTLRRGGNEICKQALEWNPAGHRSRGRPRGSWRRSLNKEIKEVDGNLTWPQVKAIAGNRPGWKSFTSALCTRMGAQDP

SEQ ID NO: 3014 - protein, 797 aa, synthetic construct
  source 1..797: note = Description of Artificial Sequence: Synthetic polypeptide
MASTLSESNTFIKLKKSIAGLKKDIAFLSECRKLNLTPKSHKIKVRGQVPQDIIKKMESEYLRSSIKKLHSKLNSQTLKCYSLHLKLAKQYPWEFPLFLTKVIQAEECEARRKKDIHSKKLAILKNKQHNKVVTALPKVHSIEGFVVNRSTQQFSEEQLTLLNKGLAYAVATKPDIEQTIIDVETAITHTIPIEFQESARNDTEESLKGNKFQLRGQNSDEDKVLSELRDKSVYYVKADKGNAVVILDKDDYDNQMNEKITTGPYRHFRVDPLPTMVRHVEKTLKECKPLLGDNTSRLKVSNPVLPRIKGLPKIHKPGNEMREIISAEGSPTHKLAKWLVKEFQSMPKPFESRSVNNTQEFASQLQASGYIQDDEIMVSFDVKALFPSVPVKEAINLLEEWLLNQHNESNWKNKVRYYIKLTRLCMEENYFSFRGNFYKQTKGAPMGNPLSPFLSELFMANFESILKKKDLLPQRWWRYVDDVFSIIKKDYLPKILEAINSIHKDIKFTHEEEKDNKLPFLDLLITRESSHFEFEIYRKPTNTMRVIPSTSNHTYQHKMAAFHHMIHRMQTLPLSETGKSKELDYIFETARLNGYRNSTIQAVVDKRARDKYRKSMTTLTAEKEDLKRVAVNFDTKITQPLAKKFRKYGVDLVFSSRSSQLKSRLGSTKDKINKLNRAGVYKISCPHCNKIYIGQTKRTLEIRFKEHIAEVKKADKELEKGLAYDFKSKVAEHVFQDGHQMTSDNIDIVRSVSSSWKLDVAESLEIYKQKPSLLLNRDQGNGQSRLFKFVPKKYKRA

SEQ ID NO: 3015 - protein, 775 aa, synthetic construct
  source 1..775: note = Description of Artificial Sequence: Synthetic polypeptide
LDNFAFRGLKQRNLLRNHLDRTLDLIFTNDAITDCSSVDEACQPIVDIDPHHPAFVLTVRSPTIVPFVEVSDEEVRDFGKVDYETLHVLLSRVDWSTVYQCNDVDNAVSIFNGKLHECFTHCVPLAMPRRKPAWSNARLLYLRRNQSKMQRRFSKRKNDCNKLAFNRASRSYRYYNRYLYGKYVRRVQDNLRRHPKQFWSFVNSKRNETGLPSFLSLNGHSASSAEGKCELFASWFASVFDTSSQSQADPDAASQSLPTDIIDVDIFEVSHMMVEEALKKLKPSISPGPDGIPACILKHCKAVLIAPLKAIFNLSLRCQQFPKAWKMSYMRPIFKKGSRTEVSNYRGITSLPAGSKCFEIIMNDVLLQACKTYISQNQHGFFPQRSVISNLCEYTSFCIKEMDKGGQVDSIYTDIKAAFDTVDHSILLAKLNRLGASSRICSWLYSYLTDRQLLVKIGKAISAPFTPHCGVPQGSNLGPLLFVLFFNDVSHVLSNCYLLFYADDLKIYLIVRSINDCRQLQEQLDLFVSWCTLNHLSISVSKCCIISFRRMKSPVLYNYAINGTILNRVDNVKDLGVLLDHQLTFKMHYSETVDKANRQLGFIFKIASEFDDPLCLKSLYCSLVRSILEFASVIWSPYDAVWIARIESIQRRFVRCALRSLPWSDPLRLPPYEHRCALLGIETLEERRKMNQAVFGAKVLRSEIDSPALLRQLNIYAPQRVLRSRQLLYQPPRRTMYGSNNPIDTISRRFQDNYNLFDFNISTNTFKNRLRNRQV

SEQ ID NO: 3016 - protein, 746 aa, synthetic construct
  source 1..746: note = Description of Artificial Sequence: Synthetic polypeptide
SQHQRGGGVLIAVKKALQSNVILINDANQLEQISVRITYGTMSLVVCTVYLPPNTEPALYQQHAASVNQLCKLLGTQDEIVVLGDYNLPYLRWRFDDDIGAFLPINASSEQEISLVEDIVATGLMQMNHLLNSNERLLDLAFVSNASVCELLEPPLPLMKVDRHHTPFVLTLDVIQTPLENRKNETFFDFRQCNYDELNAEIAQINWRDILAFGSLDDAVTRFYSELNVIFERHVPRRSRACRPDNKQPWWNAQLRNLRNRLRKARTRYFRVRNRLNRDAVRDLESQFNELNVSCFQSYIDRLESNMKDDPKQFWSYLRSRTTSRGFPQLINYDGKTATTPDDAVKLFSSFFQSVLSITPPPSSASYLSALKTFDLNLQPTSFTQHEVYKKLCSIDGSKGPGSDGLQPSFIKACSASLAEPAALLFNRSLAESVFPAKWKEALITPIHKAGNVHDVKNYRGISILSCLPKVFESMLLDFLYPAVRHIITEDQHGFVRKRSTTTNLMSYVSTLIDKIEKRQQIDAVYVDFTKAFDRVPHQLAVEKFQRMGFPDWLTKWVLAYLINRSASVRLGTTLSDPFEITSGVPQGSHLGPLLFILFVNDLCSELKSSKVMYADDLKIFRVINSPVDCCALQMDIDKILDWCSRNGMDVNIAKCNVITFTRKRSPTVFEYSMHGATIERVRLVKDLGISLDCKLRFVEQISSVIAKAYAVLGIIRRNTKDFRDVYCLKALYIYHLFAAFWNMEL

SEQ ID NO: 3017 - protein, 873 aa, synthetic construct
  source 1..873: note = Description of Artificial Sequence: Synthetic polypeptide
HGGLAVFVRNELQMDVCRNIVIEGFHHIHCRFKFEANAINLHAVYRPPSFDVRRFLHEIEGMISLSKNNEKCVLVGDLNIPLNITTNNIVGEYIRLLETYNMLPTNTVVSRQSSNNILDHVVCSTSMIEDVFNETIFTDVSDHCLICSSINMKCHTSESTLHKRIIDHSRLNELFERSILNIPQNLSVNERLNYVITHYNEILNDCSRLVTQRVKLKGSCPWMTLDLWKLIKIKDKLLKKKRNNPNDNHTTELFAHVSKILQDKKAKTKRDYYEGLLSGNNQKAAWKIIKNVMGNQKSNSKPTAIRNGAQLITDPQQVCSSFNDHFCAVGPKLSSTINTNRNINRFGTLGSLQSTIFLKPSTRNEIILLINRLDSKKSAGPDGIPVSFIKHHHSFFASLLMETFNEIIVSGEFPDCLKIARVIPVFKSGDPKDMNNYRPISTLSIIDKLLEKLLVSRILEFSTKHHLIYGQQYGFRQGSSTLTACHELVDEIYDALDNKQIVGALFIDLKKAFDTVDHDLLLRKLESYGIRGIAKDLLKSYLTDRHQYVSIGEHKSQLRLVTTGVPQGSNLGPILFLLFVNDVARLNLHGKLRLFADDTAVFYRGTNCDTILNQIKMDLEVLLEYFGENVLSLNLNKTKYMLIHTPRRKIPAHGPISIGGHNLDKVYEHEFLGLTIDSVMSWAAHINKLKSKVSSLCGILRKISSFMPQTCLKQIYFALVHSRLQYVTAVWGSASKSHLRELQVLQNRCLKIVLRKPLLYPTVNLYSNRNDSLLPIKALYEYQVLVQMQKIVKGTSTHHNTVLHMSQQSRSSRQANHIFLFRPNSEFGKKKITYFGSKLYNALPENCKSFQNMFHFKRFVRNALKQKVEQFVL

SEQ ID NO: 3018 - protein, 766 aa, synthetic construct
  source 1..766: note = Description of Artificial Sequence: Synthetic polypeptide
VNDVVNENGRCLDLCFVSTQDVAPSIAIAPSALVKNVSHHPPLVLLLADSEPCEPLTISPVSYDFNRANQQGIVEFLASVNWLEVLDTNDVENAALTFTHILGHVIERHVPKKVHGTAGPPWQTQELRRLKTSKRAALRLYSKRGTQSHRNHYVSVNNKYKSTSRRCFRRYQQHIQQNLKTKPKSFWRYVNQQRKESGLPSTVKLDDEVASDRNQACRLFAKKFSSVFCDEMLSEEYVALAASNVPLVMETLNAFSVDDGMIARAATQLKSSINPGPDGIPSSFVKSYIEQLLLPIRHVFALSLTSGTFPSVWKNAIIFPVHKKGDRKDVSNYRGISSLCAISKLFELVVMEPLIAHCKQFISNEQHGFIPGRSTTTNLLSLTSHVSDSFTERVQTDVIYTDLTAAFDKINHLITIAKLERLGISGLMLRWFKSYLTERQLTVGLEGHFSETFTATSGIPQGSHLGPVIFLLYFNDVNYVIKGPRLSYADDLKMYLRVRSICDAITLQNDLDAFAGWCSLNRMVVNPEKCNVISFSRRKEPVYFNYQLFGKILQRVDHVKDLGVILDAQLTFKHHMSYVIAKASRTLGFIFRIAKEFTDVYCLKSLYCSLVRATLEYCSTVWHPHYQNGVQRIESVQRRFIRFALRRLPWRDPHRLPSYHSRCQLIHLETLQSRRDINRAMIVADLLQGRIDCPAILGQVDISARHRNLRANSMLRPPLRRTNFGQNVAINGLQRVFNRVAPAFDFHLPRHTVRRNFAEILTRRIV

SEQ ID NO: 3019 - protein, 913 aa, synthetic construct
  source 1..913: note = Description of Artificial Sequence: Synthetic polypeptide
NICHINVQSLIARNFTKFHELKLTFIDSKVDIICFTETWLNHTISNTMIGIEGYKLIRNDRNRHGGGICIYLRNSLLYKVVSMSQSSSNDFYGTEYLNIEIKVGFDKVLLGVIYNPPNIDCIDVLHDILENCTINYDCSFFVGDFNTDILKFSSRSRRFGEMLDAMSYECMNSEPTYFHQSGCSLLDLFITDSPDFVAKLDQISMPGVSNHDLVFCSLRLSLNRVEDIVQYRDYVNFDSSALLDGFYNIEWNNLFCMEDPNEILNFINYHILKLHDDFIPLRRKKKNRTPWFNSDISHAFINRNLAYDQWKRSRTEIDRNTYKRLRNFANDLVRQAKINHDKQNFNVDLPSKQLWKNIKKLGISNDSSFLDQDCLNANQINDYFISNYINDSSSVPIPFSSDGFKFNVFHEEDIVNSIFSIKSNAVGLDNIPIRFIKILLPIALPVYKFLFDSIIKTSVFPRAWKNSKVIPIKKKGNSASLSNLRPISILSSLSKVFEKLLKIQITKFITDNDLLHPLQSGFRQNHSTNSALIKVHDDIARVIDRRGIAVLLLIDFAKAFDRVSHSKLVKKLSSKFSFSHNAVKLIESYLNERKQAVFYNGVLSDFSFIESGVPQGSVLGPLLFSLFLNDLPASLEFCSIHMFADDVQVYLCASDDVDMNDFARKINHDLNNILRWSQNNLLAVNPSKTKAMLICKLKNRPLPPSIYFDGKRVQFYDKLENLGVIFTSNLCWDAFINGQCGKIYGTLKKLNLTTKHLDTAMKIKLFKSLILPHFIYCDFLFSNATASALNRLRVALNACVRYVFNLTRYSHVSHLQDVLLGCQFSKFYSFRACLQVYIIIKRKTPRYLYDKLQFMRNTRTMSLVIPNHSSAYYGQSLFVRGINNWNRLSPTLKSTANIYGFKGGLLRELERLQ

SEQ ID NO: 3020 - protein, 945 aa, synthetic construct
  source 1..945: note = Description of Artificial Sequence: Synthetic polypeptide
LRTKIDALYCNAIDCNYDVIILIETGLDAAINSVQLFGDNFNVFRCDRNAKNSTKSSFGGVLIAVHRRFTSSSISITTGESLEQVCVSVLVGNQRILLCAIYIPPDKSKDVNVMDEHIESVRELRNLSSGNDYLLVFGDYNQPELCWKRCGDEIRPTNSGSISAASSSLIDGMDFCNLHQMNIERNHLNRTLDLVFTSLELSPEITCSVAPLLPTDQHHPPLELDLMLPNGVNNVPTVSNATGELDFTKIDFEALSLFLSETVWHVLLDGLTADNMAETFCSVIANWLNTNVPTRRPAVSPVWGTPLLRNLKRRRNALQRRLRRHRSLENIRSFHRACDEYRELNSSLYKSYVLRVQSNLQRNPKQFWNYVNSKRKSSTIPMSVFLNDSVSSSPLEKCELFAAHFSSVFDAKPASPSEVDSAVSDVPRDLLDLDIFQITPAMVSQAAKKLKCTFSPGPDGIPSAVYCRCMSALAEPLCRIFNQSFVDSTFPAIWKQSFLVPVHKKGEKRNVINYRGITSLSAASKLFEMIVSDVILAQAKGYISIDQHGFMPGRSVTTNLLDFSTTCFEQLENGAQVDVIYTDLKAAFDTINHDILLAKISKLGASNRLSSWLLSYLTGRTLRVKVDSCMSSSFTSMSGVPQGSNLGPLLFLLFFNDVMLLLGHGCRLAYADDLKLYFVVRTVEDCVRLQALLDMFVDWCRRNRMTLSVPKCIVVSFYRITRPIMHNYVVNDVVLKRADSFCDLGVLLDHKLTFNLHRSNVIAKANRQLGFIAKISRDFTDPHCLKALYCSLIRPILESAAVVWTPYQLSWSLRLESVQRKFMRLALRNLPWRDPLNLPPYPDRCRLLDLDTLDRRRKTQQVAFIAKLMNGEVDCSRLLSMLNFRVAPRVLRGGALLQQRFHRTAFGSNEPFTSMIRLFSMFEDLYDFDGSSNQFVSRVRSSDLI

SEQ ID NO: 3021 - protein, 1058 aa, synthetic construct
  source 1..1058: note = Description of Artificial Sequence: Synthetic polypeptide
MTPKCNPVMSSNGQQPGRSVESLMEAPGPSDPVERNAVTVLHSRPGPAVGCGTGVFQSATSGEYSSIIDNAPSPSIVLNSRTCNARKMPISVNAKKSDDLLIYYQNAGGMNCDVDKYLLATSDDCYDIIVLTETWLDTRTISTQVFTPEYEVFRCDRNPRNSRKSTGGGVLIAVKKKLKANIIENDLWCSTEQLWVHVQFFGHSLFLCGIYIPPDRARDETLIETHLQSVTSVIEIAKPMDEIVVLGDFNLPGISWISSGNGFLHPDMNHSHVHSAASRLLDGYSTATLRQINHVTNENLRSLDLCFVSAQDVAPPISNAPSSLVKQVNHHPPLVLKLIVQHYSTSESIAQVTYDFTKADHEGILEFLAAVEWTEVLDTRDVDNAVSTLAHILGHVIERHVPKKTLASKGLPWQTRELRTMKTAKRTALRRYTKNPTPRMRDQYVRLNAAYKRTSRHCFNRYQQQVQRDLTAKPKSFWRYVNEQRKVSGLPPSLFLNGDVASEPQSVCQLFAQKFSSTFCDEVIPEVLVTQAASNVPLVNDSWATLTVDDDMISRAASQLKSTMKPGPDGIPSAFLKRHIDSLLVPIRHVFNLSLISGAFPSLWKNASVFPVHKKGERKDVNNYRGISSLCAISKLFELVVMDPLMTHCKNHLSDDQHGFISGRSTATNLIRLTSHIADSFAEGAQTDAIYTDLTAAFDKINHAIATAKLERFGISGNMLRWLHSYLIGRKLTVTIEGFQSNEFLATSGIPQGSHLGPLIFLIYFNDVHYTLKGPRLSFADDLKIYRRIHSDYDAMCLQQDLHAFASWCTLNRMTVNPGKCSVISFVRIRRPVVFRYELYNTVIQRVDSVKDLGVILDPQLTFKHHVAYVVAKASRTLGFIFRVAKDFTSVYCLKSLYCSLVRSTLEYCSVVWNPYYQNGSDRIESIQHRFIRFALRQLPWRDPLRLPSYRSRCQLIDLETLQLRRDIARAMVVADTLQGRIDCPVLLQSLDLNVRPRVLRNNTMLRLPFRRTNFGQQSAYIGIKRVFNRVASVFDFHLSRQTIRRKFKTVFLSFLDE

SEQ ID NO: 3022 - protein, 964 aa, synthetic construct
  source 1..964: note = Description of Artificial Sequence: Synthetic polypeptide
  VARIANT 168: note = Any amino acid
AAPASSNILMYYQNVGGINSSLAEYNRAVSDSCYDVYAFSETWLNANTLSNQLFDSSYIVYRQDRSASNSNKRTGGGVLFAVRSNFKSRVLNSPNGSSIEQLWVAITTVDATLYLCVIYIPPDRVNDESLIEKHTDSLDWVVSQLKPRDSIMIIGDFNLSGISWQYDXSGSLFPVASRSTISLTSRKLLDAYSTACLRQTVGIMNENSRVLDLCFVSEELRDASTVMQAPSPLVKTCRHHPPILLKMEICPQKRFHDVSESVFYDFRNADFNGMNDFFENVDWDDVLRDSDANLAASTISAILLYGIDQYVPVKVKREPSKPAWSNSELKNLKRVKKAALRRHSKFRTDSTRARYMQANTEYKQLNDCLYNAHQDHLQSILKANPRSFWKHVNEQRKESGLPPTMSDGLHEADSKEDIADMFRTQFSNVFTNEHVDPDIVNDAIRDVPRLSTFVQQIIITDDMVASASKELKSSTGSGPDGIPSLVLKRCAETIAAPLARVFNLSLASGVFPNCWKQSYVFPVFKKGSKQLVSNYRGIAALSATSKLFEVIILQKLVQSYAHYISPDQHGFMPKRSTTTNLACFTSFILRLMEAGQQVDAIYTDLSAAFDKMNHQIAVAKFDKLGMGNSMLLWLQSYLTGRNMSVKIGDHVSSPFRVWSGVPQGSHLGPFLFLLYMNDVNFKLKCLKLSYADDLKLYWTIKQPEDAVFLQHELEAFAEWCQINRMSLNVSKCSVISFSRKHAPFHFGYFLAGTQLERVSTVKDLGILLDSKMTFKDHVAYAVSKASSQLGFLFRYAKKFRDVYCLKALYCSIVRPTLEYSSIIWSPYYQNGIKRVEAIQRKFVRFALRHLRWRDPLNLPSYGSRCQLIKLESLVSRRNVAKACFVGDLLQGNIDCSTLLSCLDINVRRRNLRTHSFINIPSARTNYGLQEPMRSMSRVFNMCYHVFDFNVSRETNKSSYRRVLC

SEQ ID NO: 3023 - protein, 940 aa, synthetic construct
  source 1..940: note = Description of Artificial Sequence: Synthetic polypeptide
  VARIANT 197: note = Any amino acid
MRTKTNEFRTKMETCDYDIIVLTETWLRPDVVNAELASNYCIFRCDRNDNTSTLQRGGGVLIAVKSTLRCSAVELTDYIHLEQVVVAVRLPDTTIYVCGIYIRPNSHFDVYDSHASAVQEICNLSSTRDSIVVVGDYNLPHLTWHFDDDCNSYLPRNASSESEIMFTQSMIGSGLHQINSLRNMNGRILDLAFVSEXSFVELIDPPSSLLKVDSHHKPFVLRIEIETRTRAPVEEADVDDFDFKRCDFAALNDMLVAVDWNETFGDAPLDRITVLFYDKVFDIIRHHVPRRRRCSAVHSKLPWWTPELRHLRNIVRKARKRYFRNKSHDNRKNLKSLETRYSVCQENAFRSYTNRMESNLKRDPKSFWTYIKKLKNINRIPEELSYNGTTAETAEASANLFADFFSSVHNNHSPTFSSSARQNIQSFNVSLPMITISQHEVSSALKKLDVSKGAGTDCLPPTFLKECADSLKTPISVIFNRSLREQVFPEIWKVASITPIHKSGSVHSVENYRGISILCCIAKVFEEIIHRSLYSAVRPIISDVQHGFVKKRSTVSNLMSFTNVLSNSVEKRRQVDAIYFDFAKAFDKVPHELVISKLKHIGLPDWITEWLRSYLTDRKAHVKVGRARSHSYDISSGVPQGSVLGPLIFILFINDLAVRLKSGKLMYADDLKIYREISSTLDCCALQSDVNELISWCTENGMELNIDKCKTITFTRRQTYVTHDYAIGNNIIERVFSIRDLGVIIDSKLKFTEHISTVTAKGFAVLGFIRRNSQSFRDVYTLKALYCSLVRSVMEYAVCVWSPYHATHMLRIEKVQRCFIHYCLRQLPWNDPTNLPDYVSRCRLIDLETLTSRRTKIQRLFVYDLLSNNIDCSELTNELRFYAPTRQLRERQLLVIRPHRTTYGQNCPMSSCLRAFNDVGCYFDFNVSKCTFKHRIKYLN

SEQ ID NO: 3024 - protein, 858 aa, synthetic construct
  source 1..858: note = Description of Artificial Sequence: Synthetic polypeptide
EQSIVCVKLQKSSIYICGIYLRPNSQPVLYSSHSAAIQQLSERISRFDSIVVVGDYNLPQLIWQTDDDINGLLPSNASSEQEVTLLETMVASGFQQINNIVNSNGRLLDLAFVNDNNDVELLEPPTPLLRMDNHHKPFVLRIDVNDSCTQVGDSNHADDFDFRYCNFDELKSAIATVEWATLFIGKDTDETVCTFYEVLHRILDEHVPRKRRRRTHPFKHPWWTSELQHLRNIVRKSRRRYFQSRTVENRDKLRLLEASYIDCQTASFRRYVARMETTAKEDPSAFWTFIRNRKRVNKFPAEMAFRDTVANSPEGIANLFADFLENVHCTNPPTFSPDSLRNCPTFDLNLEPFDFAQQDVLSALQKLDTSKGPGTDNLPPLLFKECADSFQIPLTIIFNKSLQSRTFPMLWKTASVIPIFKAGSTRGVENYRGISILCCLAKIFEELVHNVLYTASQPLISQFQHGFVKKRSTTTNLMTFTSFLSTEIENKHQVDAIYFDFSKAFDKVPHDLAISKLRHLGFPNWIADWLRSYLTNRKAFVNINGTYSRVISVTSGVPQGSVLGPLIFVLFINDLCFRLKSGKLFYADDLKIYRTIASHLDCCALQADVNELELWCQENGMELNIKKCKSIAFSRRQSRTEFDYKIGSEPLERVESIRDLGVIIDTKVRFNDHISVINAKAFAALGFVRRSTNDFNDIYALKSLYCSLVRSILEYAACVWAPHHTTQIVRLEKVQRSFIRYALRQLPWSDPVNLPDYPARCMLINLEMLDARRNNLQRLFVFDLIMGNIDCPALLEDVQFYAPLRQLRERDLLQIRRHRTSYGFNNPLSRCFRLFNCASALFDFNVSKYVFKNRLKDF

SEQ ID NO: 3025 - protein, 816 aa, synthetic construct
  source 1..816: note = Description of Artificial Sequence: Synthetic polypeptide
GIYYRPPHQEEELDLEFSRELMEAACSRDMVVMGDLNYPDICWEEHLARSDRSCRFLTCVEELYLVQEVNGPTRGKALLDLVLAKGDDLVGDLRIEGNLGDSDHEMIEFTIRRRAGKSASRAEVLDFRKADFNELRKIVGETLWEEGLEGKGVQEGWSFLKGTILRAQKRSIPVCRKGGKGAGKPSWLTRGVKECLKKKKEAYGQWKQGVVTKEEYTSIARICRERIRKARAVTEIRLVTEIKDNKKSFFRYIGSRRKTKGNVGPLQNGTGQLITDSQEKAELFNEYFASVFLHANGGRPPGRILDGCGRGDCQPMVSVELVREHLERLNVFKSAGPDGLHPRVLRELAGVIAGPLAKVFEDSWCSGEVPEDWKRANVVPIFKKGRREDPGNYRPVSLTSIPGKILEKIIKKSICERLAEGMMLKDSQHGFVAGRSCLTNLVSFYDQVTNRLDVGDAVDVIYLDFKKAFDMVSHDALIKKLGDCGLAESTVRWVGNWLRGRTQRVLVDGSVSSWREVASGVPQGSVLGPVLFNIFINDLDEDVESTLAKFADDTKLWGKAVTLGDRMRIQADLDKLERWAERNRMQFNKDKCRVLHLGRSNQRHEYRLGGDVLASTMAERDLGVMVDHRMNMSRQCDAVVNRANSILGCISRCVASRAKEVILPLYSALVRPQLEYCVQFWAPHFKKDVENLERVQRRATRMIKGLEDKPYEERLRDLGLFSLGKRRLRGDLVAVYKYVRGEYRELGEKLFTRAPQGRTRSNGHKLLEDGFRLDVRKNFFTVRVTRIWNRLPKEVVQSPTLEVFKRRLDRHLAGII

SEQ ID NO: 3026 - protein, 977 aa, synthetic construct
  source 1..977: note = Description of Artificial Sequence: Synthetic polypeptide
SPPAGFKLGSSGEGEDEYGGSHGTPNQETPTRSAQVCSKDPIRQQFKGGPGTATRGIRCIYTNARSMGNKQEDLELLLASNNFDLVGLTETWWDSSHDWVVGIEGYRLYRRDRVGKKGGGVALYVKEQYTSSLIKLGSEGGQAETLWVRIQGARGERDLVVGVYYRPPHQDDELDQEFSKQLEEAVRSRDMVVMGDLNYPDICWEEQSARSNRSRRFLTCIQDLHLTQEVRCPTRGNALLDLVLATGDDLVGDLRIQGNLGDSDHQMIKFTIQRRAGIIPSRARVLNFKKADFNRLRGLVSRVLGAKNLDALRVQDGWTFLKETILWAQSESIPWQRKGGKGARKPLWLTRGIQDTLRAKKEAYRKWKQGVASKEEYTSLARTCRESVRKAKATLELRLASGIKDNKKSFFRYVGSKKRVRGSIGPIQDGQGGLVTDSRDKAELFNEFFASVFLNGNLDEPSTYITDTNKGNISRPTVSADTVKRHLEGLDVFKSPGPEGLHPWVMKELAGVIADPLARIYERSWCSGQVPEDWKRANVVPIFKKGRKEDPGNYRPVSLTSIPGKILEKIIKEHICGSPLANVMRRGNQHGFLAGRSCLTNLVSFYDKATNCLDAGVEVDVIYLDFKKAFDKVSHTILINKLRGFALDDYTVDWVANWLKGRTQRVVVDGSVSTWKDVGSGVPQGSVLGPVLFNIFISDLDEGVGSTLSKFADDTKLWGAANTLERRNQIQADLDRLGKWAESNRMQFNKDKCKVLHLGRKNCHHTYRLGGDLLSSTEAEKDLGVTVDSRMNMSRQCDEAVGRANRTLSCIRRCFTNRSREVILPLYAALVRPQLEYCVQFWMPQFKRDADNLERVQRRATRLIRGLQGRPYEERLRDLNLFSLSKRRLRGDLVAAYKFIRGEQHEVGDDLFTRAPPGMTRNNGHKLLERRFRLDIRRKFFTVRVARIWNGLPREVVLAPSLGVFKRRLDRHLAGIT

SEQ ID NO: 3027 - protein, 784 aa, synthetic construct
  source 1..784: note = Description of Artificial Sequence: Synthetic polypeptide
MGETILDFAMAYDLAIANTYFKKRDEHLITYKSGSHKSQIDLFLVKKVDRPSCKDCKVIPGESLTTQHRLVVMDVCIKTWKRRGESNGCPRTRWWNLKNEKIDLFRDKLVEEGKWNSEHDVNVIWNEMADCIKKVAKEVLGESRGKRNFDKETWWWSDEVQKAISEKRSCYKTWQCNRNDQNLEEYKNAKKNAKQIVSKAKLKAYDNLYNKLGTREGEKDVFKLAKIREKKCRDLNHIKCIKSEDQRVLVKDDEVNERWRVYFQKLLNDEHNGNIVVEGTVGTSEGGGHRYIRRIRMSEVKEALKRMKIGKALGPDGIPIEVWKCMGEIGIDWLTKLFNKVLRTKKMPDEWRKSIVVPIYKNKGDIQNCANYRGIKLMSHTMKLWERVIEQRLRHETSVSENQFGFMPGRSTTEAIFLLRQLIEKFRAKGKDLHMVFIDLEKAYDRVPRDLIWRVLEKKGVSRHYIDLVRDMYDGALTSVRTTSGETSEFSVTIGLHQGSALSPYLFVLVMDDLTRHLQDEVPWCMLFADDIVLIDETRNGVNTKLELWRDALESKGFKISRTKTEYMECKFSNNRSRDEEVVKIDGQEVQKRPHFRYLGSIIQENGEIEEDVAHRIRAGWAKWRCATGILCDRRIPMKLKGKFYRTAVRPALLYGAECWADKKQYTHRMSVAEMRMLRWMSGKTRRDRIRNESIRENLGVAPIGDKMRESRLRWAGHVWRRPSTTPVRRCELVQVEGLKRARGRPKRTWLEVVRKDMGTYGLTEGMAFNRAEWRTRIHVADPN

SEQ ID NO: 3028 - protein, 967 aa, synthetic construct
  source 1..967: note = Description of Artificial Sequence: Synthetic polypeptide
MFINPIPLCALPRPKWSIHRRRNLSNMIYPPLSTPQEFTVTGGLWNCQSAVKKADFITAFAKTKSLDFLALTETWITPDNTATPAALSAGYSFSHTPRASGRGGGTGLLISLAWKFCVLPSPNPTSSSFESHAITVTHPSKFHIIVLYRPPGPLGSFLDELDTLLSSLPEDGTPAILLGDFNLSPETSQLSRVASLLQSFGLSLSSSPPTHKAGNQLDLVFTRSCSIPQLTVTPLHVSDHFFLSFPLSYLHPLNSSNSSPTVTFRRNLSTLSQSSLISTALSTLPPPASFSNLPVDLATSTFNSCLSQSLDSLCPLVSKPARSSPPCPWLTESLRSSRTSLRAAERKWRKSRSSDDLTAYHTLLAAFTSALTSAKASFFQSKISACVSNPRKLFSTFSSLLTPPPPPPPSSLSADDFLAAFEGKVATIRNSFAHPVSPPPPRDRPTATLTSFEMLEDSDVLQLITSHRATTCPLDPIPSKVLQSISSEFLPYLSSIVNSSLSSGHVPSDFKMARVTPLLKKPTSDPSDVTNYRPVSLLPFLSKTLERAVLKQLTSFLHQNNLLDPHQSGFRSGHSTETALLGVTEALATARASRLSSVLILLDLSAAFDTVNHKILLSTLAGMGIAGTALSWFASYLADRTYQVTWKGSASASHPLVTGVPQGSVLGPLLFSLYTRSLGSVINSHGFSYHCYADDTQLFFSFPPSVTQVNDKISSCLADISTWMASHHLKLNLNKTELLFFPCKTSLLRELSITVDGTTVTASHSAKSLGVVLDDQLDLKEHIKATSRSCRFLLYNIRRIRPYLTTHSTQLLVQATVTSRLDYCNSLLASLPACAIQPLQMIQNAAARLIYNLPKFSHVTPLLRSLHWLPVAARIRFKTLTLAYTAANRTAPIYLQDMIRFYVPARPLRSAEAGRLVTPPTRPKGSQSFSTLAPQWWNELPVPLRTSPSLPIFRRGLKTHLFRLYLD

SEQ ID NO: 3029 - protein, 1148 aa, synthetic construct
  source 1..1148: note = Description of Artificial Sequence: Synthetic polypeptide
MVKQTLKKSILARSSPRIIRTTASATPGHLSTSGLQEPGPIAEQPGHGPVGQLEAKQLQKWQKFSMPQNRTVMNCYYRSEPQKRGYQKRMYQLWKLEYPDSTVTEQRLADQRRYITKKKVLSEVELEEIKSNCETEEQTTVETAAEDLMTSEPTEHMEPEENAGIFQDDEHEEPVAIAYTTPGTLTMKQQELKENFLTHAALKEGRQRLPTLKTVPRKHLAPLMNDVNAALATVEITTMEETNQLAYSTAVIVTQELGIQQLKPARKMIGKPKWKIRLELKIRSLRSDASNLKNMKEQKLKNVKTKNYLIKKYWLNTRKIEEALEIVKQQITATARKIERYEARVIQYKQNQLFQSDQRRFYQSLNQQVAVKNEKPEKTATNAFWKDLWETEKGYNKKAEWIKDFENKFSENKMRTLEITTEMITERVKKVKNWTSPGNDQLHGFWLKYLSSLHSKMAEQFNEMLQTGNISKWITTGKTYLIQKDPAKGAIPGNYRPITCLPTMFKLLTGIIADQIQDYLEENNILPVEQKGNKRRSRGTKDQLLIDKMILENCKSRKTNLYTTWIDYKKAFDSLPHCWIIKCLDVIGVCENIRKFTENAMKQWKTELFVGNESYGTVNIRRGIFQGDSLSPLLFIIAMVPLSVILQKTNLGYQTARNSPKISHLLYMDDLKLYGKSETEIQSLTNTVRIFSTDISMEFGLDKCATVALKKGKITHSEGIEMPNGQTIKCNQPEAYKYLGILQLDNIKHGHVKNVVSKEYIQRVRKVLKSKLNGGNTIKAINTWAIPVIRYTAGIVNWTQAELDDLDRKTRKLMTIHYSLHPRSDVDRLYLPRKSGGRGLLQVKQTVEEEKHALADYVKGSQEPTLREVNSSKLLQVQKTKSEYHKNTIQSRRENWRKKALHGQFLGKIESQIDKEKTWLWLTNGTLKKETEGLILAAQEQAIRTNAIKAKIEKSTTDPKCRLCKEADETIDHILSCCKKIAQTDYKQRHNTVAQMIHWNLCHKYHLPATKNWWDHKPEKVTENEHVKLLWDFRIQTDRVLEHNTPDLTIVLKDKVWIVDVAIPGDSRIEEKQLEKLTRYEDLKIELQRLWHKPVKVVPVVIGTLGAVPKDLGLHLNTIGADKITICQLQKATLLGSARIIRRYITQS

SEQ ID NO: 3030 - protein, 847 aa, synthetic construct
  source 1..847: note = Description of Artificial Sequence: Synthetic polypeptide
  VARIANT 507: note = Any amino acid
MGIECIGLTLAIRESVTILLVYRAPGAPNENIPKLLDLVADWALKFPSLIVLGDFNVHADRLLSSSIARDLVQSMETIGFSLMVTGPTHRAGHTLDLIFSIGIQVTLSSVLEIPWSDHYILNTQIKSSPPQHPETEQIFARPRKLMDPIRLSSVLKELDYTADSLHERVENWNKNLSTALDIVAPKRAFRPRRNRSPWFTDALRQMKLERKRLERKWRKKPDETSKLALETHQKIYEAATREAKKEYNSSLIASARSRPAQIFKIVRNIINPTHPAKDMASQDITAETFQSYFINKINLLREGLPPTEDTLRELEAFWPSSDKLLELFVPLEMEDLEKTLAAARPTTCSLDPCPSRLVKECWEGLRDPLRDIINSSLEQGIFPECLKEAVVHPLLKKPSLDAAIPSNYRPVSNLPFLSKVIERTVAGQLQQFLDETAGLDPFQSGFRSGHGTETVLVAITDEIRRQLDRGGSALLVLLDLTAAFDTVDHDLLIHRLAMSGVRGLALXWFNSFLRDRRQRVEWSGQSSESSCLCCGVPQGAILSPLLFNIYVRPLAGLVRSFGIECYQYADDTQLLLRLEPGTTTIPENFKLCLEAVMSWLRASRLKVNPAKTEILWPGQPPELIQSLPDFDGEVLVPSATVKSLGVVLDSSLTMEAQITAISKQAFFHLRQARKLASYLSTEALATVIHATVTTRLDYCNALYAGLPKTKTQKIRMVQNAAARLLAGSSIRSHITPILKQLHWLPIEHRISYKILILTFRARNGQGPLYLRDRLIPFFHQWSPRSSQENLLYVPGPREVHLEATRRRAFSTYAPILWNSLPPYVRAMSELRPFVKALKTWLFGCAFK

SEQ ID NO: 3031 - protein, 846 aa, synthetic construct
  source 1..846: note = Description of Artificial Sequence: Synthetic polypeptide
MPAIDVGETSGENASGTWPHSPKDIQQPCDPGHESLRQHIEHLYGEKLFQDTRRLEKLRTRKAHLLCSLTFLLRCRDTDTIPQFLAAKRTFKTPQAHRIYNRLERNLLRERIHTIRKELANTDKELLHLHINISQKMNTQDWDKIDSLTYKKMEKDMVLHTKRQKQKFDKCRKQQPKPELDKSRTIINLTDRQLTEDQVSILEKGGNFAVTTTRIPVENIIANVESAIYQLPEEEAEEVRMETARILRNAKLPPSNITRKERQAIKDLNSDPEIIILPADKGNATVIMETKQYKEKIRQLLDPTIYKKLKQDPTNKITRKTNTLIKNSSINFDIRQQLCKSEALPPRLYGLPKIHKDSIPLRPIVSAIGSPTYNLAKFLATQLQTHIGLTAHYIKDSTHFIEKISNLNLSTKDILISFDVVSLFTKVPVADTLTLIKQNFPEDITALFHHCLTTSYFQWDTGFYEQKDGVAMGSPLSPVVANFYMEYFEKQALETAPKKPTVWFRYVDDTFTIWSHGEEELSKFLDHLNSIHPNIQFTMEKEKEGKLPFLDVLVIRKPNQQLGHTVYRKPTHTDRYLHKNSNHHPSQKRSTIKALTDRAQRICEPHLLQGELNHLNWALQANGYSTTDIRRAARPRTSHESQDKDPPRGKVFLPYIKGTTDRIGKLMKKHNLQTIYRPTKKIQQMLRSAKDKRDPLSSAGVYRIPCSCGQVYIGTTKRSAQTRVKEHERHCRLIQPEKSAIAEHLMNQPGHRILFENTKMLDHSNNYHVRLHREAIEIHKHVDNFNRKEETMKMNKIWLPVLQNSKIKTVNKKQYSENRGFPDMNQPRAVNDSKQRMPQRQEEDSR

SEQ ID NO: 3032 - protein, 972 aa, synthetic construct
  source 1..972: note = Description of Artificial Sequence: Synthetic polypeptide
MTIISINIEGMSAAKEQLLYELCRDKKCDVLCVQETHRDKQQKRPKVPGMILVAERPHAQYGSAVFVKPGLQVSSVHNTEENNIEVITVELNNITITSVYKPPNEEFCFSSPENFDSHQRTVVIGDFNSHSHVWGYAQEDKNGEAVLSWAELHKLSLIHDSKLPPSYNSGRWHRGYNPDLLFVSDSIVQQCSKSVGPPIPNTQHRPIVCQLFPTIRPLEVRFKRRFNFRKADWSKFSDMLDDKIISVAPIPEEYERFIKIVKTCSRASIPRGCRTHYLQGITPDTAALLEDYYRLHNEDPFSEQTLQTAQSILSSISEAKKEQWIKLITEVDMGRSSQKAWRLLRRLSNDPSQTNTHANIKADQIAHQLLKNGKPKLSTKVGRKPIVRQPDNENNHLHEPFTSTELDMALNKCKNGKAAGLDDLRMEQIKNFGPKARCWLLKMMNNCIASCQIPKIWRKARVIAILKPGKDRNDPKSYRPISLLCHLYKVLERLILNRIMEKIDPCLIPEQAGFRKGKSCTSQVLNLTQHIEDGFERQQITGAVFIDLSAAYDTVNHRLLLRKTYNITKDYHLTRFIGNLLQNRSFFVEFQGQRSRWRKQKNGLPQGSVLAPSMFNIYTNDQPLPEGTESFIYADDRAITAQAGSFEMVEQKLSEALGALTAYYRENQLIPNPSKTQTCAFHLKNRQASRALRITWEGIPLEHCSTPKYLGVTLDRALTYKKHCFTIKQKVGARNNIVRKLTGTTWGSQPDTVKTSALALCYSAAEYACPVWNTSHHVKTVDVALNETCRIITGCLRPTPLEKLYCLAGIAPPDICREVAANNERTKALTSPAHPLFGYQPARQRLKSRNSFLRSTEILAGTPQQARVQKWQAKTRNLNQWLTPDERLPPGHTEDWATWKALNRLRSGTTRCRANLKKWGYKVESATCDCGEEQTTDHLLQCILSPATCTMEDLLTATPEALQVASYWAKDI

SEQ ID NO: 3033 - protein, 1355 aa, synthetic construct
  source 1..1355: note = Description of Artificial Sequence: Synthetic polypeptide
MEGVCCDCSVPLESLECGIMCSFCDAVYHSACTKSPFTVIEEVKRTASLHWSCVGCSNALGNPHSKAVKTTGMQVGFQAALTAAVEVMKAALVPPVMHEIREGFASFAAAHQAPSEHFNVPPPDALPSGKRRRLFRDVVASTEAIVVDNAPLYPVNTDTDNTHQRNRPSLPPIITGTDTTTTSIPTVSQLPRTNYMWLHLSRLAKTVTVDQVVSMVKSQLDTTDVIAFSLLKAGTTISSVSSLTFKVRIIAALRDKALTAGSWPVGLGVREFISLPQRPSHHRPDLTNTNTPIPVRHSPMHPVQLSPDMNCTLISPAPQKQLQPHQTPLKCTKLLFNTFFLSNNHTTVSSKGTVPLNLTSHLFTRNNNTSTTRSLTDDLAPTYTRIPLNVRSTSITVYYQNVRGLRSKADEFRLTVLEADYDVVVLTETWLDPSLPTALLFGDAHCVYRCDRNAANSSLSRGGGVLIAVSSALRSHALPVLAQTLEFACICIQLPTYRLYIAAAYLPPNHSTDEGKINALLDTVNSICDTLGPNDRFVLVGDFNQPALSWSPAQSNHETPFVFFEPHTSSVRSAQFVDGLHQNALYQLNNNTNSMGRILDLAYGNWSSAATSSLIRVSEHPLLPIDCYHPPLEFDLEITASSMNHATTVTEIKLNYARADLTKLKRLICSFNQSFECSNYTSIDHATNDFSEFMRAALRECAPIKKPHRGPPWGDRTLHALKKAKRAAYDYLRANRSTPCRLYYNGAHALYRRYNRVCYRRYIRQTERSLRKYPRRFWSFADNMRKSTGLPGTIRYKDNCAHSPLDICELFATRFEDSFISNITPPEAVASALVNTPADAIHVTLPIVTETLVTQKIERLKSSYSEGPDGIPATILKRCAVSVAPVLTKIFNESLRTGTFPSLWKVSWLTPIHKKGSKNEAVNYRGITSLAACAKVFELIIYEPLMASAGKYISTNQHGFMPKRSTTTNLMQFVSGCYKSIDDGMQVDAIYTDIKAAFDSVSHNILLAKLDRLGLSPPLVKWMKSYLCGRSYAVRMGSHQSRSIGASSGVPQGSNLGPLLFLLYISDLCTALPDNSCLLYADDAKIYREIREPEDHLQLQATLTEFVSWCKRNALSVCIDKCAIISFSRSRAPALFNYTLDGQNLERVNCVKDLGVLLDAKLSFEEQIDQVVASGNRLLGLVINMTRELRDPMCFKTLYCALIRPLLEYASIVWWPASTRALARLESIQRKATRFALRDWPRRLDYRTRCLLLGIPPLAERVEHTRLAFITGILNGTIDCPELLSRIHLYVPARILRRRPMLAVAETRTTFGSRNPLLCMCRLLNSANDIYEPGMTITELTSLLSVRNAFNNNNI

SEQ ID NO: 3034 - protein, 1064 aa, synthetic construct
  source 1..1064: note = Description of Artificial Sequence: Synthetic polypeptide
SPRIPRIFGLQCSPGFSSTTAAAIPSQAINRCDPRTRITSVYPYRFSAANFPPVDEPAATTAQSNSTSTPITPLHHAAERFETLPSVASPITVSAPLPLHASFPHPIDDLRFYYQNTRGLRTKLDDLRLASADTEYHVLILTETWLSENIPSSLAFDNNFVIYRCDRNSRNSSRSRGGGTLIAVSRKLAACEISPASDSLEQCWIRLKLPSCSLFIGSIYLPPTLSADASTLNTLDASIDEIISRMKKNDRLLLFGDFNIPSITWHASPDPAPPFLPLLVPASSAHSSSLFIDIVRYHSLSQLSSVSNFRQVQLDLIFTFPKNQSNATSTCTYVSQAPVPILQIDPHHPPLELSLKITGSLTPSNRSQHSSSRLTTAPSLDFRKTDFNLLNTSLSNIDWSQLYSCKDVNLAVSTFTSLFLSTLPQCCPKRNPPRSPPWSDATLKSLKRDKSRYQRAYWSTRSVNALRTYKYAAAAYRLYNRTRYNGYILILQTRLRWYPRAFWKFMNARRKGSSLPSTMHLESVYASSPEDICSLFRNHFSNIFSPPSQIPNTASQCLSYTPQDVIDVSCFGFDEHSVSEALSKLKPSFSAGPDGIPPSLLKKTAEVIAPLLSFIFNLSLRLCCFPSSWKSGWLCPIFKKGNSADVSNYRGIVLLPACSKVFEIAVHSVISFQVKSWISVNQHGFMPSRSTVTNLMQFASHVIPSLDSGLQVDTIYTDFKAAFDTVPHHLLLLKLKKLGFSNMLIDWLYSFLNSRSIRVKTDTTFSSSFCPSSGVPQGSVLSPLLFVLFVSDVHAILPSEGHLLYADDLKIYLTISTHSDCLRLQEFLNSFSLWCSYNQLSLCPEKCSVISFCHNRNPIHYEYSLSNSVLSRTSLIRDLGVLWDDKLSLNEHLESVVASASRTLGLICRLTRDFRDPLCLKSLYCSLVRSTLEYASVVVGPVRSGWILRFEKVQKRFTRFAFRRMAGPNAAMPSYESRCNLLGLESLEVRRSQARVLFIGRMLNGLIDAPTLLEKIGLYAPSRNLRARSALNMVSRQTTFGSNEPLLLCVRTFNTSTDPPHPRL

SEQ ID NO: 3035 - protein, 536 aa, synthetic construct
  source 1..536: note = Description of Artificial Sequence: Synthetic polypeptide
MPSPIVDQTVISRATSYTPLNMIDYTIPTFDIRTVEKCLKSLKPSTAPGPDGIPSYIISKCYQSLAPVLTNIYNTSLSSGIFPRLWKTSWMVPIFKKGDRSCASNYRGITSLCAVSKAFELLLYGPMLSATSNYIMDNQHGFVPKRSTLTNLTEFVSFCKRNLDSGGQVDAIYTDLKAAFDLISHDILIAKLQKLGFSEQIVKWLHSYLTERSYKIKVNDHTSREVLGTSGVPQGSNLGPLLFILYINDVGQLLAEHRFLLFADDVKLFAPINDTNDCINLQHAINLFSIWCRDNAMVLCIEKCRVLSFYRSRSCTRFNYQIDNISVERTDTFRDLGIILDTRLTFNDHLENIVSRGNQLLGWIIRSTQGFRNPMTIKTIYCAYVRSVLEYGSIVSDPCTEQWSNRIEAIQRKATRYAVRLLPWRQGDVLPSYHSRCLLLGIQSLKKRREIAKCLFISGLLNHHIDAPTLLATIEFNAPSRNLRTRQFISVPRYRTRFGQSDPMSAMCRTFINNFDLFDFNIPQNVFRDRLRTQLT

SEQ ID NO: 3036 - protein, 1008 aa, synthetic construct
  source 1..1008: note = Description of Artificial Sequence: Synthetic polypeptide
MMQGGESRKEAAGQKPPPSSKSKSLRIGSWNVRTLYEAGKTAQVLQEMHRYQLHILGISETHLNQSGQKRMKEGELFVYSGNDSDGPHREGVGMIISKTAQKTFRGWEAHGPRIIMASFGTKKELKVRDGRKKVINMNIIQVYAPTNDAEVENKDDFYNRLQNVIDKLPGKDINIVMGDLNAKVGSDNSHNEEIMGRHGLGEANDNGERFQNFCTFNNLVIGGTIFPHKRIHKATWVSPDGTTENQIDHFCISRKFRRSLEDVRVLRGADVASDHHLILGKMKLKLRRYAQVAAGNRLKYEVSLLKDPVKKNEFKLELKNRFQALQDLDECEVNEHWDKLREAVNATCQSTLGPKDNTRNEWISQDSLDKVKRRRELKAQVNNSRTRTEKLAAQQEYTEVNREVKNSIKKDKNTYLNGLAEKAEKAATDGHLRIVHQTTRTLSGRFSKPTLPVKDKEGKTIFNPEGQLNRWREHFDQLLNRPPPENQPEILPARNDLPIDTEPPSREEIAAAIKTLKSHKAAGPDHIPPEALKAEKDTFVEILYALFEKVWQKEEIPSDWKEGHLIKLPKKGDLSNCNNYRGITLLSIPGKVFNRILLERIKLATDEKLRGNQAGFRKNRSCVDQIATLRIIVEQSLEWNSPLVVNFIDYEKAFDSVDRETLWKLMRHFGIPEKIVKLVKATYDGTSCQVFHEGQLSEPFRVQTGVRQGCLLSPFLFILAIDWVMKEATRGKRNGIQWIPWQQLDDLDFADDLALLSHTHAQMQEKTKELNSLSRSVGLRIHPGKSKVVKLGKVSNLAVTVEDTPLEEVDSFTYLGSVIDGKGGTEADVKARTAKARSAFKQLSKVWKASNISLRTKIRLFNSNVKSVLLYGCETWKTTKTVLNKVQTFINRCMRSILRIKWQDRIRNEELWERTGQKDIEVEIGLRKWRWMGHTLRKPSGNITRQSLQWNPQGARGRGRPRETWRRCVERDMREMKLTWNELGRMAQDRDKWKELVCGLYPARGERH

SEQ ID NO: 3037 - protein, 935 aa, synthetic construct
  source 1..935: note = Description of Artificial Sequence: Synthetic polypeptide
MSLKSMVEIYQPDIIAVTEVKPKYVRFKIQESELSLDGYDYELFHNLEEEGRGLVLYVRKALKPGLCDDLDNDFCEKRFVKCVLKDGVSLLIGLAIYRSQHSPTAEEDARKLNKLFELVSLRKETHKIIMGDFNFRQIDWETETSNAGEKHIATKFLKATKDAFFIQHQKTPTRYRKGETPNILDLVFTNTEQLVTDIKVEAGIGKSDHLCLLMTLSLSAGTAPKVTRRNFRKTDVEKLREDLGAYDWESELANKNVEDTWSVIKSKIEGAIGASTPLMNISGRKNKRYMDKDTLEAVRKKHRAYRKWHRTGKTTDEIAYNKANNKARKACRKANRNYEKKLAIEAKKNPKVFYSYANSKIKSKTGIADLNKDDGTKTKSDTEKAELLNKFFQSIFTNEDTGPLPDFEEYDYNTELQDFNIETVTVKELLVSLDVNKATGPDGIPPRVLSQAADILALPLRILFRRTLNDGVLPVEWKTAFVSPIFKKGNKAAVNNYRPVSLTCVICKVMEKLVRGHIMDHIVNNMLISKDQHGFVTGRSCITQLLEALDDWTSVMDEGGSVDVIYMDYQKAFDSVPHRRLIQKLSACGVKGRVLKWVRDFLTSRKQRVVINGSRSEEAEVTSGIPQGSVLGPLLFVIYINDLPRGLKTTAKMFADDTKLYVRSDTVNGPQDLQDDLDTLQEWSQRWLLRFHPQKCCVLKVGKDNDNEYFMDQAVDGSTSRHKLNVTKREKDLGVVVDNKLTFKEHVAQMTSKANRIVGLIRRSFDYLSEDMFVLLYKSLVRPLLEYAHCVWQPFEKGLCSEIEQVQRRATKMLSHLKEKPYSERLKKLKLPSLEHRRLRGDMIETYKYIKGYYITERPAFTKATTTQLRGNSEKLQKQRSRLCVRANFLENRVNTIWNNLPESVVSAPNVDTFKRRLDEYWKDLPTIYNPTCQN

SEQ ID NO: 3038 - protein, 1202 aa, synthetic construct
  source 1..1202: note = Description of Artificial Sequence: Synthetic polypeptide
  VARIANT 96: note = Any amino acid
MSIRIASLNCRGLNKKLKRRAIFRKCTQYDIICLQETYVTNTTAREWSLEWSGDFFYSEGTNKSKGQIILVNKHFKYKTVELCIKTERILGLSFSXDDVSYVAINVYGPVVKNDKLDFIDKLYSVLKDEKADHTIICGDFNVVHNNTLDIVTGEKHDDMSTQKFRDWIANCQIVDTWRGVHGEEKDFTWSRPTPFTARRLDYIFCNTELFPFVIDSKHAFVYGTDHKAVITTVRTEKFKRGPSYWKFNNSLLKDKEYVNSMEKCIDEYLERTLDETDKTIRWELLKVMIKSHTIDYCIRKCRALKLRENLITEELLKLNDQVVKNPQDLTLLKQFESKKKELEIYQLHKARGAQIRSRQKWIEEGEKNTKYFLRMEQMRGGSNVITSLQDDKNNNLYGHVDIVDSIKNHFERLYKKDHNIETNRVDDFMQGCSFPVLDDVDKEICDSELSIVELDAIVNKLNIDSAPGIDGITTPFYKFFWSKLRKPLFTNFQQCLETGELSPTQRRGVISLLHKGKNLRRDNIKNWRPITLTNTDYKIFSKILAIRLQRVMPVLINENQTGFLKGRSISEHIRTLDDIIYVASEKNLPGMVVSLDFQRAFDTVEKGTILATLKKFNFGEGFINMVGVLMANTECCVQNGGWLSEWLNTERGIKQGCCTSPLLFVLVAELMSIKLRNNSSISGMSTILSGEIINFCKVLQYADDTTLILKDQEDLASALLDIDSFGSISGLKLNKDKSQGMWIGSDRTRTEKLGGISWVPNGNTIKILGIHFSATEEASRIELNWIDKIENMKNIMKMWMKRNPSLYGKVIICKTFLLSQISYIIQSLSLPERVLNTIDTLFFKFLWQKRHSNKKAREKVKRTVMCRSIEEGGLGVISVKDQQKVFLLNWLKRMATVTEGRPNNIPNRISDLAFTEVGGCDYFFSATANCKKTGKLCHASKFWESVMDTWIEMASIKKEPSSTIEILMEPLFNNRNIKYKGKSLYLKRWMNSGIKYVYHLYDRRILKSKEELSHITGTYAAFDFDYYALMNALPTQWKQDVSDNNTEELLVNTREVINTNGKKTVLEILSKSNREIRQLLKYRRHAEICGRNFWMRKMNIDITCKYNIAHRSTKESRLRLLHFKILHNIFPSNILLNRLGIKNTELCEHCGVKDVIEHMFIHCTLLKNFWKYVFHTICLKTSSRFPMTDCNILFGFSERGQG

SEQ ID NO: 3039 - protein, 1095 aa, synthetic construct
  source 1..1095: note = Description of Artificial Sequence: Synthetic polypeptide
MDNDLSVKRTMQKENQENSFMCEQCYRKFDTWRGLRVHQGKVCLKKRRQCRSSDCKTRSKSSQDENHSGAISASVDSPFTLSQQEMEQQTEPGLRKPRILWPAANEKAKYKTLEEEVQKKLKEVKKSSNRGDAKEILSAFATIIYDSAIKEFGICEGKKKTEKKSGLSRRQRVLAQLRKQKRDLQKQKKYAPPEEIEGLRILFEDLKKKSRDLQRHERRCTRRKERKREREQFLKNPYEAAKKLFTEARSGKLECTKEELDAYVKQTYSDSRREEPLPYMRGLKRPAAPVVKYYLGPIREKEVDEFVKKARAKSAPGGDGVSYKVFKYCDTLRHTLFEMLRGLWKDKEIVKDWCRAEGVYLPKEQNAKEIGQFRPISIINVTCKIFMGILAKRTVAYLQSNGYVDETVQKAGVPGIPGCIEHAFTIWDTIQEAKKNKESLNVVWLDLANAYGSVPHKLLMKAMDFFYVPQEVQNIMREYYSNFQMRFSTANFTTEWHRLEIGIAAGCSISVIWFILVMEMLLRSAECCEEEAKVRSPKKAFMDDVTLLTRDGDTMQSVLNRLDKLITWARMKFKAKKSRSLTINKGKQKQLKFTIAGEQMPTVKEQPVKSLGRWYSGTLSDRSQGVEIMKQAENGLKAIDQTKLPGKHKIWCLQFALYPRLAWPLTMYEVALSRVEMIERKCNSYIRKWLGLPRTINTSSLYRHRGALQLPLTSIVEIYKAGKIRTVLMLRESRDKEISGKPPDVKTARKWKAEVAANEIISALEHGDIVGPAQPDRLGLGNGDFRPFRKMSQRDRRKAATRHMQKMEAERREIHLIQCSQQGQMTRWEEHVVERKVGWSDIWKWNTSRLSFLLRSTYDVLPSPVNLVRWKVREDNKCRCGKLGTMKHILSNCNLALNRYTWRHNEVLKVLTKMATQQVEEGKYAPKIQKHGPTKIAFVPQGSKVAKRKKANEAMKDQSGGTWEVAADLKGFERFFPIPTTKKPDIVLWEEKDKEVHLVELTVPHEDNIYAAHERKENRYEALVEQCEEAGWKATHFPVEVGCRGFVATSARKWMRVAGLTAKKSNELTNSLQETAEKASHWIWLKREDSSWNES

SEQ ID NO: 3040 - protein, 1101 aa, synthetic construct
  source 1..1101: note = Description of Artificial Sequence: Synthetic polypeptide
  VARIANT 216: note = Any amino acid
MLFTNDRIPYELRRRLGNQGLPQVLVGNQAGLVDGYWKKKKIRKQRKWKNKKKTPPTTGNGKEKLIDFNILQANVCGLDKKKTQLGKILYERKVHIALLQETLHSSCDINITGYTPYPCKCEGCQGIITYIRNDIQGEVELLNWHPTDAHKVTLWYGNSKLILYNIYCPPSSTLNFLEQSTIFKKTVIAGDLNGHSPLWGYADQNNTGKRIEELCXSSNLILLQDEDSTKTLLHRRHGTLHRPDLTLVSADLHNYCSEEVLDCISSDHRPVLTKISILKHRQRKRRTRWNFKKANWDLFRKTAEDTVKLDDLDNKSIDALNSELTSTILDAAKKSIPQGCRTNYKPFWNERLEKATKTKNDARHEYEKDLKNMDKKIRYKKAVAEAKLVTKESKKEAWTQKCEGLNLHQGGREAWSLLNNLTGEKRKENPKPLHTETEVLTSELKKAEHFNKHFASINKSSKRNDLDRGLLSVLKGKERDLMTPSIFQDFLTKRELDCAIKKLKKRKSPGPDKVHNEMLQNLGEKAKLLLLKLYNRTWTEGNLPKAWKLATINPILKKGKKANDPKNYRPISLTSCIGKLCERILNSRLYWWLESSGLISQCQAGFRSKGRTEDQLFRLTQKIIDGFQRGEQTTAVFVDLQQAYDRVWRKGLLLKLQNMGIKGNMYSWIKSFLTDRLIQTQMDETLSSKAVLEEGLPQGSSISCTLFLVFLNDVSDVLKTEKALFADDLVLWHTGNSTTISRRRLQDDLNSLGTYCRLWKMKVNCEKTVYSVFTRSYNLANAEIPLKIDGTNLKKENNPVYLGVQLDSKLNLKQHTNNLRKKAMKRLNLIKRLASTNWGSDKNTLRGLYLGYTRAVFDYNLVLQNICSKTTKNSMDTIQNQALRLISGGMRSSPTAACEIHTNIEPLETRRKRAALEVYERSKRLENNHPNRVLVDKWKPNQRLKNTKSVLDTVLNLQEKHHLPERREPLERVPSTLPPHLTIAKPEIRKTLLDKSNKNTYPVALKHSALETIDSYPPTWIHSYTDGSAFKATINAGYGSVINLPSGIKKKKSLTPAGPSAPISLPNNRLSPTQQTTSTTCLTLTHLLPQTSLSLQTAFQH

SEQ ID NO: 3041 - protein, 990 aa, synthetic construct
  source 1..990: note = Description of Artificial Sequence: Synthetic polypeptide
  VARIANT 11: note = Any amino acid
  VARIANT 59: note = Any amino acid
  VARIANT 209: note = Any amino acid
  VARIANT 387: note = Any amino acid
  VARIANT 778: note = Any amino acid
  VARIANT 971: note = Any amino acid
  VARIANT 975: note = Any amino acid
MDHITSINKDXDVKGSSERTASSGRVSHAQQVTPDRHQDTAHKRKNQTRNIATWNVRTXLEKGKLDNIKKEMKRMNVNIMGLCEVRWTGAGRILSDSYNIIYSGGDKHERGVAVIMDMPTSKTLKGYLTISDRVMLVRLKGSPFDTTIIQAYAPTSESTEEEIEKFYDEINQAKTHCKSQDIVIVMGDFNAKVGATRHEDIVGPYGLGXRNERGEKLIEWAILNDMIIGNTWYEQPPRRLWTWKSPGDSARNQIDYIMIKKRYKNGMLNVKTRPGADCYSDHVPVVGKFRIRLKKTHMSKNKNMKLNMALLQSNKEMQDKFRITVQNKFGPLEEIQDIEKQWEQLKTSINEAAKDVIPERTTKAKKKWMTEEILNLMEERRTNKNNXEKYVNLHKEIRHKCNLAKETWLKEECEEMENHSNANSKDLHRKIKEVCHTRTRGSTGCLKSKDGNIIMDKDKILERWTEYIGDLYNDKRDEQRRVENNNEGPPIMKEEVIKALRKMKNGKAAGPDNITTEMIKALEDFGITTLTKLLNNIYATGHIPSDLSKSIFIALPKKPNANECETHRTISLMSHITKILLRIIMMRIRNKILPEIAQEQCGFIEGKGTVNAIYVIRTTIERALEVQKDLHLCFIDYTKAFDKVRHDKIIDMLEVLNIDGKDLRIIKNMYWDQTAAMRIENDISEYIQIKRGVRQGCVLSPDLFSLYSENIMRHIEEMPGISIGGHNINNLRYADDTVLIAEDEEHLQNLLNVIVQESDNMGLSLNIKKTETMVISRXTPIPTCNIKINDTTLKQVQHFKYLGTIISSDGRCHTEIKSRICQAKATFHKMKQILTNINLSLETRKRVLKSYIEPILLYGCEAWTINKQLERTIVATELWFIRRMLRIPWTARKTNEEVLVEANYRKQLITNIRKRQANFFGHTMRKEALENIVTTGKFDGKRGRGRQREKILDKMTTWLGAARTTDTIAAXKDRXKWRSMIAHASRQGTG

SEQ ID NO: 3042 - protein, 1308 aa, synthetic construct
  source 1..1308: note = Description of Artificial Sequence: Synthetic polypeptide
  VARIANT 9: note = Any amino acid
  VARIANT 150: note = Any amino acid
  VARIANT 170: note = Any amino acid
  VARIANT 204: note = Any amino acid
  VARIANT 727: note = Any amino acid
MHTSLHNPXTNKMPLRQMKLYELGCRLGYQGPRSLPSPGGGSDKSATGTHTAGIGATSNTQTLNILQLNISSIQNKKMELAKTLSDLRIHVALLQETQLPKRIELHLTGYTMYHCKCTKCQGIATLIRNDITAEVSHPETDDETDMQEVXVQQSDGTTYTIYNVYCPPRXTLQLNFPNTDHKHTILAGDFNGHSPLWGYSDTDXTGTVLEELLRSSNLISLQNDKTPPTLLHRASGTLSRPDLTLVSADLHPHCSMTVLDDIGSDHRPILLQISSNRKREPTNPIRRSWNYKKANWELYQQKSESRLLDVCTTNPIDECYKDITTALKTSAKEAIPRGNPKKFRPYWDKELEQLTKARKKARRRAEKNPTAENRKHYNYLTAKVKLKTKSAKRQTWREHCGELDLRKDGRKAWNLLTNLSGTKRRKNPAPMKPTEKGETCRAEVMNKYFASINKKGNQNKLSHAIKQLTKRAERTPKANLEVFEKEFTLTELKAALKKCKKRKAPGPDHVTNEMILNLTDSSLSILLGFFNRTWNEGQLPTEWKKANITPILKKDKPASQPSSYRPISLTSCLGKVVERMVNDRLYWWMESTGTISTSQAGFRKGKRTMDHLIRFAQKTSDAFQDKDNVVAVFIDLRQAYDRVWRQGLFYKMQKLGIAGRMYSWIKNFLSCRTIQTSCDSKISSQRTLEEGLPQGSALSCTLFLLFMNDLPDVISCQKALYADDLLXWSKGSDMRALNQAINADLTTISSYCQLWKMEINTDKTVFGLFSLKNKVTASQVNLKINGTTIRHEDYPKYLGVQLDRKLSLKEHLGELTKKATSRLNLLKHLSSLNWGADKATLRQLYIGYVRSVIDYSLPLQSIASQSSLAQLDRVQNQALRFVSGAMKTTPTSACEIHTNIEPLDLRRKSATLETYERFVRLEDTNENRKMADEWEPRTRIQKTSFMREATKLLEEFDPPENREPITNISSEPPYWQTPEITIRTRLLDPSCDKTTPEEILRTSALETVDSYAETPIHAYTDGSATNATRNAGYGSTIKYRNNLGEKKQTQLFGPCGTYSSNYDAERIAIVKTLEQIAQDFFEGAVTPGDVVVFSDSMSVLQAVEGGGDYRGDGNILSLVKQMGTSYGVRVTLQWVPGHSGVPGNETADHLSKTGASLPQTDTTASLQTCRGIIQAKSRDEWLNRWANAETGRSLFGYMDKPNPKDPSNLLCRADQTLIFRARTGHLHTNKHINRINPMWEPHCRHCDYHEETVEHLLLHCPNLAVLRRRLLHTPTDLQSLLYSGVDQMTRTCGYLREALRCQERNARS

SEQ ID NO: 3043 - protein, 994 aa, synthetic construct
  source 1..994: note = Description of Artificial Sequence: Synthetic polypeptide
MKDSGQSRKDSSDPKPSLSNKSLRIASWNVRTLYEAGKSSQVVQEMKRYRLHILGVSETHWIQSGQKQLSSGEQVLYSGREDKYHAEGVGIILSKYAQKSLRGWEPHGERIIMASFTTRSKSINMNIVQIYAPTNDASDEDKDAFYSQLQGVIDKLPRKDVNIIMGDANAKIGQDNVGYERIMGQHGLGQMNENGERFANICAFNSFVIGGSVFPHKRIHKATWVSPDGVTENQIDHFCISRKFRRSLEDVKVQRGADVGSDHHLLLAKLKLRLKKHGTSTGIKRTKFQVSLLDGHKKEEFQLQLRNRFQPLADLGGEDTEVDTHWTKVKEVFTSTCQEVLGGKKWEHKEWISQHSLDLIRIRRQLKAEANASRTRGSRADALEQYRTTAKDVKKSIRKDKEEFMNRLAEKAEEAAVGGHMRILYQTTRTLAGKYGKPEVPVKDQEGKSIFGKEAQSKRWVEHFNSLLNRPPPSNPPNILPARNELPICCDAPSKQEILDAIKKLNKGKAAGPDQIPPEALKADANVTADILLPLFTRIWNESKFPKDWKEGHLVKLPKKGDLSNCSNYRGITLLSIPGKVFNRIVLERIKTGTDPRLRDEQAGFRKNRSTTDQIATLRIIVEQSLEWNSQLIVNFLDYEKAFDSIDRATLWKIMRHHGIPQKLVNLIKSMYEGTSCRVVHDGQLTDSFDIKTGVRQGCLLSPFLFILAIDWLMKETTRGHRNGIQWTPWTQLDDLDFADDLALLSHTQEQMQAKTSVLNSLSESVGLRIHPGKSKVLRTDAQRKEQVTIEGKALENVESFCYLGSIIDREGGTGAEIKSRIGKAQAAFISLDRIWKTREISLRTKLRIFNSNVKSVLLYGCEAWNASQTCIKRIQVFLNRCLRKLLRIRWTDRVTNVEVLRKTRQIPVRDEVGRRRWRWIGHTLRKSGSCITKKVLDWNPQGKRSRGRPRGTWRRITEIDVQKSGKTWNNIKRLAQDREKWGVFVRGLYPGAG

SEQ ID NO: 3044 - protein, 1114 aa, synthetic construct
  source 1..1114: note = Description of Artificial Sequence: Synthetic polypeptide
  VARIANT 1041: note = Any amino acid
  VARIANT 1047: note = Any amino acid
MSPRVTFDDGSDYSVALISYRPSQTGQPPVSKVLIRHVCLLLWVYGARTKTERQTLNPAPGKKRVKLTPWKLGTWNVRTMTTGLDTTNLEKTEDIRKTAIIDRELTRLNVDITALQETRLANSGTIRERNYTFFWKGLGEDERRIHGVGFAVHNRLLNRISTPQGISERITVMEMETKTGKAHFISAYAPTLTTENEKKDQFYEELQDAINNVPKADQLFLMGDFNARVGTENKVWPTCLGPFGLGKINENGQRLLEFCTNNNLCITNTFYSGKDRHKVSWCHPRSGHWHQIDFIIVRKKDANMVKQTRSFYSADCNTDHLLVIAKAKIVTKKTPRAEKQKKPKINIRNTKDPALKAKFQEHVKEELQHLDSSSPDNMWNSMRSTIYNSASITFGIERPCKEDWVEASASTLAPLLEKKRKILIEHNTNPTESTKQQLRAAKSNLQRETRKCANQYWDKLCSEIQQASDTGNIRKMYENIRVAIGPTANKVAPLKSATGEQLTDKKKQMERWVEHYSDLYSEERHVDRQLHEAIPQLSEMSELDTTPTEEELSSAIDELACRKAAGNDNIPAEVLKENKETLLPYLYKLLTTCWLKAEIPHDMRDAKITTLYKNKGDKGDCNNYRGISLLSITGKAFARIILKRLQKLAERVLPESQCGFRSNRSTMDMIFSIRQLQEKCREQRLPLHTAFVDLTKAFDTVSRSGLYMVLGKIGCPPILLQLIISFHEDMKATIQFDEGCVLAPTLFSTYFAVLLQHAFKESPGDVFLHWRTDGSLFNLARLKAKTKINKTTVRDLLFADDAALVAHSESTLQTMMDRLSTACKVFSLVISVKKTVILTQEGAEQSHIWLNDKELETVDKFCYLGSTISSTTSLDYEINIRIGKAATTFGRLTKRAWENKRLTIKTKIKIYEACVLSTLLYGSETWTLYSRQEKRLDIFHLRCCRKILGISWRDKVTNVEVLARANLQSMTTILCLKRLRWLGHVKRMDDNRIPKQLLYGELAQGKRQRGRPKLRYKDTCKNSLSKLGVDVSIWEEIAEDXKTWRKXIKERTKMLENSLRNNQAEKRQRRKENSGNTELRSTTLTCKHCDRICASNIGRISHERSCMKTTLRPS

SEQ ID NO: 3045 - protein, 827 aa, synthetic construct
  source 1..827: note = Description of Artificial Sequence: Synthetic polypeptide
MGDFNGRVGERRTPWTKHLGPHSDHRTPCNYNGNHVLELCAEHDLFITNTFFQHRASQIYTWYRWNNIMVSSQIDFILTRTRMRITITDSRAIPNAGLDTDHRPIITTLTTKKERKPKKHKRQQERLNMHKLGDDQVQAQIRSTLNEKLGSINSTILTVEEAWDTFKTTLLDTMKEVCGTKKTRGKHRKATAWWNEEVKDAIKEKKRLYNVWVKSKNEEDYIKYRLARRHSKKVVITSKEKSWTQYGEKLSETCKTSPREFYKKVKTMRTRDEPYVPTTVINDTNGEALHEEKEIIKRWEEYFQELLNPSGVQAQNTQCPFTANYPEHSEPTILESEVREALKTSPKNKAAGDDGITTEAILACGETGIHWLTIIFQKAWKERKVPADWQNAIVVPIWKKKGSKKDCNTYRGISLLSHAGKMYAKILERRTRAKTEHLLSDAQFGFRKGRGCTDAIFALRQLCERALEYDKDLHLVFVDQEKAFDRVNRNKLWKILEQYDIKGQLLDNIRAIYANSRSAVRTTSGTSDWFPVTSGVRQGCNLSPLLFVIYMDQITKEANPDPEALNELMFADDLAMINNKTQLQEHINQLNASCEKYDMKISISKTEVMTISRRPGKVDININGSQLKQSREFKYLGSIFTENGKLDREIETRCQRANAVSYQLGPLLKHPNIPMSTKAKLINAIFLPTLTYQCQTWTLTKALERKLVTCEMKCLRRAVNKTRRDKIKNEVIRDTVGATPVLPHIEKQKVKWFGHLTRMPSNHPALRAYNIKYSGWRARGRPRRRWSESVADTLKDHGMSLLQATRLAADRHLCLPATPQGTSGRKK

SEQ ID NO: 3046 - protein, 945 aa, synthetic construct
  source 1..945: note = Description of Artificial Sequence: Synthetic polypeptide
  VARIANT 763: note = Any amino acid
MLGAHDLNLILPKGTITWKSRGSQSTLDLAFVSNALESTVMACKPAFDLEASSDHIPICTQLHIEPPNREEQQPRPQWKKADWEEVNRRLALKLSRLSTDHLELNSPESIDQRVSAITQAIKETIPTARPSTFAKPYWTKECSETVKEARKARRLWTKLGSEESWVEYQKATNRKKSQIKKAKMIGWRAIVSEATNDPAKLWKLAKWAKKSPEERSRLPQLPDIKDKDGNMFTEDTEKADILAQHFFPQPVQANLEDIDGTRYPEELTTVSSIITASEIQDTMANLASEKAAGPDGISNWMLKNCRITLGKVLEKLFNACISIGYHPKGFKESVTIVLRKPQKESYDNPKAYRPIALLNTLGKVLEKLVANRLSKAAEAHHLLPDEQMGARQLRSTISAVELITEQVHSIWGKNKRRVASLLSLDISGAFDNVSHKRLIHNMRAKGIPRWTTQYIESFLEHRTTSMNLGSFKGEQFPTSTGIPQGSSLSPILFLFFVSTLLPELQSPSSTAVGFVDDTNILTWSNSTEDNCRNLERLHGICEKWADRHGVKFAPEKYQLMHFSRARKRHNMQATVQIQGHLAKPQPSLRVLGIHLDPKLNWGAHVKSIQLKVEPQIQALGRLAQSTWGATFHKAKLVYNAVVRPAVTYGSPIWAEPGMAGKIPERVIKPLRSIQRRCLKIVTGAYNSTSSKVLEHETSTLPMEIYLKQRRVQHAGLSKSLPVQDTISSACRKIKQPRAGRQDARAVTRIMDIADWGKIGANIXTKERQKAAGKIAAFKEWERSWTRLAARQPTNHHATADPKIWNAANIFTDDKTGRTRMDQRGTPSSLHKHLSRAQSSIAMQIRSEHIGFNSYLHRRKVPGVDSPRCQCGYPSQNVKHMVMACTSWAKGRGEILRKAENRSFEAMMNNPKDLARITRWIQQEGRLEQFRLTLEVEATMRAREEG

SEQ ID NO: 3047 - protein, 337 aa, synthetic construct
  source 1..337: note = Description of Artificial Sequence: Synthetic polypeptide
  VARIANT 85: note = Ile or Leu
LLQKLINFGIPSSFVSWFAVFLADRTFSVKINDSIGDTSPTIPSGVPQGSVSGPLLFLIFINDLLLSLATIPLLHIAAFADDIKXFSNDPFVVQTGIDTVVGWAKSNSLPLAHSKTALLHLGSLNPFFPYTIAGNPIIPTSSVRDLGLLTEPNLKFSAHINRTVALALLRSKQLLKSFKSSSPQFYVYLFKCYVLPLIEYCSVVYCPPSTSKLSLKLEYPLRFFTKKVFHRCNISYTSYPDRLAHLDLFSLRHRRLKAQLQLLYNFLSGSSYFPNLDSHVRFSSSPRRPMNLVNVNPRVKDFFFITVPIWNAITCHCPTFLRPSEFNSLLQCSIQRF

SEQ ID NO: 3048 - protein, 1023 aa, synthetic construct
  source 1..1023: note = Description of Artificial Sequence: Synthetic polypeptide
IGLAGHYRVSRDTTFALNSNPSCLSPPHPASAKGKTVPGARRKRRSNLGVQTICQSDLEIKKPRDKTRRTDYRVCTFNCRSLSSDDRLAELLEETRRIQFDVIGLCETKRAAEAHLIHHDGTGVFLGKRNESSVSGGVGFIVRSTLLPKIVEVRFLSHRIGLLTFKVSRKFNCTVIQVYAPTADSDLEEICDFYDSVEDVFRECRSKYKLVIGDFNARMGCRQNNERYIGPHAMEPRNDTGELLATFCETNRLWHTNSMFKKPMHKRWTFVSPDGNHRHEIDHILANGKFVTDTTVLPSFTNGSDHRLLRCNLHFNNCLAKLEQVRRRKPPKRVLDPAIAYAISATVTVQSDPDLDTDYDNLIQSLKELQDQAIVRPANHSSNRLSEETRKLLNKRRFMDRNDPQFKSISDKCREAVQKDHEAFASTRLLSAANQKKSLKRVARDINEYKSVIPCLKSTSTGERITSRVKMEQEIEKFYTELFKSAVSNSQTSSIPATATPPPFLPEEIRHVLRSFPNGKAAGQDKISADFLKSCHDNVIDLITDRFNRYLHSRNVPKPWKTSKTTLIFKKGDRENLENYRPICLLPVLYKVFTKCLLNRMRRSLDEAQPVEQAGFRRSFSTIDHIHSLQRLLEVGREYQIPLTLVFIDFKKAFDSVEHQAIWKSLDEQGADGAYIDLLKECYKNCTTNFTPFHRPVAVPVTKGVRQGDPISPNLFSACLEHVFRKLSWIELKGEAEDYDTIPGMRVNGRNLTNLRFADDIVLIANHPNIASKMLQELVQKCSEVGLEINTGKTKVLRNRFADPSKVYFGSPSPTTQLDDVDEYIYLGRQINAQNNLMPEIHRRRRAAWAAFNGIKNTTDSITDKKIRANLFDSIVLPALTYGSEAWTFTKALSERVRITHASLERRLVGITLTQQRERDLHREDIRTMSLVRDPLNFVKKRKLGWAGHVARRKDGRWTTLMTEWRPYGWKRPVGRPPMRWTDSLRKEITTRDADGEVITPWSTIAKDRKQWLAVIRRNTTNS

SEQ ID NO: 3049 - protein, 473 aa, synthetic construct
  source 1..473: note = Description of Artificial Sequence: Synthetic polypeptide
NMKQPAKRTVMTCLDQRAAFDKVPIKKLCVDLHESLNEAKISKWLTNYLSKRIIKANFGNHSSKWCTLLGGVPQGSVLSPNLFSFYMRNMPIHPKTEITVYADDTTILAQDTNPFKAGELIQEHLDLLYDFFNERKMSISAEKSTTTLFTCDTKEFKTKIPVNWNGAEIPTTNQVRLLGVHLNTMCGSKDHVAETRKKMMVSTNILKALSGTKWGCSKELLISTAKALVKPIAIYGAPAWSQLLSETNLNKLEAAYRNTLRTCCGLTSDTPIEHIYAEAQMMPLKEEFELAKQQTYIATTKSGTHPNRNLESRRNTERRSNRPREPPLNLQEATKTHLSRLKGTKAEAQKANHTRFVREFLNSAPPNRILGATPPPLNSSEESSLPKATRTELARLRCGHSLLIPRYKARIEGTPIGTCGCGDNEGGIDHYLSCGRSHPISKEKLWTSPMEAARALGLAYKPYDPGGGATTSV

SEQ ID NO: 3050 - protein, 726 aa, synthetic construct
  source 1..726: note = Description of Artificial Sequence: Synthetic polypeptide
MPTRKSKILDVALSNSVISNLNIMAPIGSSDHNTIKFTVQLLQNISVPKKMIPDFSKLDWPCCATYFENIEWGKVFDTHSHVNDIYECFLGHIRTMFSQAVPTMPMPETSKPVPQYLRSFEQMVKNQFSKTIMSKTMNDFIEYIYLARKYRKKLRKYLSNLEVKLFKKKGNSKFSKHAKTLLKPRNCSVPALIDNDENEIVSELDKANLLASYFEAQYTNQNNTNFALDDDFVSDQPIPWVTDAEVLKVIMASKKSCSVTSDQVPFTFIKILSPLISSVLAQIFNLSMMRGQVPHAWTESIVIPLDKITNANNPTDFRPISLTSHLCRVYERCILAKIELFLIDNKFWSQNQHGFRPKKSTVTNMLESLNDWSKSIDLGEQIDIIYLDFSKAFDRLPHDLLLDKLVSLRMNKNLLIWLNEFLSNRSFRVRIGQTLSSRKLATCGVPQGAVLSPLLFGIYVNDISSILPEKVACKQFADDTKLYVSTPKTESENNLQSALDAVVDWTRGSKLTLNQSETVHVTVGKRRTDFKYHLDGYPIERKAITRDLGFLISEKLDFSEHWRKCINLAKFQLANMFNQYSTSNKKLMILLYKTFIRPRLEYGTVVSSPTKKSDEKAIESVQNAFTRRLYSRIKKRYINPTDKDYKTAMERNELFDLQTLSTRRKIIDRIQVIRMNNGKVDLKTSEFFEQQETHTRSKKKYIWSTGKSKLRRHFFVNRTLATMKQH

SEQ ID NO: 3051 - protein, 605 aa, synthetic construct
  source 1..605: note = Description of Artificial Sequence: Synthetic polypeptide
  VARIANT 7: note = Any amino acid
  VARIANT 8: note = Any amino acid
  VARIANT 9: note = Any amino acid
  VARIANT 12: note = Ile or Leu
  VARIANT 13: note = Any amino acid
  VARIANT 17: note = Any amino acid
  VARIANT 35: note = Any amino acid
  VARIANT 37: note = Any amino acid
  VARIANT 38: note = Any amino acid
  VARIANT 42: note = Any amino acid
  VARIANT 43: note = Any amino acid
  VARIANT 44: note = Any amino acid
  VARIANT 47: note = Any amino acid
  VARIANT 48: note = Any amino acid
  VARIANT 49: note = Any amino acid
  VARIANT 50: note = Any amino acid
  VARIANT 143: note = Any amino acid
STKLDLXXXEDXXFNEXHLNKSSPKAFFNFINSRXKXXQEIXXXRDXXXXQVTSDYMKAELLSNCFSNAFTEDKNTNTDFPYRTNHFINSLCFEPFIVESILSKLTPKCNTTPDGIPAIFLKRTCTSIALPLSIIFRNSYNQXVLPSFWKTALVKPLHKKGSRSDPNNYRPISLTSAVGKVMEKMVRKSIILFLDDFKLLSNSQYGFRSKMGTESQLLSYQNKLVTNYLSKQTTFSVYIDFRKAFDTVGTKKLLIKLERYGIRNHLLRWLENFLSNRTQRVIINGVMSEEKSVLSGVPQGSVLGPLLFLLFVNDIGDNFNSDYLLYADDLKIFSTDKSSIQRDLDSLSTWCENWQMSVAPNKCETIAFYHSKRGMDKDTKFTIGGATVPITSRIRDLGMFFTSDLSFSNHIDTVLRKAHQRVNIFFNVLRHAGFDTFIKCFIIYVRPLIEYGSIIFSPTLKDLVKSVESVQKSFLYRCFKKFRIEYISYFDSLSYCKLESLEHRRLIIDLTFLYKLIVSKEIFIHNFTCITRSPLPSLRRHPYIVRSTLRNSSKLSHQFFSNRIITCWNSLPSYLFPKLICSETFKSALKCLDLSKFLTLNMHNY

SEQ ID NO: 3052 - protein, 960 aa, synthetic construct
  source 1..960: note = Description of Artificial Sequence: Synthetic polypeptide
MFGRSTTDTEITEASYGPKNRRKGNDFHIGSLNVRSISDQSKAEAFDLLAVNSGCKVIALQETKRKEGEWVLSSGAELICTRREAREGGLAFWIHKDWLDSLVETKRESDRISTASFDFHGSHLHVINVYAPTSAANETQSDKFYKDLKKVYTRLSKWDSSIIICGDFNAVVGCSSDDLPFVGGHGTGQRSDNGDRLVNFAFSSRVSILNTIYPKRPNRKWTWISPNGKTKNEIDFILTNRREIAVDCEVYCDYLNCSDHRLLRARFRSTAKKEKSRKFAKTKRAGGERSWDPVRFKNTITEMLTENPPTCYEELTESIRSAASTATHATHQLSRISEATKKMMLSRFQMIHAGQTKNADLAKINNEVRRSLENDLDKWREVKSLEAAVKGRSLKKTKRALTLKSSPFTNLERPDGSTTYNRPEIRKLVLTHFSNLYAATTREPRSRYNHPDEPEILQHEVEHAIVTSKTNISPGPDQITMLQLKLGIESIAPHLTAALNQVLTNGRTPEDWKTVKISLLPKTTKPKKVKDYRPVALSSIVSKLFTKILTRRITAKSEDYLEESQAGFRRGRGCADNIQVVAQMWEKCTEFKIPLVAVFLDFTCAFDNVNWTKISEVLNNLQIGRNVIRALNNSNSSAIGELNVLNKKMRFKIKRGVRQGDSSSPLLFALALQAILDELDPAPCEDDKTGIDINGESIHRLEFADDVVLFANSVKEAEDRANRIAMGCPKYGLNINPSKTQILMNKYVTRSDIDILNTRIEISQKVKYLGRTFADDGSLTEEVARRIRAGWAAFNAIRRELLQSPQKIRIRLLTTTVIPAMTYGCETWTSKEADTKRLQRAVSNMFEIAGCDPPDMEKQVLRRKLKWAGHVSRMKYDRWAKIASEWDPRGSARPRGRPPKRWADDITDSIKIFIHNEALRGNLGHGRRRIGILEARRAWSTVGRDRVTWRSLVRSIQDGN

SEQ ID NO: 3053 - protein, 959 aa, synthetic construct
  source 1..959: note = Description of Artificial Sequence: Synthetic polypeptide
  VARIANT 38: note = Any amino acid
  VARIANT 43: note = Any amino acid
  VARIANT 57: note = Any amino acid
  VARIANT 128: note = Any amino acid
  VARIANT 150: note = Any amino acid
  VARIANT 187: note = Ile or Leu
  VARIANT 367: note = Any amino acid
  VARIANT 520: note = Any amino acid
  VARIANT 655: note = Any amino acid
MPTNHSQRTLMPRRCKYERTRQRIFSRIQKTNFAQHRXFNFFXHSPDLILSILSANXRSLMANKLEFQYIVNTTSPDILCIQETWLSSKFGNASFLDPNSNYHVFRADRCATSRGGGVCTLVKKEFPXTIITAETKNSAYELITVDIDVXVTPLRIINIYRPPSCSFENTITLLNKVSDLSNHVGQXVILGDMNINGINWNSAVPTSQTRLGSLLCDFCNQNNLTQYIRKATRKENLLDVVFSNSRLSDVRILSPIGSSDHNSINFKLDILQRPPEKKILFYDYKNIKWPKCLDYLGSIDWGRLLHPGNSISTMYQNFIDHMREAFELSVPKIYVEPTIRNTPDYLKSFYKLVQLKLERVKASRGRXDFLDYIKTAKKFRKKLLKFRRNEEVKLLESSGVSRFSKKAKYLLKPKSLRIPTLTNPLGVLSVTNAEKAEILADSFESQYVNRPLLNFELPSNFKSPQEIPWVTDAEMLSMMLKCKNSCSQTPDNVPYKFLKLIAHLISSPLAQLCNLSMMRXECPSLWKESIVIPLNKKEKPMAPTDFRPISLTSQLCRIYERCLLKKILQHLDTIKFWNNDQHGFRPKKSTVTCMLEAVNDWTESIDEGAQVDVIYLDYAKAFDRVPHDILLGKLVDANLNPNLIKWIRSYLSNRXFSVKVNNESSTPKHAQCGVPQGAVLSPILFGIFVNEIPSILPSGIRCKQFADDIKIYTAIPKSDTIEDHETLMQSAIDAVCNWSENSKLALNDSKTLVISLGKNPRTTKYQINNNPIRRETSIRDLGFIITPMLDFTGHWKKAICKAKFSVFQIFNHYCSNNPRLMTLLYKIFIRPILEYGTEISNPTRKLDCKAVESVQNAFTRRLYSRIKGRYLTPNDPDYLTAPQRNSLFNLSSLESRRQTSDRKLILKMISGLVDIDTSPFFTYEKNTRTRAKNKFKWNHCKTKIRRNFFVNRTLSSFKL

SEQ ID NO: 3054 - protein, 648 aa, synthetic construct
  source 1..648: note = Description of Artificial Sequence: Synthetic polypeptide
  VARIANT 21: note = Any amino acid
  VARIANT 117: note = Any amino acid
LINILNELLTELCPRIPERPXSKVCPLLRKLRRLRRYKSSSLSHADIANRLKRYRALASRYRKWVLKHETKLINESNCTSIRKFVSKRLKSKQSIPALLDNGKAVTSDFVKCDLFSXSFMKNFACPPEEYSTPTPSHYGSDSLSSFSSPSSSRCLFLPYIVEKVLQHLPPKCGFSPHLANYLVLKKCATPLALPLSIIFSQSYCESEVPAAWKLAVVIPVHKKGNPACTDNYRPISLTDPIARVMERVICNYIRSELAYKFSPYQHGFLHFRSCTTALASSTAKYRQILKKSKTLDIIFFDFSKAFDQVSHSILLDKLAKFGVDPLTCSWFENFLCDRSFTLKVNNTFGDKLYPVYSGVPQGSVSGPLLFIIFINDLLFSLPPPIHYSCFADDIKIFSDSPEILQSGIDTVVQWSIRNCLPLAPTKTSLLHLGDKNRMLKYFIHGIEIQHSSCVRDLGLITDSSLTFKIHISRIAALANLRANQLLKCFSSQSPQFYAHLFNTYVRPLLEYCSIVYSPSPSSSLAGKLENPLRTYSRRVLQRCNISFSSYENRLEILNLTSTRHNRLKSQLLFLYRIVTNNSHFPNLSDFVSFVKSNRRPMLLVRNDTCTLHFFARTVPIWNSLLRNCSTFLSPIEFSNLLNVNISRF

SEQ ID NO: 3055 - protein, 779 aa, synthetic construct
  source 1..779: note = Description of Artificial Sequence: Synthetic polypeptide
  VARIANT 3: note = Any amino acid
  VARIANT 33: note = Any amino acid
IFXTIILLYWAISIFPQSTGDLLPDSPEFLVDXMTSFHLSQLVTFPTRTSRLGKKNFLDLLFSSNTSIIKNLKAGSPFILSDHCSVLFSLSLATSTIPKPPTEDPQHLHFRKCDFNKLNCHLFSYNWPKQLSYFATADSKLYHFLKIFNELIEQYTPISTKRTVHSKITGKKLYRKLRKRHPNSLSLSLKKRVKSRLKNIRKSFESQEKKVIASKNPRSLYSFIKSRIKTKSTLTHFEVDKKVIQKPSDMADLLVNIFSKNFNTPPPPFPALPSPKPLNTSIDTSPFGIYQVIAKIKPKIGYSKDNINNFIIKNCADSISIPLSLIFGEFLLSRTFPDCWKISTVIPVFKKGNIHDPLNYRPIALTHPLARLFEKVVIGPIRRTFSPKLSKKQFGFLNNRSCTLAHLHASSIFHSVLSYPKSYLDVILIDFRKAFDSVPHELLLCKLSNFGFDTKLCEWFREFLTGRSSIVKIDNNYSSIKFKNSSGVLQGTVTGPFLFLVYINDLLESFPDDVHVVAFADDIKIFGNNRSSLQKSIKIIEEWCSIWQLKLAENKTQVLHLGVHNPRVEYHIGGITIDKCTSVRDLGIWVDEKLQFRKHINIIVNSCMYKVRQILNSFRSSNLNFYFKLFNTYIRPVLEYGCEVFNPCSVSMSTSLEKPLRFFSRAVFKRCRVNYLSYADRLLQANQQTLKHRRVLLILKTYHNIISGWYHFPNISQYIKLAHTPRFPYLLQPRGKWTPNNFLHKYLSLWNKIAKKFPKTVSGATFHLHISALPLDSYL

SEQ ID NO: 3056 - protein, 1048 aa, synthetic construct
  source 1..1048: note = Description of Artificial Sequence: Synthetic polypeptide
  VARIANT 245: note = Any amino acid
  VARIANT 351: note = Any amino acid
RPAPPPPSQHTTKCRAKPAKTRILSWNVNGWSKRRSELATIIAKEKPDIVCLQETKLDKTNLGYTPTGYKVALASRNKFGGGVCTMVRDDWIFTISKTTSKKTAEILSITIDKLMVTNVYFPPRSSDSPTAEVREDVMEILDMASEKHIITGDWNAHAKTWHSHKTDERGAMIEDELDTRGVHVVLNEDSFTRAASGVLSSPDITISTSDLAACSSWRTCGVLNTDHLPVIIDTMAEIPKLVRPXRIMANFKKANWTDFSDSIETKVACYAGPRDAYSLENFLSATITRAASKHIPHGKFTPTREHTGDTGEIAELTRERERIQKRNPLDSNLKALNDKIEAARRELRRLXWHQKIEDMEDKRKIDCNALWRVIKGLKPKTKSTGSIRLPNGTTTTNPKTIANAMASSLVAVGKGRDCREERIAWRRTKRRLKKLRPQLPASSISHAEVKLAILKGKPSKALGPDGICHLHLKHVPDNCINLMAELFNASIDENKVPDSWKKANVFMLPKPGKDPSEIKSFRPVSLLSPVAKVLERIILERIRREIESPKDQHAFKKNHSTTTAITEATSCIVGGLNMEKPACRTIMTCLDMKAAFDTISIAKLLCGLEDAIADKKVCGWLGNYLHKRRINVQYDDVKSSWLTLRGGVPQGAVLSPNLFNFFIRDVPAIPDTKIITYADDMTLLVQDPLLSKAAEKSQDALDSLQKWFKDKHLDISAGKSTVTIFTADTKEFKYDPGLKWEGSVIPMQNRTRLLGVELDTMLRMTGHVEQVSARLAKANNILRALAGAKWGSSKETMLRTFKAIIKPLATYAGPAWHQLMSETQKTKLERQYVGGLKACCGLTKDTPRQLVYHETRMLPLSEELTLGSEQLAIAAIKTPGHPTSDLSRRRPKERTCGNRPRTPPLGCLEDRGDEWRRMRGDTRAVQKRNHTSFVKSYLSNHGIHPILGRQPPALSEEESTLPRNTRVELARLRAERSLLLEKYKAKVENRPVVCCIKCNDDVGDLKHFLKCYPVKPLPMSKLWKDPVAAATALGLAVTPFDPGGDADS

SEQ ID NO: 3057 - protein, 832 aa, synthetic construct
  source 1..832: note = Description of Artificial Sequence: Synthetic polypeptide
  VARIANT 35: note = Any amino acid
  VARIANT 71: note = Any amino acid
  VARIANT 643: note = Any amino acid
MPPGNEDRYRTRGIHSNWLQDRYGPEEQARRRSVXNGQARLGLHDHSIHDEESGLLITNVYFPPRSSDSPXAEVREEVLQILDMEDRKHILTGDWNAHSSAWHSHKTDERGSMIEDELDSRGNHVILNENTFTRAATGILSSPDITMATADIASRATWHTCGVVNTDHLPIIIAMDSEIPKREKPKRVIANYRKADWKGFKTDVETRIRSYVGPRDAYSLEKLISKAILEAAGKHIPSGRFVPTRECQGDTKEMDDLLKKRDEIQKLNPLDGKIAEINDVIEKSRRELRKERWLNKVEDMEIKRKTDSNCLWSLLKGLKPKARSSGPVNLPNGTTTTNAKAIANAMAKNLVTVGEGRENKDEKMAWRRAKRNLVKSKTTLATTITHAEVKLAITNGKSSRAMGPDGLCHIHLKNLPENGIHALAELFNATISENKIPDSWKKANVFMLPKPGKDLTEIKSYRPVSLLSPVAKVLERVILERIKPEIQSPTSQHAFKKAHSTTTAIIEVTNRIVGGLNMPKPANRTIMTCLDLKAAFDTVSIARLLCELDGAIQDKAITRWLGNYLYKRKIRTQFGEEKSKWRTLRGGVPQGAVLSPALFNFYIREVPTIPGAEIIGYADDTTILVQDPILQKAADTSQNALDXMKTWFDERHLDISAGKSSVTIFTADTKEFNFDPGLTWDGTPIPMQNRTRLLGVEFDTMMKMNGQVAKVSERLAKSNNILRALSGASWGSSKETMLKTFKAIIKPLATYAGPAWHQLMSDTQMAKLERQYIGGLKACCGLTKDTPKELVYYETKMMPLKEELELGSEQFAISAMRTPGHPAKDLHTRRPA

SEQ ID NO: 3058 - protein, 909 aa, synthetic construct
  source 1..909: note = Description of Artificial Sequence: Synthetic polypeptide
  VARIANT 287: note = Any amino acid
  VARIANT 427: note = Any amino acid
MMHRDGTGVFLGKRNTTSVSGGVGFIVNSTLLPKIQEIKFLNHRIAYLTFQVDRRLSCTVFQVYAPVADSDPEELADFYESLEEAYTACRSRYKLVVGDFNARIGPRQHTERFIGPHSMEPRNESGELLATLCESNRLWHMNSQFGKPSHRRWTHISPNKLHKHEIDHILANGKFVTDVSVVPSITTGSDHRLLRGNLHFNTKIARFEQVKRRKPPKRVLDPAVAHAITATATITPSADIDLDYINLIAMLKELQDQAVTQPSNHSTNRLSGTTRQLLTKRRFMDRXDPNFKSLSNECREAVKKDHEEFAKDRLLQAAQNKKSMKKVARDIQEYKTFIPCLKSSTSGTRITSRTEMEKEIQQFYSKLFRSNRGPPVIASPIGMEIPPPFLPEEVRAAFRSFPNGKAAGDDKITADFLKSCHDNVILXLTDRFTKYLQSGKVPEKWKTSNTTLIFKKGDKEDLENYRPICLLPVLYKAFTKCVLNRIRTTLEEAQPVEQAGFRRSFSTIDHIHSIQRILEVGREYQQPLTLVFIDFHKAFDSVEPQAIWESLKSQGVQPAYIALLQQCYTNCTTTITPFHKKIEIPITRGVRQGDPISPNLFSACLESVFNKMSWQHLRGDEDDENDKANLLPGIRINGQNLTHLRFADDIVLVASNPKAASLMIQELVEMCGKVGLRMNTNKTKVMRNKFASQSPVNVTLNNVTTCIEEVNEYVYLGRLLNHNNELEPELHRRRRAAWAAFNNIKNTTDALSCPRIRAQLFDSIVLPALTYGSEVWTFTQALSERVRVTHAALERRLVGISLSEQRQRNLHREDIRAQSEVRDPLLVIKKKKLGWAGHIMRRNDGRWTRLVQEWYPIGEKRPVGRPRMRWSDSLKEQISLFDGNHLKTHWSTIAKDRMAWKAVIRDHIR

SEQ ID NO: 3059 - protein, 898 aa, synthetic construct
  source 1..898: note = Description of Artificial Sequence: Synthetic polypeptide
  VARIANT 124: note = Any amino acid
  VARIANT 171: note = Any amino acid
  VARIANT 195: note = Any amino acid
VLVNRHEIQFLIDRAKPDILCLQETWLSEKTPSPTLVNPPSRYQIFRTDRAHEKRGGGVCTIVKSEIPAKVITSETKNMAYEILALDINISTTPIRLINVYRPPTCSYANTLTLLTKISDMTNXNGQIIILGDFNIKNIKWIPAGPMTKDRLGTILSDFCKNNNLKQFVNXPTRKNNILGIVFSNTKLENVEISXPIGSSDHRKITFTLDILEKPTKHLIEIWDFKGINWKVCAAELNLIDWPTIIDPVKTISEIYNEFLTIMRRICELAVPKKRINKELYNVPEYLVTFHKTIENKFDKLLKSRSWADYALYIELSRKFRKKLLKFRRNQELLTLKKSGNSHFTHIAKNILKPKFSMVPTFVDQSGHHATSDHEKAEVLAVNFESQYVNKSNTSFTLPPDYKSDQEIPWVTDAEMLKFIQKCKNSCSDTPDKVPFKFLKLIAPFIASPLSQICNLSMMRGEVPEKWQQSIITPINKIAKPQVPTDFRPISITSQICRIYERCILSKLLPFLDKIRFWNNNQHGFRPKRSTVSCMLESLNDWTNSIERGSQVDVIYFDYAKAFDRVPHDLLLDKLVSIKLNGNLLKWLASYLSNRTFTVKVTKNQSSTKMAQCGVPQGAVLSPILFGIYVNEIPSKLPMGVHCKQFADDIKLYSEIPKDSDPQNNKLQQAIDAICQWSETKKLALNNSKTILISLGKTTKNCDYVINGSPIGRKQLTRDLGFMISPKLDFSEHWHKATNQAKYALSLIFKKYCSDNSRLLTLLYKIFIRPILEYGTVISNPHKKSDIKSVESVQNAFTRRLYSRQKGRYIRADDPEYLSAPERNSLYGLSSLENRRKYFDRKFLTKMIAGNVDIDTRPFFTFFQNTRTRAKTKFIWARSKTKIRQEFFTNRTLTAITL

SEQ ID NO: 3060 - protein, 588 aa, synthetic construct
  source 1..588: note = Description of Artificial Sequence: Synthetic polypeptide
  VARIANT 34: note = Any amino acid
KILVSGSSKNFFKFINQRMKESSDVGMIMDGKTXVYDNYRKAELFAESFGKVYSTDDGQYTTCDLRTSAHLSEIIFEPYAVELELSKLASKVNTSPDEIPAIFLKKICTSIALPLSIIFNTSMRTGFLPDLWKTAIVKPLFKKGSRSDANNYRPISLTSTICKTMERMIRKEMMKHIYGNKLLSNAQYGFRPHRGTEAQLLHYISCIQSNMEKKKDMSSVYVDFRKAFDTVSLPKLQIKMESYGICGRLLNWLSSFLTDRHQSVVLNEVFSPRMVVKSGVPQGSVLGPVLFLLYVNDIGDSLECDTLLYADDLKIFSTDSAALQRDLDRISNWCRTWQMDVAPNKCEFITFNYSKKNSALSFPLMIGNFNLQRTTEIRDLGVIFSNNLSFKSHISVIVRKAHQRINILFNIIRLSTIDVFIKCYVIYVRPILEYGSVVFSPISKELVKTIESLQKSFIYRCYKKFGIVYNSYFEALEQNNLETLERRRLMADLVFIYKWLVSREINIGHDLFISSANLLPLRRHNYYIRCQLTGATRIGSQFLSNRIIRCWNSLPVKTFPVKFSSTAFKNRLQNLSLNNFLLLHFHNF

SEQ ID NO: 3061 - protein, 434 aa, synthetic construct
  source 1..434: note = Description of Artificial Sequence: Synthetic polypeptide
  VARIANT 16: note = Any amino acid
VIPIPKKGSLSSPENXRPISLTDPFARLFERVICEYIKLHFAHKFSQNQHGFLAYRSCTSSLVHSISCYKSSLSSNNSLDVIFFDFKKAFDKVNHKLLLQKLALFGIPHLFIEWFSNFLSGRTFSIKIEDFTDTSITQIPSGVPQGSVSGPLLFLIFINDLLLDLALIPSLQVSAFADDIKIYSSNPVAVQKGIDLIETWASSNSLPLAHTKTSLLRLGSKNISFPYFIAGQPIETSKSVRDLGLITDSTLKFKSHINKTIASALLRTKQLLKSFKSTSPQFYIFLFNCYVLPIIEYCSVVYSPPPASKLSLSLETPLRFFTRKIFQRCNITYSSYSDRLAQLNLFSLRHRRLKAQLLLLYKFLSGTSYFPHLDSYIRFSSSTRRPMNLICIKPKCSDFFSHTIPIWNAITSQSSYFLSPSEFNTLISSSITRY

SEQ ID NO: 3062 - protein, 940 aa, synthetic construct
  source 1..940: note = Description of Artificial Sequence: Synthetic polypeptide
VQKGPNSLAVDNSTKQVKFLSVGYANCFSVKNKLAQLELVTITNNFDIVCLTETKLDNTFPDSLLSLSNNFSVVRKDRNKHGGGVAILISKSIRFLPIEIPSSLLSSEIAGVDIMAGGVSIRIVVGYHPSHHSKLDGMISCLEFLLSTRKNCVILGDFNMPHISWPSLTASDSHCKKFLSFVTKNGLTQHIASPTRLKPDNILDLCFTNTDILRDVRVGDLFSDHKLIHVTLSVKNRTKKLTKEVKLFRKADYASINYLLSNTDWVLRFSNLNADGMYENLLSILHELIASYVPVKAINTLSKRHSAEILKLQKAKLNVWRKEGNSTNYKNISADLKVALIKEERRVNDEKLTNGSVKDFFKFINSRYKDNQEIGTLKNDSGAPINCDSEKVELFSDSFSKVFTEDNNVQPHFDKRTEELVSSPDFEPYIIEHTLSKLTPKLNTTPDGIPALFLKNVCTAIALPLSIIFRESFRTSIVPTAWKTAIVKPLHKKGSRANPNNYRPISLTSSVGKVMEKLVRKQLTNYLNSNRLLSNCQYGFRSSMSTEAQLLSYQADILTNYICKKTTHSVYIDFKKAFDKVSLSKLKIKLRSYGIHDDFFNWLCAFLTNRTQRVCINNVFSSDRSVLSGVPQGSVLGPLLFLLFINDIGDAFESNYLLYADDLKLFSTNADCIKKDLVRLSVWCDNWQMGVAPEKCEVISFNHSKKHSNSASLNFSINDAIIPQTKIIRDLGIIFNSDLNFSNHLDVTLRKAHQRVNIFFNVLRHADFEIFIKCFKIYVRPLLEYGSTVFSPTSKEQVRLIESVQKTFIFRVFRKFNIPYISYFESIKHCDILSLEHRRIIIDLVFMYKILVSKEVRIYNDVHISLPRFSNNLRRHPYYIKSKLSNSTKNTCQFFTNRIISCWNKLPPHIFPSFPNSDVFRCNISFNFVEPFLILKHSNF

SEQ ID NO: 3063 - protein, 1066 aa, synthetic construct
  source 1..1066: note = Description of Artificial Sequence: Synthetic polypeptide
  VARIANT 82: note = Any amino acid
  VARIANT 212: note = Any amino acid
  VARIANT 711: note = Any amino acid
  VARIANT 771: note = Any amino acid
  VARIANT 943: note = Any amino acid
  VARIANT 978: note = Any amino acid
  VARIANT 1000: note = Any amino acid
  VARIANT 1033: note = Any amino acid
MLDTADSGRPERRSALIAHELSRLNIDIAALSEVHLHEEGSLKEHGASYTLYWSGKPKTERHLSGVGFMIKNSIASKLENLXTGHSDRIISLRLPLHNKQHVVLFSIYAPTLQADHAEKVKFYTDLRRLTQKVPAGDKIIILGDFNARVGKNYEAWKGVLGKHGVGNCNDNGRLLLEFCAEQQLTITNTIFQQKDSLKTTWMHPRSKHWHLXDYVLVRQRNVGDVRHTRAMPSAECHTDHRLVRCKLTLYFKPKPKRGGIPRRRLKVNDLQKDTVRNSFQVNLQARLLDHPIDPSPEALWQHIKNSILQSSEESLGFSSKKNKDWFDENNQEIQELLTKKRTAHQAHLAQPSCHVRKAAFHLACSKLQQKLRDIQNKWWINLAEKTELCAVTGDHRGLYEVLKAVYGPTHQVQSPLLSADGQMLLTDKTSILNRWSEHFQTLFSASCVVQGSAIQHITQQPVKTELDIAPTLGETLKAIQQLKTGKAAGVDGIPSEVWKHGGQALHAKFHELLVSCWEQGKLPPDLRDAVIITLYKKKGEKSNCSNYQGITLLSIAGKILARILLNRLVPAIAEEVLPESQCGFRANRSTTDMVFVLRQLQEKCREQNKGLYVTFIDLTKAFDTVSRKGLWQILERLGCPPKFLKMIILLHEDQQGQVRYGDALSESFPIINGVKQGCVLTPTLFTIFFSTMLQRATADLDEENGIYIRYXTDGSLFNLRRLKAHTKTLNHHVPELLFADDAALVAHTEAALQRITSCFAEAADLFGLEVXLKKTEVLYQPAPQEDFHHPHITIGESELKSVQQFSYLGCIISSDAKINKEIDNRLAKAYRAFGRLHKRVWSNKHLKKSTKISVYRAIVLSTLLYGSESWVIYRHHLRLLERFHQCCLHTILNIHWTDCVTNVPVLEQAGVTSIEAMILRTQLCWAGHVSRMEDHHLPKIVLXGELATGCRNRGAPKRRYKDSLKQSLSFGHTDCHQXSTLASSRETWRHTIHNAAASFXNTHRISLEEKRQHRKNRALAVPSQETFCCAFCXHTACPTLALSAISVLAASVGRALLKSSFVKPSH

SEQ ID NO: 3064 - protein, 1088 aa, synthetic construct
  source 1..1088: note = Description of Artificial Sequence: Synthetic polypeptide
  VARIANT 129: note = Any amino acid
  VARIANT 831: note = Any amino acid
MTSLTTMAAIATTHARTDWMTNQPNMAERTDNDSLVIGTYTATVHLDSTDNDALLRSHYNLNQVLQTNQQEQDNTPINFSPYYDHEHLIQHLAQPTNNVKFKILSLNCQSLNAKFDQLMILIAQLNHNXVIFDAICLQETWIKESELPPVFNIKGYQAIHQARHCSGHGGLLIFLKDSYKFKIIPFEKSAVWESQFINIDFENGNKDSLLVGNIYRPPHKVKDDLDLFSNQFTRNLLQCSKYKNIAIAGDFNINLLDVNSTTSPAAHDFPSSIISNDFLPKITLPTRISESSSTLIDNFFCKLKNDSTSSGVVIHKISDHQAYFTCLPIRSNKIHNIEKIKMRRVSQESIIAIGNDIRNATGRLDLSTETDPNVNYEALMETLHDSMSQHIPIKEVKFNRHKHKGSSWITAGIVRSIRERDKLYCKLIKAKPNSNKRESIKLTLQLYTRILQNIIRKAKSSYYSMHFAQLKNDMKKTWKAINDILHRNKNSLNRNYPEQFKINDQLISDKNIIAEEFNSFFTSVGKILASRIAHNSTNTATDYLSGNVTSRFVLQKVSESDIERIIAQLKSVSSCGYDMVTPKLLKALSPFLIMPLTIIVNQAISTGIFPDSLKRAKVVPIYKKRCPFIKKDDETVLTNYRPISLLPAISKIFEKVIHNQLQHYFTSNDLLYHSQHGFRPKHSTELAALQLLDQITTDLDANKIPIAVYLDLSKAFDTINHNILLKKLNYYGITGTAYEMMKSYLTNRKQYVSFADCNSRDIMIDTGVPQGSILGPLLFIIYINDLHKSCSNFLPIVYADDTTLYKTINSPNSINSINQELEHVNLWLKIXKLSLNASKTRYMVFHKPRKRLPTLNISIDNENVERCISFNYLGIHLNQNLTWNDHIKRTSLKIARATGRINCLKHFLPKKILLTLYNSLILPHLTYGILAWGAKSNDIAKLQKKSVRIITASKYNAHTEPLFKAHHLLKIEDIYKVYQLNFYFKWKNGNLPKYFNSFSCNTNRDTHSYHTRTTSTVSARVNHEFAKHSLRHSLIILLNQTPNIITDKITTHSYHGFSSYVKNYYINTYTNVCYNSTCYICRNQQQLL

SEQ ID NO: 3065 - protein, 873 aa, synthetic construct
  source 1..873: note = Description of Artificial Sequence: Synthetic polypeptide
MTMYIKDHIDYTMLDIGEDTCEVQAARLLMEQGQATIFASVYRSPNSSKENSDNINAFIRNFSNERAYTLIAGDFNYPTIGWKTMTGRTEADIEFIEALRDGFLIQHVDRPTRGRGSNNPSLLDLVLTKEHTATPTVEYHQPLGKSDHSILDIRIEMKQSETFIKTIPNYNRGNFDRMRRVLSDVDWEEGLGREETTQKKWELFHETITNAVNRCVPKIKIKRKVLKNIPVDNKTLTKIRRKKRLWKQYLETGNQTIYHDYCRTRNQVRQLTRKNMRELEKNIAKEAKTNPKKFWAYANQKTKYRETIPQLLKTGNPNDGMLTENNQEKAQTLATFFNSVFSEKPNDHWNLSPSSYPTIEQDLIITEASVLHHLSKLKKTKSPGPDGIHPRILIEIKEIIAKPLSIIYQHSLDQGQLPDTWKTANITAIHKKGDKRIAGNYRPVSLTSVPCKIMEKIIRKSIMDHLIRNNILSNKQYGFITGRSTLLQLLTVLDQWTEILDRGSEIDVIFLDFKKAFDRVPHQRLIDKLEYYGINGKILTWISAFLINRKQRVTIHEATSAWAEVKSGIPQGSVLGPTLFIIFINSLPDVTSSPTFLFADDAKIFREITKPTDSLLLQEDINNMYHWTLESLLTFNPDKCSSMTISRSGTNHRQYQMNNSPLNKTIIERDLGVILDNRLTFDHHIQAKIKKSNSIMALIRRTYTYLDNHTFLLLYKSFVRPHLEYANQVWKPHLQKHITAIENVQRRATRILPGMKDLNYEQRLRKLKLPTLQYRRIRGDLIETYKIATEYYDTQITQNFFQFNSRTSRGHPLKLYHQPARTELRKNSFKIRIAQLWNQLPSEIVASPSIATFERRLDHHLKNHPKHNPFRPP

SEQ ID NO: 3066 - protein, 601 aa, synthetic construct
  source 1..601: note = Description of Artificial Sequence: Synthetic polypeptide
  VARIANT 578: note = Any amino acid
QLIKDKKAAYYKKLFSEANHKETFQLLKGTTKPPAKVLRQEQEDVTLAFEFQQFFNTKIRKIHDTLQTDENNSPHSHDKRTSASFTAFRTHTQSQVEKIIKSAPSKTCELDPMPTWLLKEQNVLDQVLPWVTGITNSSLELSHVPKDHKTANVKPRAKKDGAAYFDLSSYRPVSNLQFLSKVLERAVASQLTEYLEKETLMDPLQSAYRRGHSTETAVLKVKNDIDLAIDEGDGIILVLLDLSAAFDTLDHAILLKRLEKCLGIKGSALDWIESYLRNRPQRVKVGESYSSDSILQTGVPQGSVLGPLLFLLYVLPLQEVISRFRIDRHHYADDTQLYGRIRLNSIKTIDEDVREMEASIQDVRIWMKKNKLKLNEKKTEALIITSKEMKKHAEGIKLKIGGDTVTATSKVKNLGGWFDEHMKMQEQVNRTTKAGYFHLRTINRIRKNLDTPTCAKAINATVTSRLDYHNALISGARQCIMKPMQRLQNHSARVITMTDKREHIRPVLEDLHWLPVKERSDYKVLTFVHNALHDELAPAYMKEMYRVYHPNRALRSGEDRWTLTVGTAARHEGHRSPXIHGAIMWNTLPEALRSEASHPRF

SEQ ID NO: 3067 - protein, 1205 aa, synthetic construct
  source 1..1205: note = Description of Artificial Sequence: Synthetic polypeptide
MTILQWNCRGFRANFQELKTLVAQKDATVLCLQEIKVKDSDSCSLNGFNTLKKCTLGIDGRAVGGAAVLIKKDTPHQHIPLTTNLQAVAVRVTLHRLLTVCSIYLPPGRSHGDLVELDRLVQQLPPPLLLLGDFNAHSELWGSEEPRPSGRVVEDFIAGNDLSILNTGSQTYLHPASGSFTVIDLSLCSPSAHIDFTWEVDTDQHGSDHFPIFISSECRPSLSHPKWVFKRADWTAFGSLCEIEITEDIFEDVDDPLDIFTTLLIKIAHETIPKSCSSTKCRKPWYTDECKKAIRLRRAALQKFRHHPNDDNLLSYRKAQAVVRRVIKASKRASWKNYISKLTIRSSVKKTWDMVRKISGKYKGHQIHHLTTRSGDTATDKESIAEALADEFALNSSTSHYTDKFQKYKDKAERKVLNFNSNNTESYNLPFTLLELLMSLKSSHDTSVGPDDIHYQLLKHLPINCKMILLNLFNRIWVGEPFPSAWRNAIVIAIPKPGKDISLPTNYRPIALTSCLCKTMERMVNGRLVYFLEYNNLLSPSQSGFRSQRSTADHLVSLETYIRDGFAHGDHVLSVFFDLEKAYDTTWKCGIISDLFNMGLRGHLPVFIRNFLSHRQFSVRLGSVDSSPHPQEMGVPQGCVLSVTLFSIKINSITNAVGADIHKCLYVDDFTISYRSRYLPTAERKIQLALNGLQKWADESGFRFSPTKTVSVCFSGRRGVFPDPLLTLNGQKIPIVEKTKFLGVIFDKKLNFKEHIQFLRGKCQKVLNLLRVISKMNWGADREVLLRLFRSLLRSRLDYGAIVYGSARISYLERLKPIQNQALRLCLGAFRTSPVTSLHTEANEMPMAIRQKLLSVQFALRVCSDTTNPAHQCIFNYNNDRFYLSKPNAIRPLALRIKEDLQTICPDIKAITPNQLFNTPYWLLRPPELDISLIHFGKKTANPNYTLRNEFYNLMDKYPDHKVIFTDGSKSDSAVACSATADNLRIQIRLPDSASIFSAELLAIYQVLTLLECSANDQQQFLIATDSLSSLQAIGNFNIKHPYVFKILEKCTLLHKKGIDLVMAWCPSHVGVMGNERADLLAKEALSFTTCTIRIPSSDFKPITHEFYKEKWQEQWSSEQENKLYCIQPTLGKWAKSSREIRREEIVLARARIGHSHLTHGYLLRREMPPVCIPCQSILSVKHIFIECVDFDILRRRFFNVSSMK

SEQ ID NO: 3068 - protein, 538 aa, synthetic construct
  source 1..538: note = Description of Artificial Sequence: Synthetic polypeptide
LDCPQIPDPHFTVENVLSVLASLDTNTAFSPQDIPPIILKKCRSLLAPSLCIIFNVSIRCKTVPLEWKKARVVPVFKKGDKSAVSNYRPISILCIVSKVMERCVFNHMYPLLSSFIHPLQHGFCKGRSCTSQLLDVYNRIGSILDKGGQIDVVFLDFSKAFDCVSHKLLLYKLKHFYGVDGNLLEWIRSYLSERSQSVIVEGKSSTWLGVPSGVPQGSILGPLLFLLFINDMPYKTLHCTTALFADDSKCFKSINTTHDCELLQRDLNAMHEWSLIWQMSFNPSKCKVLSITRSHAPIHFNYAMNGVILDHVNVFKDLGVFIDQTLSFSTHIESTILKCNKMCGIVKRTIGFNAPVNVKSSLFMSLCRSHLDFASPVWSPHLKSKVKQIESVQRSMTRFILNNADLSYIERCQFLEILPLSFRREITDLLFLFKYFNGAMNVDFTSIVAKRCFNTRLRSGPFIELLTPTPRTDSFINFYFNRVAHMWNILPLEIRSCLSVSTFKSKLLSFYSNKMCFYDVNNSCTWTSTCRCNGFYHT

SEQ ID NO: 3069 - protein, 1075 aa, synthetic construct
  source 1..1075: note = Description of Artificial Sequence: Synthetic polypeptide
MWKVIFVICVLSQIKAKTGSGETRPGFTICLPQPRHASPTSMPSLCLEFIRALAVKAPARLPTDLYKRLNGLRISRRRLSKRGTKGYGRGVIPVQVSALRSADRYVNTARRDASLPTSLVTIEPMTIASSSSCVLLNCRSICNKASEIRDFISDRRMDFLCLTETWLTGTDEDKVVSAALLPDDYAMVHRPRDARGGGVAFIHRRSITLSQIRLGDYSSFEVLDALVCTARRLRMCVVYRPPPSRRNNLTVAQFMSEFADFLSDIVSLPGEPLIVGDFNFHLDDCGDADASTFSDLLTSFGLKQHVRGPTHEKGHTLDLVITKTDTALIWSSVSRDLCISDHYPVFTTLAIPKVLNPTREISYRRIKAIDKEQLDRLIEASSLSSPPENASLDENVTNYQRTLTGILDTIAPLRSRTVRIRVNADWYNDEIRAEKQRRRQAERRWRKSKLPADRELFKVAKNRTQSMIDEAKSLHFREKVSACSDDPKQLFRVVDTLLGNSTESPLPVHDSRVELSNRFSDFFVEKIATIQSAIPSVDNPPRPQAPLPQSQLATFQPLDVADTCALISGAAPKSCELDPLPSPLVKDLPSLRPIITRIINQSLATGVFPMEYKSAVVRPLLKKPSLDRDSLKNYRPVSNLSFVSKLIERAVASQLASHLRNNDLMEPRQSAYRPGHSTETALLCIHNEIVCAIGEGKAVLLVLLDLSAAFDTVHHPTMLSSLERLGVTGTPLKWFESYLSERSQAVQIGDAKSDPAAINCGVPQGSVLGPILFTIYTSSLGALLREQGVSYHLYADDSQLLLTCDPRDPAPAVARMEACIRSVQAWMSCHSLKMNGDKTEILLITSKPMRKVLPDVQLCIDGHQLQPSTTARNLGVTFNRHASMESHITSVCRLSYMQLRRLRRIKKLLPRDVLESLVHAFVTSRLDYCNSLYLGIPQTQLDRLQRIQNSAARLVTDSGAREHITPVLQDLHWLPVKERVIFKVLLIVFKSVHNLTPQYLSEMITVHIPTRHLRSSNQNFLTVPFTRSSFIKNSAFSVAGPTIFNSLPINIRQAESVPIFKRLLKTHLFHNYFLT

SEQ ID NO: 3070 - protein, 659 aa, synthetic construct
  source 1..659: note = Description of Artificial Sequence: Synthetic polypeptide
MIYCLPTYIRKLERQKPMIKTIRQWTEDAAEQLGGCFACTDWNIFEDTTTNINEYTNVITDYIKFCEETIIPTKEIKIYPNNRPWVTNDLIHAVRKRRRLWMSGHHEECKEAQKEVNTIIAQCKDNYKKKIEESFRSGNPKKTWSGLNTITGYKKKPMTRTSISNDEGWANELNVFYTRFEKEDEDLVFDQPAIAPIRFEEEDVRRVFMGIKQDKAQGPDGLSPRLLKACAQDLAPVFTGLFNRSLEESCVPTLWKCSTIVPVPKRPTAKELNDFRPVALTSIVMKSMERLVLRRLLHQVQLSMDSNQFAYKARRCVEDASALMVHLVSEHLETPGSYARVLFVDFSSAFNTMRPSILISKLEAQGVAPPLCQWILSYLKNRPQQVRVNQSLSTIRHTNIGAPQGCVLSPVLFTIYTDEHRATSQETRVIKYADDTALVALLSPGKEHLYTDAVSHFIDQCDNDDLKLNSTKTKEMCIDFRTHNTIITPIIIKGQPIEQVTTYKYLGITIQSDLRWTSHISTQCKKASARLYHLRKLRQFHVDRHLQELFFTATIDSLLLFGITVWGGRCTARDRNNISRVQRIAGKIMNTTVQPWGVSHRQRTIMRAKKIIREPLHPLHYTFQRLPSDRRYRALKAKTNRLRQTFVPSAIRLINSQPI

SEQ ID NO: 3071 - protein, 758 aa, synthetic construct
  source 1..758: note = Description of Artificial Sequence: Synthetic polypeptide
MSLTHEHLSIKVIDVDRSVTSDHFGVVFTINCPKPAREKQKLKVRKWKNVNISALDETIASHIPAIESAQDPFAAYNNCLTQVVDEFAPETTIEVTKRTDTPWYNAELRHLKTECRRLERKWRRTQLKIDQEIYRKKCRCLRRLRDRTKMTYISSKLQNATSTKDTYNILNQLLHKQSSSPLPRHDDEIELAETFSSFFSEKIERVRSAIGAHPDPDVTIEHHLSTEITPLTSFRPVSRDWISKTLSSTTPKSCNLDPIPTALLRKCPSAVPLLCFTINWSLANSTMPDSHKTAHVRPRLKKTSLDHDQLKNYRPVSNLSFISKMTEKAIVAQLKDHCFVNNIDVQMQSAYRAGHSTETAMVRVQNDLLDAVDRDGGAILVLLDLSAAFDTLDHPLILHALKYNIGVTDSALKWFESYLTNRKQLVTIGSQTSDTKNLVYGVPQGSVLGPILFTMYTRPLSNIISNCGMNHHLYADDTQLYIAVNVRSPTSVSSVKESIQECSNQVHRWMTANFLKVNEEKTEVLVITKPSLTEIAPSSFNIIGETITSSASVRNLGVMLDNKLSMADQVRNICQKSFFHLHMIRKIRNFITEDAARQLVHANVMSYIDYCNALLAGSPSYLIDRLQHIQNCAARLVKCADRHSPSLPLLKELHWLPIKFRIMFKINVITFKALRGLAPPYICSLINVYTPARSLRSSNFTLLSVPKFHLQSYGYRTFAHQAPILWNRLPSNLQNQQSLDAFKAQLKTYYFNIAFSSI

SEQ ID NO: 3072 - protein, 693 aa, synthetic construct
  source 1..693: note = Description of Artificial Sequence: Synthetic polypeptide
DDLNDLVSSFNRRCLDVTNAHAPLRQITLKGDGMKPWYSDAIHSARVVRRKYERQFRKSPLEVHRQIYVDQCKEVVQLIQNTKKEYFHQKFASASAKEVFRLVDNLLHKEPNHTLPTNVPLGDLPQTFNKFFYDKVHQIRAELDASPTLPSLTTPQPLVAERGGAPALETFEICSAEDLRKIIQTSGSKTCMQDSIPTPLLKEGAVLEAALPAIVNIINRSITEGCVPAELKKAVIAPILKKTGLDPNNLAHYRPVSNIGFIAKVMEKVIARQLTDHLTRHNLHDQLQSAYRKGCSVETSLLYIKSDIELILDAGDAVLMILLDLSAAFDTIDHALLLTRLSEIGLEGSALAWVKSYLMERTQVVRIGDKISESSDLDIGVPQGSVLGPLLFLIYMIPLGSIIDNRGVLRHSYADDTQLYCRVNIKDPTKLQKQIRDMEECITSVRSWMKSNKLKLNDAKTEVLLISRHEPRQPVEIRVGNAVIKPAPLVKNLGAYLDCRLSMKDQVNRTTSAVYYHLQRIAKVRPFLSDSACANAINATVTSRLDFQNALLMGLPDCQLRKLQVAQNNAARLLTRTKKREHISPVLTALHWLPIKHRIEFKVLSMIHKSFHSLSAPDYLKKLCRPYVPSRNLRSGDDPFKVVQLRTRNLYGARTLGGLGARLWNALPMSLRKPMTFSTFKKNLKTHFFRISQ

SEQ ID NO: 3073 - protein, 793 aa, synthetic construct
  source 1..793: note = Description of Artificial Sequence: Synthetic polypeptide
  VARIANT 14: note = Any amino acid
  VARIANT 40: note = Any amino acid
  VARIANT 97: note = Any amino acid
  VARIANT 99: note = Any amino acid
  VARIANT 102: note = Any amino acid
  VARIANT 202: note = Any amino acid
KMFLDLMHSHAFFXLIDKPTRITATTSTLIDNIFSNVINXTHLSGVLYTDISDHLPLFTVNQFICRNNSIVTKTIGYRSFNETNKLAFQNAPLAIDXDXLFXCHNCGAAYTLFTSNFVDCYNESFPIKSHKINPKRNQPWLSPELKRSINRKNRLYRRYHARPSVFNEINYKSYKSMITKEIRVAKRTYYHDLLEQNRNKIXKTWDIIKEVIGIDNTKKPIASITINDSTVSEPIEIAQHFNKYFSSIGNNLASSLPINHLDPMRYMNPNTPRSLFLSPVTSNELYTIIFNLKDASAGIDDIKPIIIKEFSQLIIKPLLHIFNLSFTQGSVPCAMKKANVTPIFKGGDPTSLGNYRPISVLPVFAKILEKLMYNRVYNYLTENRILFNKQFGFRRGYSTEMALLTALDELSSALDMKRNVIGVYLDLRKAFDTVNIDILLAKLFKYGIRGIAHQWFTSYLNDRSQRVKIGCSFSEMKSISCGVPQGSTLGPLLFLLYINDLPNVLTNIFPIIFADDTSLFMTGVDINDMTEAFNHQLSKINEWLIANKLSLNIQKTYSMLFTLSPHLYSSPIPITINNTEIQRVHSTRFLGVIIDDRLTWANHITHVSNKIAKSIGIINKVKHSLKQDTLMILYYSLIYPYLTYCFLLWGKASHSHINKLTILQKRVIRIITNSGFRDHTRPLFNTLRIIHMDDLFTYLCSVYIFKCIKIIFPRSFLDILNYFTDYNSNAPRSSTRASLTRSIIVPLCRTTLRQKQLRFQSIKLYNNFLMPLEILDNSNSISHFRRFLKNVLS

SEQ ID NO: 3074 - protein, 661 aa, synthetic construct
  source 1..661: note = Description of Artificial Sequence: Synthetic polypeptide
KRNQLTRATRRAKIKYYSDKINESASPKEIFQVTSFLLQSKREVVLPKATTMSSGSLADEFAEFFENKITAIRNGISAAPVQSSPLSDVVALHTFALTNAEEVSTLIRKSTSKSSAVDPIPTWLPKKCILTFSPILAAIVSASLVSGCVPDQLKAAVVTPLLKRPTLDPEVYKNYRPVSNLSYVSKLIERVVAERLKEHCALNNIQCKFQSAYKQNHSTETALIRVHNDILRAVDRDGGAILVLLDLSSAFDTIDHTLLLHHLEHQMAIGDTALKWFSSYLSERTQRVKVKESLSSPRRMLYGVPQGSVLGPVLFTLYTSPISAIIRAQQLQYHLYADDTQLYMSFTPTSAASTTSSGASMESAVSAIKRWMDDHYLKLNEDKTEMLVIQRPNPRSSQPTHRPTLTLDGNNINPSTSIRNLGVLFNSAFNLEDHVNALCRTMFFHVNRIWRIREYLTTSATRALMQAHVISRLDYCNALFYGLPVVVRNRLQKAQNAAARVVVRAKRSDHITPILLQLHWLPVEFRVQYKICLMTYKALHGLAPAYIDELISVHRPTRRLRSSSDIRISPVQYKLKSVGGRCFSSAAPSLWNELPQSIRLSSHLLEYKSKLKTHFFRKAFNDIYLNKSTSYHFIYILLYIAFEQFYFFLNFAIHKFEVINK

SEQ ID NO: 3075 - protein, 508 aa, synthetic construct
  source 1..508: note = Description of Artificial Sequence: Synthetic polypeptide
  VARIANT 379: note = Any amino acid
MSDHFIHGCPELYVHLSLFLNAMLIHLDVSSVMSRSVLVPIPKNRKKSMNSASNYRSIAISSIVGKCLDNVILVKHADVLSSCDLQFGFKRTHSTTQCTFVLNEVVDFYMRGGSSVYVTLLDATKAFDRVHYTKLFRLLVDRSMCNATAKLLLCMYVNQSLVVRWQSVTSDSFPVTNGVKQGGVLSPMLFCVYIETLLERLRRSGIGCYIGSTFAGAIGYADDVALLAPSLITAQKMLNVCEDFSREFFVQFNSSKSKAIVFNAPPNAVRSMRKLTLNGSPIDYVADALHLGHVVGDKSASLNMENACRDLVVRVNMLCSNFNFVHLDTILLLFNSYCTSYYGCSFWDFSPRTINGFVVCWRKCVRRLLDLPYRTRSKXLHLIVLKPEPRHQLFFRFQSFYVGCTTSTNHIVSLCTRLLPFSSSSVACNLRQLMSFVNINYDQLNNLIDNHSIRKRLSEFCEATTDQESLCCASSVIELMKIREGSLISPINPTEATDLLKHMCCSND

SEQ ID NO: 3076 - protein, 722 aa, synthetic construct
  source 1..722: note = Description of Artificial Sequence: Synthetic polypeptide
  VARIANT 202: note = Any amino acid
RTGSSRHSMLSLLLPASPMPWKSSETLTTLLTSTHTTKYLPQHLTDMHLRKPESSHYALTLLGTMMNSEHQNMSEKEGTQVENKWSRDRKETYKEQRDIYNRLLNQTKTQYYSKMVTDKARNPKDLFQLVDLLIHGKETNPVLPEHTSLDELSDRFATFFSEKIETIRLNLSNRQTDSQLLVHQEAEPELVSSWMVFSRVTXEEVTRVIKKSPSKTCSLDPIPTWLLKACLPALCETITAIINDSLSSGYVPDSMKVAAVSPILKKTNLDQNELKHYRPISNLTFVSKTLERIVAHQLNIYMAENHLHEQFQSAYRQHHSVETALVRVQNDILMNIDRGDAVLLILLDLSAAFDTVHHDTLIRRLEGIGIGGIVLNWFRSYLKDRHQSVTIDKHSSPRRQLGQGVPQGSVLGPILFSIYMIPLAQIIERHNMSGHYYADDTQIYISFRPSSPLADIEAKANACCSEIQQWMARNMLQLNEGKTDVILFGTKNILRTLDQKASISIGGSVVLSSASVRNLGCVQDSELKLDLHVNQICRSAYYHLRNINKIRRYLPLDVTEQLVHSFVTSRIDFCNSLLIGIKKANQQKLQRVQNAAARCILYIKSREHITPYLHALHWLPVEYRIQFKVLLLTFKSLNNLAPAYLTSLLHQNAVLASSRRNSSRLLSIPRSRLVGAGDRAFQHAAPTLWNASPPAMRTLSDVNVFKKGLKTFLFRRAYSDYC

SEQ ID NO: 3077 - protein, 693 aa, synthetic construct
  source 1..693: note = Description of Artificial Sequence: Synthetic polypeptide
  VARIANT 297: note = Any amino acid
  VARIANT 406: note = Any amino acid
  VARIANT 590: note = Any amino acid
ISSNDPCDAYPRFLNKITTHYESSFPIIKKKPKKRDNNKWITNGLIISIKYKNKLYLDYKRHETIANELAYKKYKNRLSGIISQAKKNYYQGLIDENRHNMKNLWRTLKELIGSKKRSSLSNEFLINNKPCKDKDMISNTFNQYFVNVGPKLASIIPNVDSNPEDYLSGSYPNSLFLTPVTINEIKLALNKLKTTASAGQDKLKPNIIKLISDEISLPLTHIINLIFEHNKVPDEFKFANITPIYKAGNSMEVQNYRPISVLPAFSKLMERLLHDRIYVFLQQNEIISDYQYGFRKXFNSEMALAVTTDNIISSLDSQKHVMGLFLDLKKAFDTVDFNILMKKLVHYGIRGNALDLLKNYLSNRKQSVKIENSVSSELPVTCGVPQGSILGPLLFLIYINDLPNAXTSCNPIMYADDTNLFLSGKNIDEMENKFNTDLVALTKYLKCNRLSLNVSKTHSMLFTLNNSLRDSSLSLSIDGSIIDTVKCINFLGVKIDNKLNFSEHITHTCNKVSKSIGIIRKISKTVNRPTLLMLYNSLILPYLTYCNMIWGKSANIHINRLFILQKKALRLINKAPLLTHTAPLFHECSXLNIHDLYIYRSTIFIFKLSHHMLPTPVSKFFNLTPLVHGLNTRRQLNYKVIVPFCRTSLGQKSLNFNIAKLYNNILQPLSLLNLDSLEKFKKSIHCILVAKYL

SEQ ID NO: 3078 - protein, 468 aa, synthetic construct
  source 1..468: note = Description of Artificial Sequence: Synthetic polypeptide
TLKIAQVKPRPKKPGVNTMDPKLFRPISNLPTIEKLLEKCVIRDLHLYIQQHNIIDPLQSAYRPGHSTETAMLRIQSDIKTSLDEGNGVLLVLLDLSAAFDTLDHNILLSRLQNSAGITGVAIDWMKSYLSSRQQFVQIEEKRSVTHDLDIGVPQGSCLGPLLFVMYTTPLGAIFRKHGLSYHQYADDTQVYCSLPSDDQNSLKNVLTRVEKCLDEVKCWMTQNKLKLNESKTECIIFSSKRNKQLFHQTTIRFGGSVITPVTSVRNLGAHLDCEMSMDKQINNTIKSAYYHLRRIAKIRRHLDRSSCTQAVVAFVSSRLDYHNGLLAGITQKNINRLQKVQNHAARLVSQTAHHCHITPVLADLHWLPIRARIDFKLMLNAHKAVHCNDAPKYMKELCMKYTPSRTLRSSSDPHLLAVKKSKRNIGASTFDVYSCKTWNELPRDVRDIEETICFKKTLKTHLYKRCF

SEQ ID NO: 3079 - protein, 1053 aa, synthetic construct
  source 1..1053: note = Description of Artificial Sequence: Synthetic polypeptide
MACEWDGKNSLLKLGSENQPSVSDVSISAMQAPPVAQSPVVSTARLSTLALPYAQVILNVPTAKASTRHPASPVHPTSKPKKENMDSHNIWITNIRGLVSNFDSFRLEIEHAHPYLVIVTETFLSPDVPDQALLIPGYSFLRRDRRTHGGGVALYYRSSLRLRRLTSLETQDHEVIWFQASTREHDIIGCAAYWPPGSDLDITQHLQHALDEVSIEFNTIVLLAGDLNAHHPDLSESISTNTAGRLLQRFATVNALTQVIQAPTRVTAHSSSCLDILLTNIPEEINFLGVYPGIGTSDHGVACVDLKTTSVITHTEDSATIRPRLHFNTHSTNWKTVNDHFSNINWHHRFAACNVEETWTLFKDAYEEVLGRLSKKSRPTSRRTNHERHQHNTLNQELIRLRATQQAAWRLHSTARTRETHQSLVTARQEFTLACANHIRRTDEATVKRMTESSNAKQWHKYCKQLYRGSAVKEAIPIMTVGTESYITAKDKATILNQTFIAKSRASSRPRFPSLKKRTDSTLADILFNEYRVKKILQDLNINKASGPDGIQPSTLKNCSDSLHVPLAILFTKSFTEGVVPTEWKLAAVVPVYKNKGQRTDPNQYRPISLTSCVGKVMEKIINDALLQHLMGNELIVDNQFGFLPHHSTTDQIALLLHELLAATTTKKSVVACFLDLAAAFDSVPHPAILQKLPAYGVRGRLFRWIESYLSFRTQYVVVDQSSSPIAQVSSGVPQGSVIAPTLFLLFINDLCHSLSANTSLSHPDCHPEALVYADDTMLYRTGKDPALICPAIEEDLRIAAKWADIWGMRFNASKTVAMYISRTTATPPPITFAGATLEYSHEHRHLGFILDSALSFHAHVNALTRKGATEVFLLRRLSYKVKDRDLLLKIYKMYVRPHLEYASPAWAALTVTQTGLLESLQRRAMRIILALPRNHHITDADYAALNITSLRHRRNFALACFMFKLNSNRLPRKLSKYRPIPHTNPYNTRNCVLRAPYVPYPCLRLLDRSPFLFGLKILNFISHTFHSLPDISSFKSSLRESSYYMPLAQIYY

SEQ ID NO: 3080 - protein, 650 aa, synthetic construct
  source 1..650: note = Description of Artificial Sequence: Synthetic polypeptide
MKNSIKMKNKLYCKYLKTKNPNDQKQYKSYKITLRSILYKAERTHYDQLFCRNKNNLRKSWEVIKTVIHKQKNNNKQQYNMEVNGKKTSDLDIITKHFNEYFINVGPNLSKSIPYSNIDPISYITQTNRYSMFTKPTNETEIGNIIRALKNSAPGPDGIPSSILKENTAHFIQPLTHILNLSLSQGIVPNEMKIAEIKPLFKSGNKHLVNNYRPISLLPAFSKIFEKCMASRLIEFITKHNLLYQYQFGFREKHSTNMALHLLIDKITNAFDQNKVLVGVALDFRKAFDTIDPSILISKLEKYGIRGCTLDWFRDYLHNRKQYVHLEGIKSSPLSIKCGVPQGSILGPLLFLLYINDLPQSSQLLPIIFADDTNVFYSGDDSEECIGIINQEMINLIKWIRSNKLSLNVEKTQYIVFSKRKIAPDNNDVNINGERLNRVDSFKFLGVIIDDRLSWKQHIAYIKTKVSKSIGILRQARPVLNKTTLLTVYYSFIYPYLNYCIDVWGHCSKQDLQSLFIVQKRAIRIINYAERNAHTDQLFKSLEILPLHHLYIFSVIIFMHKFHHKRLPPVIDELFQTNASIHSINTRQRHQLHTPLLHTNISMKSIRYRGAFIWNQTFNEIDTNLTINRFKTCLKNKLFTDFPIRTSPIQ

SEQ ID NO: 3081 - protein, 882 aa, synthetic construct
  source 1..882: note = Description of Artificial Sequence: Synthetic polypeptide
  VARIANT 22: note = Any amino acid
MVPDVNPSFSIRAEDCRYIAPXEIPNLCEHYTHPLRILHVNIRSLRANYDELLNLIASYEESNRALHVLLLCETALSDANTVLFGIPGFDAVYANRKSHQRGGVAIYVRKGLNFTQRPDLSIFSEGKFETIFIELSLCQNSQPIIIGEIYRVPSLNAPETIAFFDSFTSLLHRSNASIIFGTDQNLDLGKIDEHALTRNVYNLLESEGFLPTVNVPTRIEGVTKTIIDNIYIRGSLPSARTSVVEVKIADHLPIVLTVDFHMHRKKNSPLVIMHRKMDETIAQRIVDELGQCDWQSNENRDIDSAFEFFLSEMTRVLDRHAPAKQIKIPSKSFRREPWFTKGLQRSSRRLSKLYSTAAKCAKNSHQHTAYVKYRNVYNSAKRAAKQLYYDNLFSESKNDIKRTWKILNDLTKKSGKDNSPVEKLQVDDVTITEPKAIADAFARFFADVGPKQAGLIASHVQTDDQQNRAHLGVPPSHHSVFLHPVTQQEIIRIVDSLKNKKSLGLDLVSTHFVKKLKHALSAPLSALVNKSFCEGAFPNLLKRAKTIPIYKKGERFNMDNYRPISLLPIFGKIFEKAYCNRLMPFLEDRGFLCDSQYGFRRKRNTTYAVSELYLNSINALLKNEITLATFIDFSKAFDTISHEILLNKMPSYGIRGRALDWIRSYLSNRSMKVSIQGCLSEEVQLSQYGVPQGSILGPILFIIYANDLNACLTHTKAIFYADDTTLFLSGKSANVLAERMNDDLGRAKRWCEANSLAVNIKKTKYMLIGPNALTRCTIDLSMANEKIERVTTFKFLGITIDERLTWKAHIESLSKKLSSGLYALRNTKRLTSRHGLLSLYHSLIHSHLTYGCLLWGSASDNALKPLKIAQKKAIRLVYDAIV

SEQ ID NO: 3082 - protein, 2548 aa, synthetic construct
  source 1..2548: note = Description of Artificial Sequence: Synthetic polypeptide
KLGPTPAALAQDPPTNPTGGPPAGPNTTNSPSPPTSANPGPAARSNTATRIVPKPAGPTKRPARRTPNPTPKLRKLATGTPSAPPPAKRLHQTTIATSHKRRHTATLQNTPTEPTNGQAQASPSPPPDGRISILTLNTRELLSHHESILHTVTTHTPDILFLTETKIPTRLHYSMGSAKKGLSSHYQTYTSNAPYNPREGTRPHAGVMVGVTHRFSRPSGTTDMNAHNTDSRLAGHVCHIRIAPPHSTPVHAIGIYAPSDDATRAAIYKYCTDQAAKTTAAKEHLLIGGDWNAVLFPSDRSTGQLNATDRAHIAFTTSAGLHPLTPPTHEHPRPHTYLQDQATAPHMSRIDDLLVSHHTHATITTTGGGQEAVHECGDALDHRALLSSVPLAALRLYPFPTAPAAPSDPDAWVNYHPPTKDQREKARIKMEETIGQEIADLLNTLHPAHLAITNKLYPAGLTPAQAERNTPSPAEFRALPEVSAADTTSISNTLESILQKCLDVLKSYCDKKPPRASTTSPRHHTSKTVTRLLTATSKLKERLTAALTVTNAAGATPPTTSPHPAPTPPPNTTSPTPTPPTPAEADTPTAIRSQLLNARTLLRAAKKEARKLNTKRAARAFRRLVATQPKRAHQKIFDETDQPRGTPALTDPTTKEVHTAPEKILSSIHQHFTAQLLPINGPRTGHYDIPHSEKQYPWSRPDAPDRMPALSKPTDAPATLLPGIADSTTFFGCVNHLSRRKAPGPDGIPNELLQTIPTSLQTAIHQLMTLMWVKAHIPTHWTQSDTVLLPKKGDPLLIQNKRPIALANTLYKLYTSLITVNAALFSEQAHIFTESQEGFLRGRNTERQVQNLLHAIEDAATTGRDLFLLYIDFTSAFNTIDHDKLLIVMHDLGYPTDLIEVVRDLYGKAATSVRTEHGTTPPIPIQRGTVQGDVLSPLLFIIFIEPLLRWLHVGGRGYQYGCLTKAENDKHNLSSGAFADDLVTATTQISNLRIQVEKIEKYAAWGGLKVNVSKCQLQGILHGRARADPTLGGPRSKPHQAALARMLEGQIRIDGTAIPYKPPHESYKYLGIHITPTLDWSAQVQYIREKIKKRGQRIATSLATPDQKLRMIQLTIHPAVAYSLPFMPYSTHDVTSLDSLIASTAKMCYGLKRGFPTRAILQPTNALGLGVGSIRELYVRRAGKALVQALNDGGRLGAVTRAMLHLQHSVAQKIPADQLRTQCRFYTSLRQLSLITDAGLELTQQGSAYHTTLHGLSALLARTVPPGADAEQALPFRLIQPLLELTSDFRELLTPDRTCVIDANTLKNTWPRAQRRHRLALNRLTLALHAETRTRAKTHNSTAPLTTAQRTLPDGHTFTGLHTAHTAPAAVDWGTLNRFLRQRAPATGQTANAGETAAATTAAATTAAAEPEEDHHAGENHAPAQTRRPGTQQRKRACIKMVREPEGRGSPPADAPAAFDWDPSLDPLTEAHCADLIHTAPSLLGKSKPQNPAAHLRGLLLGPTPPATFTHRHKLSQEEQDAYLAATSDTWKHFSETYRTKALTTTNTLYGQQERVQQVIAHTTSKGAPFYRVQWEPTVITPGSLTLYARNRYRPKPGGLTWLLTPGNEPRVLVEWEDLEEPAAILDAQDNKQELLDALNARLAVPLGPRPPPPATDTHLSHDQRQGRWTDASNDTARGQRTLRHYVDINVEPCNPSRDIHPTQAYTVQLGTVLDPGSPACGTHLAHVYDPRGRCIGTISAEQLSLLWQRYQHAQTTWPKVHAKHDQGRGFAAAIARLLLRYKPGGGSKSHPVTEKGECMLCEGLTQTLHTAIGSTTELFASPLNVSDAATTYYTLYEEDMLFGANYDAYSQPWDGVAVACPEPNTEDGAHAVRWALAWAEHTETLTNTRNPPTTATLLILPTQRNAPYTRYLAHPRVTLLGSISATTTHALLGQIHNDTGITLKHDLVLVSNTPGAQLAQPIRDALGTSLYLSGMPVDPQPQLTWAHTRWVTKQVRRMTRTRPAAPRVTPPPVPATPATLAPFAATQPLRLNPYEGFYTDGSVQKDALGQPSAWGAAAIDARTLRCYQIDVNPGQHGCNTITRCELSAIHQVLKLDEVQALPEVTVYTDSAASLFLIRKTINQPQLLTFSKHKALLDNILALLKRRSHAGRRTNLLKVKAHSGIAHNELADQAAVKTAKGEQIPGAEWLVEESDNDPRSKYYWIRKIIKPTVEGVPREKNEGHYAHDLNRGIATLAAPHIAQGHTRETLYTGFVANAIPDLDIKSSTRTMNLQSGRHRKAKRCMDYLYGQLWNNKLAARFGRTVTGRRAPRAGPDTPAPCPLCRGPDSGGHILGGCHNPQLRAMYIKRHNIAVQTIARAISRGDCGGCYMVMDATSKADLPDYAADNRLPPWLLPDQEGKPAGRHLHYRPDILLIPSISLAAALNPDFVVLPSEHDTIHIIEAGYTADTNHAAKQHEKAQQHQALAADLREAGWKVQYTPQSAISLGFAGTIRKDLHPLLTSLGVTSHKARQCCDTLHDHAVATLNHIVLTRRRLERGLPPGDPGGT

SEQ ID NO: 3083 - protein, 1484 aa, synthetic construct
  source 1..1484: note = Description of Artificial Sequence: Synthetic polypeptide
QWGWWRRRWRRHAAGGGGRPCRCAPRPRPHRGDLGCPAGGSAVVRRPRQQAAGPRPLRVGSHNVRGLRSRVQHLGCPRLHALLRCWERQQLDVVCLQETHVRAEDIDLVTADLRAAALRLHVREWTAWWAPAPTPHQRVSGGTAILIRTCLLEQGAVTFPGGVAAPSVADGAWVGRGVSLPVQWGGHDFTLAAAYYPLASPEQRAFTQQWVASAVGGEGNHLLAADFNFVSDVALDTASGVPRPGDPAAATALAAACPGLIDVLRVRRPGQRVCTYIHSHGASRLDRILCSGSLVAQVLACAVEAGVPSDHRLVTLTLAATPEALPPSPGLPKARLGFLDFKDLTKDYRTWLTAALGARPGAPAELLAWWPQLKRAAAASAARLSRVAAVRRIAASEEEARALAAAAAAAAAVEVGAALPEAAAAAVRARCAAATAAVQAAAGAARRTRHEWLRGGEKPCPVLTRMLRPSGGPRTIARLKRPDGSATSDPTVMGQVMATYWQDVCAAPPPAPAARAQVLAALQQHGRRCTTEEAAQLGQLAVTAAEVRAALAAAPAGRAAGPDGIPVELYQYYESDFSPVLADVFTAVGEGAGVPGGFLDGVWTFFYKAGDPLEPSNYRPITLTDTDYRTLARVLCRRLQPVFGRVIDPEQTAFLSDRRIADNVLLLQLTPGLLKAAGQNSGVAAFLDFYKAYDTVDRSFLLACLERMGVGAGFLTWVSRLLTDTRGAALVNGRVSGWVPLAAGVRQGCPLAPLLYLAIAQALLSWLRSKGHGVLAGLASALASQYADDCTPFLAGMQAVPGFLADMDVFRCASGQRLNMSKVELLVLGTSAGLGVAPAAVAGPPLPPGWRVVNTAKSLGVHFGDWKTATPPVAFDGVVGVLGLIVRMPVSMFGRAAAASAYALSKVLYHLEFAGFPSPWAPVGKLLGQVAAVVDRRLSPAKYAVAPHARPVGVSLDIMQVPPALGGVGLLPLQLHVQARQAGLAVRCVLGACGLLAFVPPWTKVAEAWLRARHPAATPLRLLVRCDPSRVLDKLVTPECKPFLRLLGAVAHLPPITLVAPPAAGDWVYHVPLWANPALCDGAQTFDVAFADLFALPGLVYVGQLVAAHDQLEAVRAAHTRPGGWGTRFGEAMLDLYLTSVWRPVLGWGPRRHLPSPLLGPASPLAAAERIAAAVALLPGGWEAAARAARLARGRAWVMPLPADAVRQAAAGALTQVVRGLGWVLDGGPPLLLLNYSVKAGTAMQLGPQVAALRSKHLLYVRDAGVSADGALAAAGAFAGTLARLWALKWENYHKEALWRVAANACWSFPKNAAQRAAGVAMPLCRACGRDMCDGDRRHYFWDCVVARALRENMAMAMLGSPPDTADDCFSRADLWLVQPPAGLAPPVWDVVCLAALSALDSGRQQVIMTGLRVRRALTSAEVMRISVSVIADFWGRLQSYVSLGLRPKAWATVPAHHPFLSRGAGDCVLLVLPDDVGSPPPSP

SEQ ID NO: 3084 - protein, 3134 aa, synthetic construct
  source 1..3134: note = Description of Artificial Sequence: Synthetic polypeptide
MSSNPMTLQIGTQPGQQQPDLTSPSHPLRGGNNTERTTTPAAENGHIPVPLSWPRQIPSTYFREQQHLNFCTIHAINNMLGAPWLRAHAVLAFCQVVHTALADTPELQATWGHHFKHNGLFHEAAINHYLRHRPAPIDTTGTRLLLRLAAPNLDPGHSQDTILGLLPECSRNMGFMVHDGRHAYAIRKEEDSWFLVESFVHIGRKPMTPDLWQAVKGDIFCLHPYHLDMPLDPRTYPTIPNLPPPPQPPSPPPPNQTKPKRGPTQRALSTMFARQTTQLPTNHSAGDNAAPTPHPGPAETTVTRPLTQATLNITRREATEPARTQNERPATPNSAARPTRRPRHDNQLDPEPTSPTRANTTTRPRANANMHAPNTNPTQPTANNTTQPTWAQVVATHAEAAGNALRTVGRITTQAPHQRPETPPSAARPTQRPRADPPDSPTTHQTVNPNTPRRTPPGPTPDPGAGAQDNTETRPDNTTWLHIATHNVRGLGTNLLSTICHLREWNADIVILTETKLGPRTRWLKDTLRQEKLSYRTFTSTKPGTEQYKRRSAGVLMAISKRYHSGSNVHTATIPPHLHGYIVHCTIRTPHSTPLHILGVYAPEDMPTRRRIYKYCEETINTANKTDAHVIIGGDFNAVLNEGDRTGPPDEADKHHARFVSKNKLKRLPEFGGTISMSFYQTRDGTPQPTSRIDDILICQNIHSALPTASRTPATLQVQPCGGLFDHYSLHARVPTFPIRLWPSHTATQADTQPPETPGPWRTVVLPIPKSTLEAARTKIEHTLANPIATLASAIQPATTAIQQHLAQHTAGATNASELQHALQTDPAIQTPDLDALANQLLEILQDGLSILVDMCPKKPPTRGVFAPRKINKRIRESHNEIKQLRTQCDALLQQQHPYANITTTTAPNTGIPLPDPTTEQDAENPPPQQPPPAHDATTTAEPQRRPRPPPATPAIANLIDKIKRAGDTLRQILKKQTQHDIQKARDRFQHKLATRAKQAHKDIFSTQEQSRGIPALIHPQNKAHCTDKASILDAIHAYFQGQGASITGPRSGKYKPEDRTQVYPFDPSLKNSAPDTFTLHSATTPPTHALLPSIADSTNFDSCIDHLSRNKSPGPDGIPNELLRALPQTLRTTLHNLLTLMWVRAHTPASWTASETVLLPKPGDPLLLKNYRPIALANTTYKLWTSLITVAISDISHDLDLFSETQEGFLRYRNTERQTLNLVHALEDAGLTKQDIYVMYADFSSAFNTISHDRLLEIMWDLGMPHDLIRVVQNLYSNARTYIRSEHGLTAPIYIERGTVQGDTLSPVLFLVFIEPLIRWLHVGGRGYSYGCLPPHLNARYNCSSAAYADDLAVLTNTLSDLRIQCDKIHRYSEWAGLQVNHAKCRVTGILHRRAMQDKGLNGPTCNRTLRSMLENKIHIGTTSIPYLPATEPFKYLGVQVTMTLNWGPQFAYLCKNITDKSLSLQTCQASPEQCLRIIKSCIQSVAAYSFAVMPYTENDIRTLDNMIARLARTCYRLSRGFPTRAVLTPAEMSGLGVGSLLPIYVQKATRALTLALNDPGRLGMVTHALLELQTRIAGTTDMHKLRHESHYYTTLKQLSIMRAYNLTLWDHGAPYKGPPNTLLTAISRSPHPISHHLVLTLTQAGLDLRNLVGKERTPEGRACLIPSDILFQHLPRNQCQHKHRVALNRLSLCLSAECDGAREAPFNQAESYKCHLPLPQRYRALPNTPAFAALLPRNATPGELTTQSTMDAHLQHMTALHPNTEAQTPQHPNGLGPRQRQTTLAHMLRTTGAPPTAPTQSPTATLTQTPTGTLPTPPLAQPMPPPLTQPTPPLTTPAGPDAPNTQTPPTVASLTTAHQQPKSKKQRPNAIKRLQQKIDADPRHDPLPPTDMRSHTEKSGFILNNDPDENDSGPPNFVMWAPHYFANVQKDMQGTNRMPRLGIPRHHSRFPQNRTRPNPTRTIPAHLADPYFLGSQVDDTNPLNPVTAYISANPPTTPPTCAYDSRPRWADTGDFMIAPEPPNWPNITGATPGDSHDPRQADHDPQGQMRAEYMQERERLRAHLDDHPPQPRPFKRWMGIRLQLLTGKLPWPTQAYHVAQAAKQLVYSLYHDIEEISHIQAGPITKAVTAPEKGASLHTERYYEVAWKDTTIVKGAAEAYTRMKYTGTAAAHMGYGQACHKYFLRMKWDPTSEPVDKCPTLQGWTPAISEHLRKLAEPPTPTPQPKPKDARLTPAQQQGRWTQADVAASHVRRTTKQNTRIDTNPCNPYLDVHPTGRYTIQIPDTYTDERTLAHVYNPTGRHIASVTLGTLLTLKARYEHALSTHHDATSPHRSQGGFPEDLAKLLLRTRVDSKGKTCKSAPARERSLPESLKLALYNCLASTHSDPDRPVGLVERFASPLNCSGRATKYYSQHAADSLFGASHDAYTAPFDGLSLAHPDPDPDACTKALAWATASIEHLEHQATPAITFMIIPQGKGAASRCLASPHVTILALIPPGVSASSMLDGLGAADEAASSKQGLQLLLIANTTGVQALNSNNNLTRLQTSLAELGAVPPPTSQPPGRRQPLEWPARVTLPRDRTAPPGRPYSHRAKARAKQLTRPQAPAARGLDTCPTPMPTLSALYTTRAAFPTRSSYLYDAATIVWTDGSCIKVAAGEDGNEMNKLGACAWSQQTEHIYVEPGGLNSTNTIQRAELSAILVALEYIRPRLCLLGMTQVTIASDSLVSLYLIRRALTAPQRLLLSKHKNLLENILHELQMYADAGVPVQLLKVRSHTGLHGNEEADKGAAKVAANDMEAMGQAIRLAPDEPWSNIWWPKRNSDNFYLSDLNRGVLNSLPPEAQQGFTNNTPVLEQWAEASANMCPTLSNRTLASSTRHPWLVKQILYARYGYLFNAQLKRRYRLGGNGNCPLCHTPDSGGHILGGCTHPKMKGAYINRHNWAVQRVAKCISKGTYGNGFMVMDAGPLADLPHYASAQRPPAWLAAERTSSPLITRLRPDILFIPNLPAHETHREGYRPPLNKARLPIYILEIGYSSDVRHLDKREEKSQQHQELKRLLEAAGWTVHYSTNECLALGVTGAIPCNLTKLLTSQLGVTHTAARVCGERLHTHAVNSAGGIIKMRRVTEQELKPRGG

SEQ ID NO: 3085 - protein, 719 aa, synthetic construct
  source 1..719: note = Description of Artificial Sequence: Synthetic polypeptide
  VARIANT 7: note = Any amino acid
  VARIANT 14: note = Any amino acid
RFFEAEXFLSDLYXNFCNLLSHKPPEYSGDCLLQNFFSVFSEIVDKHAPLRSISRKKRRLLSKPWITKGLLQSIKNKNSMFSSIVKNKPNLQKYSVFKVYRNKLNHLLEISKQMYYKHEFSRSKNDIGRSWKLIRELIQIKSPTMTISKSVGITASDVTSDPINVANKFNDFFVDIGKNLASKIKPPTNHVPLKPFRKSSSFFISPSTPDEVFSLINCLDVKKGTRHEDIPTKFIKLANSIISPILSEIFNTCVKQGIYPDFLKNAEVIPIFKNGSDNLCTNYRPISLLSQFSKIFEKLLYNRLIKYLDKHKLLSNHQYGFRENCSTTLAVADITNMLLSNTDKGLYSCGIFIDLSKAFDTVDHSKLLAKLEHCYGIRGVALDLFKNYLTNRSQYTFVHNVRSSIKPVLCGVPQGSTLGPLLFLMYINDLPLVSNFVTKLFADDTFLCMSSKCPYELQAKVNLELIAIDDWLRSNKLSLNYSKTSYVLFTGNLKPIGINDFHLNINNNKIIRSQSAKYLGVLLDEKLNWNCHILNLSQKLARYCGIMFKLRKYVDIKTLLNIYYSLVYSQIQYAIVCWGASNKKTLYPLNVIHNKIIRAMSYSPARCHVTPLFSDLKILKLCDIYKLEMGKLMYKFHNKTLPDSFNYIFQPLYCAHNHITRQVAHHDYFVPYFHTLLGQNSIGYRGPVAWTAIDVSLKKLGWFSFKKQLKNQYLLTYIT

SEQ ID NO: 3086 - protein, 801 aa, synthetic construct
  source 1..801: note = Description of Artificial Sequence: Synthetic polypeptide
MAQRRFLLKCRYARVFPNHIKHLYNKCSSVNFRCKPIHADFNKSTLHFCQKLLNFEISDINTHIRFLQNSISRLKDHIASLKLDYNIRERHYKFVNIKQNTIYRRSNHTLHKKFKKILPKTNTTTSNNDSIHNLTNIAIPKDVAEIASLGPNFNLPSTFRERDFLCIIKNLEVGLSHLDTNDRVKTEIRDKVSQYLVNACKQKPAISRKDRQYAKNLKSTKNFLNKNPDIFFTSADKGNVTVCLKKSDYTERMHNLLSDKSTYKIISKNPLNSLQKRTSNILKNLNSNGFLSRTYHPNALSLTDTTLAKCYGLPKIHKVDAPLRPIVSLINSPTYFLAKVIYDELKKSVNVPISHINNSFELKNKLKNIKPTTNYRLMSLDVSSLFTNIPLELVLRSIDRRIVTIMNKCRIPVDEIRQCTEFLFNNTFFTFDNIFYQQIFGTPMGSPISPLFADLVMDDLENDCLSILKNNYNIIPSFYFRYVDDVLLFINVDHIDQILNIFNSYHPKLQFTYEMEIDKKLNFLDLTIIRNSNYFNFDWFEKPTSSGRILNYFSGHPVSYKRNIVFNLVDRAILLASTRFHGVNIARVKNLLIKNNYPFNFINKNIKVRLKRHKYSNHNRSTTNTYPLCKIGIPYIDNNFEKISTMLKPYNIHTYPLINNKLQHIVRLGKDTTNKHKQTNVVYKFYCKNCPASYVGETKRAAEVRISEHMKSKNSDSVVCAHQINFDHEFDWDNFKILDKESNYKKRIISEMLYIKLDKHNINRKEDVLSFNRAYLPLLRKFKCPDRVHRPLPSTFAAPPI

SEQ ID NO: 3087 - protein, 403 aa, synthetic construct
  source 1..403: note = Description of Artificial Sequence: Synthetic polypeptide
LFNNICFDAVKMAIEKFWHHIHNKINLSLTDFLNVIEFIMNNNYFQFNNNFYLQRRGSAMGSPISPVLADIVMRDLETACLNLCPFNIPVYFRYVDDILLCVPVDKVEYVLNVFNSYSHFLNFTIEKSENNTINFLDMTIVANNDSSISTNWFRKDTHSGSYLNFYSHCPISQKKAIVSHLVDKNYKLSSPEYFSNNFKYIYTVLLANNYPLDFIESCIKKRLYFLKSINNSQNNISPVNNAIGSLVIPYCRELDYKLRVFCSKSFINVIFKSSNKLPFNRMYGKDILKKLNNPNVVYKIDCSDCSNCYIGQTLRKLSIRLNEHKSDIKHKREKSALYQHHLDTGHSFNFSDNEINIIDIEQNYYKRLLSEMIFIEKTNNFNRMLDCDNLNKVFKRYIHLLLK

SEQ ID NO: 3088 - protein, 752 aa, synthetic construct
  source 1..752: note = Description of Artificial Sequence: Synthetic polypeptide
SDINIYKNYLQKELDKIEKSLIFTLGIRFFELFERFFHYKSKIGIKTFDDILTNKFKILYFRKYKHTYEKKININNNSIRVSKTNSNIKSKWLHNLTTINLPKEVQFCINLGKNFNFFDFENQNETKRVYLELFKSLNKPLHKNQSISNNIKFKILDLVKTHIKNNNKSSLDILISNMLNNCNKFLKNNKNIMITKSDKGGAFVIIDKQDYINKVEESLNDKKLYEVVEHNPLPSLINKTSNLLNELNGSDLFGDSGNKKVFNTIRDKCILAKCYGLVKVHKPNQPMRLIISNIGSPTYFLSKWVSEFLKNNLPPSPHNVKNSFELKNDIKNFLIPDGFCIVSFDVVALFNNIHFESVKVALESVWHILNLKINLEFFSFLNIIRFIMENNYFSFNNKNYRQKFGSAMGSPCSPSLADIVMRHIIKMLLFLGPFEIKLIKVYVDDLLACIKISESDKVLNYLNSIDKHIQFTMETPNNNSINYLDMTLTWDNNGSIKTNWFQKPTHANLHLNYWSHSPLSQKIGVIYSLVDRAIKLSDTCYHNNNLKKVYEILKENNYPPDFIKKHAERRKKIIYYNNKNDNNNNSNKKLNDDNKNYIVLPYIKNCDSNFKSLLNKVSYKTIFKSVNKQKFLNQLGKDSIKNKDKVCSVYCIKCKNCDKCYVGQSSRVVSKRINEHKRDVKSKKNESAIFNHVQDNGHSFDFDNFKVIDNEPNFYKRLISEMVFIKKYNTVNKVTDTQSLSSVFEFYINKYL

SEQ ID NO: 3089 - protein, 646 aa, synthetic construct
  source 1..646: note = Description of Artificial Sequence: Synthetic polypeptide
  VARIANT 596: note = Any amino acid
LLKPLEAALAVNKKIEVDTSKKIRQTYLQVIKKNIFNSKKISYFDKTINNHLNETKMFLKEHREILVTRADKGGATVVINKTDYINKVERALGDSMYYHRLDSQKRANHLTRIINSTKKLVDVWDNRGVFDTVEIDRPDVNQLSGCNLAKAYGLIKVHKPGLPVRIIVSAIGSPTYTLDKWFSKFFNKFCKRSPSSLKNSYDLKSTLRDLIVPHNYLLVSFDVVSLYSNLPFSLIKKSVEEKIGRTLDSMHLDRKEFLDGLDFLINSNYFTFNNHTYKQTCGTPMGGCTSPWIAEIVLESLEKSVLPRCRDSCLMYRRYVDDCLLIIQSDSVDTVLGIFNDFNPFIQFTVEREDNGVIPFLDVTITRIADSVCEIDLYSKPSSSGRLLNFFSHNPVSQKIAIVFSLIDKCFKLADPKFRSRNIDRARRALTMNGYPTYFIEKYIKARISIINRFNKNKNHINSLTNCEMSPPVMEGSSRLSFIILPFYPRLEKTLRSFFSKHKLKTIFQNSNKFTNIIRLGKDQTPKLKRSGIVYRIECECGLFYVGQSKRRLATRIDEHKRMVHKCDKNSVIAAHCSEFSHTFKFDEVKILDQEXNKFKREFSEMLYISYFNRNVNRKLDTNKLHDHYKSFLYELRDRMHGWRCS

SEQ ID NO: 3090 - protein, 671 aa, synthetic construct
  source 1..671: note = Description of Artificial Sequence: Synthetic polypeptide
  VARIANT 569: note = Any amino acid
  VARIANT 574: note = Any amino acid
MDNPTYSPNETLNRNFLFDEINRLVFKTKSKSASGYDEIPYGVLKSQKVIETLTRLFQLILDTSIVPSVWRKAIICPILKDASTDPRIPMNYRGVSLLSCISKIYSAFINQRITSHLDAHEYLMSKTVSEKTGRVKTRIHLNSVIRIKITIRSFHDLRKCFDFIDREMMLYKLLVHDIDGKVYNSVKSIYQNSESCVRWQSVQLCEKYLPKLRIVCALNGQLTNSCNTGVKQGDNRSPTLFSIFINDLVQDINELGLGVDVGEKKLSLLLYADDIAMIAKSKAELQRMLDKLHQWCKRWRVLINTNKYKCVHFRKGKIKRSNCNFTIGSNALETVDHYKYLGVTFNYNSCFNSNAELLAKLLAKSGGRALGQIIAKIHNNKYFGFTSYEKLFSSCVAPILDYGAGVWGYRKFQAIDNIQNRAIRYFLGVHRFTPILFLYGDVGWLPSQFRRWFCMLRYWNKLICFEDDRITKMAFNLDYERCRDNWCSEVKHIMNQIGIGQYYDTKCAIDLGLVESHLTNFYSEIWKDSLENVPKLRTYKTFKTDFGLENYISFNLSKAERSHMAQLRXGILHXRDPPLRIESGRYVGEPPNERLCTLCTQQVIENELHFVLDCPFYNQYRTEILGEQLLSPALLNRDRQYVFTYLMSHKFRQLSKFVVKAFRIRRQFLYR

SEQ ID NO: 3091 - protein, 1137 aa, synthetic construct
  source 1..1137: note = Description of Artificial Sequence: Synthetic polypeptide
MGNSLEQYRAAIGNFYFSCRCVCRSVLVNFFGFSFFSKIFMFPSIGLFALAMKHLSRHIVVYNFYLQFFMFLLLLCGDIEVNPGPIMTNVLDILHLNIRSIRNKVANLNTIVHDFDILCFTETHLDRNVTNESLMLDGFNTIYRKDRNCFGGGIMIYLSDLLRAIRRPEFETTCNESIWIEIESHTCSYFLCCVYRPPNSDGNFWTSLSWSIEKVGEITDNIIIIGDLNVDLLSIPQTHVIHDIMSNGNFVNNINEPTRVTNTSSTLIDLVLSTPAVKVHESGVLNIDSSVSDHKAIYISFSIDIELNRAYERNIWVYKDADFEKLNSLISNCDWDITINSAPNIDAAVAQFTSTFMAYVRECVPEKTITIRPRDKPWYDSMLRKTMRIRDRLRNKALRTNNDADWTKFRHVRNKVNNMKKHAITNYYDNIESALHDSSRNGKIYWKLMKDLFKVKATTEIPPLQFFENGQPTLAFSDIEKTETLNKYFSSISNIESANRSLPNLYYMCNNFFSDIHIEVQEVFDIISILPVNKAIGPDNISHRMLKYTKFSISKPLCMLFNKSLVENSFPNYWKIAHVLPLFKKDDPSVASNYRPVSLLSCVSKIMERIIFKHVYNFFHENNLFYKYQAGFLPGHSTVFQLLETYHSIVKSIEDGKMCCMIFCDLSKAFDRVWHEALIFKLQTYGISGHLLQWFKSYLSDRTQRVMYKNKLSSTLCINAGVPQGSVLGPLLFLIYINDVATNMLSFCRLYADDNSLQHCDLYTKNIEIVLNHDLKILSDWSDKWLLKFNPSKTKAVFFTKKHVEEFPKLFFQGCQLDYVSTHRHLGLLFSNDLSWSQYINNIVNSAYKKLGLLKKLKFTLGRTNLSKMYITFIRPVLEYASVVWDGCNMFDMERLEKVQLSAARIVTGLPILASTDSLYTETGWESLVSRRNKAKLITMFKIHTNQVPEYLSNIIPPVTKNVSIYHTRNSENYSVPISRLELYKKSFVPDTIRKWNSLKLEVREATSLNIFKKNITESIPQPPKYFSFGKRTINILHTKLRHNCILNYDLYRRNIIESPNCICGQKEDVYHFFFVCKNYVNARNNLFELLFNRLDETILINSHLLLWGSDNLSYNTNCFIFSAVQKFINESGRFNN

SEQ ID NO: 3092 - protein, 1053 aa, synthetic construct
  source 1..1053: note = Description of Artificial Sequence: Synthetic polypeptide
  VARIANT 14: note = Any amino acid
  VARIANT 31: note = Any amino acid
  VARIANT 43: note = Any amino acid
  VARIANT 48: note = Any amino acid
  VARIANT 69: note = Any amino acid
  VARIANT 70: note = Any amino acid
  VARIANT 75: note = Any amino acid
  VARIANT 86: note = Any amino acid
  VARIANT 442: note = Any amino acid
TYFCSRMLYTPESXVFYKKGKVDIFDCLEEXYCSFHRKGHIYXVGDFXARCGTLDDFISDDKLGKSVEXXLQSFXDYDNNANVYCXHNADRGVNNFGKKLINLCRTTGLKIVNGRNENDYNGNITFYNANGTSTIDYLLTDVYNFDNIAYFSTGIFNCFSDHAPVSFCIKTNYIDGGSKALCCANTSQGNGSINQCTSVRWKEGADLEATWSISEHYDLFLSYVENQLYTQEDVDNCVANFSKTLCKIMKPYCIITGGLANTVIDAERCIDKPWFNDICKSKYRDYRGALHNFNVCKSDVNRIVLCAKKKVYKKNSPEVIELYFVQRKRFIKKTVQKFKHNYERYQGDRMEYLRKCNPKQFFRLFKNNKKISCDVSAKEFFEHFKNLFENVKTTTYDNTSDDYEILPCYEELDVCISELEVEKAILKLKSNKSNAEDGVINXFFSKCKEVMIPILCRLFNNIFDSGFYPDNWSKGCIVPIFKKGEMQDLNNYRGITLVSCLAKLFTSIINTRLLEWDQRYNIITDAQFGFKPGVGTIDAIFVLQNLISRTLKNKKRLYCCFVDYTKAFDLIDRSKLWYKLQMEGFGGKLLRIIKSLYKNVRACVKHKGTFTETFRISAGVLQGEILSPLLFSMYLNDFERYFINSNCTSIELQMINMFLIMYADDTVLLAESPEGLQDMLNTLHRYTDEWNLSVNVQKTKIVIFRNGKCVKDNEKWEYNSKYVEVVNQFNYLGMLFNYNGKFLSTQKHCAAQGNKAMFSISSKMKDLNFNVETQLNVFDTYVKSVLSYGAEIWGFHKGQDVEKVHINFCKKVLGVRKNTCNSAVYYEVGRFPLEIFRKQKIFKYWFKLRNSKNCILKACYEDMVKNNDIWISNIRKELSILGLADLYQSTMKESVILDIIFNRMCDVFKQKVVNDISNASKCILYKHVVDHFCLQVYLKKPIHVKYRKLITRLRLSSHDLKIETGRYDNLTRDCRKCESCNLNVIEDEFHFLLICPSLCSLRDKYIKKYYSRKPSVYKVIQLLSTSNTKELCNLGKYLYYANKQRTLHVNYPN

SEQ ID NO: 3093 - protein, 531 aa, synthetic construct
  source 1..531: note = Description of Artificial Sequence: Synthetic polypeptide
  VARIANT 89: note = Any amino acid
  VARIANT 298: note = Any amino acid
SHPERIVFKHLYNYFHSNNMFYKYQAGFLPGHSTVFQLLETYDDIVRRIDEGKSCCMVFCDLSKAFDRVWHKGLLYKLKMYGIDGKMYXWLKSYLANRTQRVMYKNLFSTKAQIHAGVPQGSVLGPLLFLIYVNDVAHNMSSFCRLFADDNCLQYSSKCVKTIENCLNHDLNVLENWSKKWLLKFNPSKTKVIFFNTRKNLEPPKLIFQDSQLEYVQTHKHLGVTFSSNLSWSSHIEILLSNAYKKIGLLKKLKFKANRKTLSLMYTSFIRPQLEYASVVWGGCHAFDSEKLEKLQLXAARIVTGLTIFASRESLYFETGWEPLNARRKIQRLNIMYKIHNNLVPEYLSDIVPDMRCNASAYYTRNSQNYNIPVCRLQIYKSSFVPTVVNEWNSLPLDIRDSSSLSLFKNKISKSLAVAPPYFSYGKRRTNILHTRLRQNCALNIDLYRCNIISSPLCSCGKIEDAHHFFFSCPKYATVREEFFNKFLRFGKIRILDSRSLLWGDDSLSVDENKYLFSIVQIYIQGTGRFE

SEQ ID NO: 3094 - protein, 538 aa, synthetic construct
  source 1..538: note = Description of Artificial Sequence: Synthetic polypeptide
MKGPKFREPRSFTWRRNFIHIMNSVEDYAKRWAKSEKEELDTLSEWVKSIRCILKSRIKRLRGQMKTIYPSVFNKAEVRKELDRLHDQYVLVPADKASNNIVFVCKAHYINCIFKELGFDSTHGNPTYTHSSLSKQEILQNHKSVMDIFNIPNTQNEFDLPYLYWIPKLHKSPYKQRYIAGSSKCSTKPLSLLLTKILTVVKEKLQEYCTTIYSRSGVNQMWILKNSKELLETLRSQNLTKINSIKTYDFSTLYTTIPHDKLKSRLFDIIDSCFFNKNGSRKNAYLVIGNLKNYFVKNHSDCTHKYSEVDIKKMLEFLIDNIYVVFGNQVFQQSVGIPMGTNCAPLLADLFLYSYEAEFIQKLVREKNKSLAVAFNSTFRYIDDVLSINNCYFHTYVDSIYPSELEIKDTTESASSVSYLDILLEMDIDGNLTTKLYDKRDDFNFSIVNFPYLCSNIPSSPAYGVFVSQLIRYARACSSYEQFLRRGKLLTNKLIKQDYQQSRLKSSFRKFYGRYNDLVSKYNLPLGRMLTDVFHTNC

SEQ ID NO: 3095 - protein, 1416 aa, synthetic construct
  source 1..1416: note = Description of Artificial Sequence: Synthetic polypeptide
  VARIANT 30: note = Any amino acid
  VARIANT 42: note = Any amino acid
  VARIANT 49: note = Any amino acid
  VARIANT 1400: note = Ile or Leu
RAILTLSCPFIKIKSTHCHRPLTLLWNDLXWLRMGIARFMKXVSVGLYXIPWKTQISQLLQQIKFEPSEDILSVAKELVAHLDDSAQVVAAARLKNRKIDKPGLVKISFARVDQKIRVLRAKRKLGEISDYRSVFLRSSKSHTERLIELNARTILNEMPNGKDFRITANGRIVKKTDNEPNTRDESSSELPRPFETIRIGHLNVCGWTNKNHDLRVEIIKYTDCDIVSINETHLLNKENLDLDGYQWMGLNRSNVHVKAPKGSGGVGLFIKKHLCKNYKVDIIDNSFDGILGVKFTNKFSDYVFVVFSCYLPPESSPWGRDASSFFSHLLTQIYIQYDTDSIFICGDFNARISNIPDFDKDLDTIPPRLTIDNVHNQHGSSFLEFLNDCKFCVLNGRFGNKSNDYTFQSTRGHSVVDYICVPHDVYNSVLRLSNNFLMEDLAINQMTIHFNRQEVIPWLTIYVFLMMFTIQCSDFQIISCSDIVENAGLVSMQGENCRIPDHGFLIFDFMIRDFENAHPSENTVTSSTRPIKKYKLRCIPPSFMSSVNVRGSLLNMIRIIETCRESRENIDRTYTQLCNIITKEMECSIPKFDWSKRSRKKFRTHKPYWNNELTELWRVMREKEKTFLKHKKGNSVLKQKSFSEYKRAQQELDKRMRFFRRKYNLDLAINLDNFSSNNPKKFWEELRSLGPKRKNKVPTECYTDDNDGSISSDPTYVQNVWKSEFCNLYNPSTDVAQQPSNDAFLQRVKESVNFMENNMLDPLREHNPYLNRPIELDEVKNVIMKSKNGKSSGVDEIPYEVLKYDCVIEVIHRLFMLCFESHIIPSVWRQAIICPILKDSNSDPRVPLNYRGISLLSTIYKMYSSILNHRLVSYLEDNNLLVDEQNGFRRERSCADHVFTLNSIIQNRKETFVAFIDLQKAFDTVDRDLLKFSLLNNGIDGDFYNSIKSIYGNTVSCVRVSELCTDWFSTSAGVRQGDNLSPTLFALFINDLAKEIKELRKGITVGEINLGILLYADDIAILSDSKENLQKILDTVSYWCEKWRLHINMKKSGIIHFRKKGPRSDFQFQINSNILQYNTDYKYLGVIFHEKMNFQNNADTLSKAGGRALGGMISKIRSIFPKFGPYKEIGISTFEKLFLNCVAPVLDYCSEVWGLQNYHSIEMVQNRALRFYLGVHRFTPLPALHGEFGWKLCYHRHCINAVRLWNRLLTMEDDRLTKRVFLWDFNQTGLSRWTSRIKSLFESMNLLHIYDNLSICDVNEFENKLFLTYENEWLGKINQLPKLRLYKSIKTNFKTENYLEMNISKSQRSILAQFRCGILPIRIETGRYKGEPLDERICNFCVLNEIEDESHFLLNCTIYSDFRRELFNNIGYNPTLVMSNLDCIFFLLSNFPRQTSKYLXESYLYRQSLLYKKRNA

SEQ ID NO: 3096 - protein, 1521 aa, synthetic construct
  source 1..1521: note = Description of Artificial Sequence: Synthetic polypeptide
MNLSSPSPSKPPKKKKQRTKSSTQGKMATTQQGACTNSVYPNDNLSQSVQPIQQVGNLTYHQLQPMQYIQSAHAPMQTHMQHQPQNVQSNTPQVTPQWVSDIVTQLKNMNQKLDTIDTTLSSMKREIKGLSNRVVEVEKSQEFISKSLEDNEKNTSKALTELSDLKMALDQSLQENVRITESVLDMQCRSMRDNLLFFGIEEAQSGEQENCEDIITSLCASKLEIRSEILIERAHRLGSKKNNKPRPIVVKFNRFPHREMVRKCSYKLKDTHISIGEQFPKEIQERRKKLLPIYKRAKENNQKAVLARDKLFIDGKLYSDDGPVQMKATPTQPKASGRRGQKHGRGKRGQENQTGLRIIAWNIHGGLENKWSERNFKSFLCTYDIICLSECWIGKDFNISDQNFQSFVFPRKSGKSQGGGTVVLIRNVYTPFISFVESLHDTIVWLKIDKSFCNHTKDIYIAFTYFPPSNSTFLKERDIDLFMELENQLSYYMSIGDIFLFGDFNSRTKTLPDYIVNDQVHESVLDNNLQYSSDNQLTERVNPDLGHNEYGQRLLSLCRSTGVRIVNGRHSGGHSNDYTFNGARGLSTIDYLLTTYDMFDFISKFIVCNFTTFSDHAPLHIEFKCTTLLDPCDTSSHYRTRNVFRWDSSYVDSCNDFFNSIEGTCNFVDFEKVTSQSDLDECMLKITDMLSKDIGNFFYVSSKNSNQSKPANSRSRYSTYLSTNDKPWFNENLKSLYRDYITALRTFNVCKNAQNHLNLVSKKRTYKKLEAKLKRSYKQIEGNRLNILKKNNPRQFFAKFRKKPKSVGNVPIEIFFDHFKKITNVDGSFDTNCEQANMEVLIPIVNKPTDECVFYELDKEIDVDEIRKAISNLKRGKSHGEDGILNEYFINFQQHLLPLLYSLFNCILDTGFFPKSWSSSIIVPVYKKGDCTNPDNYRGISLVSNMAKLFTSILNNRLLDWSKTNDVITDAQFGFKPNCGTRDAIFALHSIVTNTLCKRKRLYCAFIDFKKAFDSIDRSKLWLKLSKVGIQGKLLNVIKALYNDVKSCVVVNGHLSDYFCNNVGLMQGEVLSPILFNLYVNDFEMNFLKSGCIPHELLSLNLFLLMYADDMVLFSESVEGLQLLLNELSHYCKTWNLCINVEKSKIVVFRNKGKIKCNEKWCIGNDVLEIVEQFTYLGIIFQYNTKFTKAEKQLSDQGRKAMFAFRKNIRGMILNHETLLSLFDCYVGGIINYASEIWGSHKGNNVEKLHLDFCKQTLGVKRSSFNAAVYAELGRNTSYYKKVLFNFKILEGCVMVGIPLITKRFCSILKFWKDVLCSNNCIIQKCYEEMYINCELHGHKNWASDVKKILNEIGFNEVWNKQTIDSLTLKVINQRIADLAKQDIFGKIENSQKCHFYKYLVDGFYLQYYLRKSVPVKFQQCISKLRLSSHRLAIETGRYNNTHRAQRNCFSCKNYVEDEFHFILVCPVYIEYRQKYIKKYFYEKPSMFKLLQLFNNENFKDMCNLGKYIYYSMKLRNDICN

SEQ ID NO: 3097 - protein, 1268 aa, synthetic construct
  source 1..1268: note = Description of Artificial Sequence: Synthetic polypeptide
MDDKVQQSYLSILTLNCQGLGDINKRRDIFKVLKSKNYNIYFLQDTHFVEKEESLIKGLWGYKAYFNSYKSNSRGVAILINNNCDITILNEHKDSDGNFLLLDVTIESLPFLLINIYGPNSDSPAFYINVLNKIQDIYSNQHIVIGGDFNLVFDKDLDSMNYKNLNNPKARLEVLKIMETLTLKDVYREHNPTLKKFTWRKKNPIKQARLDFFLISESLLNLSLYVKYENSYRSDHCPVVLYVRTNEFLKGKGFWKFNNSLLKDKEYVYLIKEKIKNVKQQYACPVYNLENIETIDDNIQFIISDQSFLDTLLMEIRGKSISYSTYKKKKTTEREKQLEQEILLLEQNFTVETKDELSNKQTELELIRKNRLQGQCIRSKVKWIEEGEKPSKYFISLESRNFSSKIIPKVEKEDGSTVFNQFEILNELRMFYDNLYQKRETIDSENIYEKLKLYDIPKLNKQESDLLEGPLNKLEVYNFLKNMKNDKSPGPDGFTSEFFKFFWNDLGSFITRAINNTYELGHFTESNKLGVITCLPKAGKPKQFLKNWRPISLLNVLYKIASGCIANRIKTVLYKLINEDQTGFLKGRFIGENIRMIYDIMQYTEQNQIPGLLMLIDFEKAFDTISWKFIYQTLDFFNFGISIKNWIQTFYSDIKSCVIQNGIASDYFFPQRGCRQGDPISPYLFLLCAEVLGILIRNNKEIRGIEIDGVEYKLSQYADDTSIIFDGSPQSMDGILRELDYFACISGLKINFSKTKMVWIGSKKISKEVFHHSRWKLDWNNPTFDLLGVKFSVNLNEMVELNYPSKFLEVTRLIKQWKLRNLTTVGRLTVIKTLIIPKLNHLILTIPKPSVEYLQQFEKEIYIFLWGGKVHKVKKNIIIQDYRYGGLKMIDYMEFVCALKSTWIRRLIHSNTKWVKLFESELGLKIETLWEKGSDFITNISNKISNKFWKEVLLDWVKIVMSYSQNDIKVLNEHIWFNPNIKINNSSIFIKNYFNCGYKFIKDLMTEEGNFVSLETLENSNVKTNFLEYRSLKGAVFERLKALNNNKVEYGPFIPNSLSIFYKQSKGCKDMYYVLIDNKKESIRSVKKWTESGFAYTEIEWNNIFELPFKTSKESKFQWLQFQILHRILPTNEYLFKLNIIDSPACSFCNQDIETIEHLFVDCFHVKEIWLYFEEWLRSKFNFLMTFDKKTILFGKFKNRNMYRLQNILILTVKQFIFASKYKNVPNLSTLMLKRTVTDRIHIEKLLLLKNCKFAEYEKYWQTICDLL

SEQ ID NO: 3098 - protein, 441 aa, synthetic construct
  source 1..441: note = Description of Artificial Sequence: Synthetic polypeptide
  VARIANT 31: note = Any amino acid
KQSRVLQGDILSPMLFSLFLEDLETHLHENXSAGIEIDQINIFLLLFADDLAIISETPNGLQKHLNTLHTYCERWGLTVNIDKTKVMIFQKGRTRKGYKFCYNNKNLEIVDSFAYLGTVLSPNGLFNKHVKITAEKTLQLYNTFMYKTQKLSLDCKTMMELFDVACSSKMNYGAEVWGYTNAKDLERVHLKFCKRLLGVKTSACTPAVYCELGRKPLLLTRTLRIIKYWFKVLRSQNCLMKSIYDYDLKNMLSSWIIFVKNTLLSNGFGDVWYYPESVNEKMFYVYFEQRLSDCFYQNLRVEIENAHPLRLYKYLNLPVHQAEYLNHILYDKHRKALSRLRLSSHRLRIESGRYDKKCPINERKCIYCKSNDVEDEYHFVLVCDFYTELRKLYIKKYFYVRPSMAKFIDLLNSDSIFMLKKLGKYVYESFNKRDNFTIRRE

SEQ ID NO: 3099 - protein, 1096 aa, synthetic construct
  source 1..1096: note = Description of Artificial Sequence: Synthetic polypeptide
MKNRHKLSNRRSGGLILAFKDTIVKYIKVLETDCKFIFLFKLSKTLLNISEDAVCGLVYIPPEGSRYSSPDCFSEIEQEIINVESNCKYLCLFGDFNARVGKMQDYYTPDDFLAHVTHCEIQSEVATRSIIFDNYQIPLDRIVRDHTINNFGYKLVEFCKNNDIYIMNSRVGNDKNIGGTTCKDSSTVDYVLASANFFAIVESFNIKNFCDLFSDVHNPISFSFSICINDAKNNIPGKNQPSVKLWCADKADDFRNNIQMSAVCEIENELNVLSSCIDNICKDNISKIAKDICTVFVNTARETFGMSKHVDNFSNEKSSKPWFNRVCRTARRKYHLAKRLYNRNNSTDNKENLKVLSKQYKRTMDGCIKDYKKTITKKLVNLRSTNPKDYWKILHGSRRDEKCAVSIDDMFQFLKDMNEGCENGESNIDNPDFIGTCMYDDILNGEISDEEIVAAVKKLKNSKAAGYDLIVNEHISSTLSIFLPVYKKFFNIIFCSGFVPDEWLIGIIKPIYKNKGDPTQPENYRPISLLSCLGKLFTSILANRLEAYATETNLIYENQAGFRKNYSTLDHILTLQFLCDIFMKRKKKLFCAFIDFKQAFDTVWRTGLWSKLILNGINGKCFRYIKNMYMGIKSLVKLNGIASNFFECNVGVRQGENLSPFLFSLYINDLENFLLEKNIVGLQSISNEIENELLLHLKLLILFYADDTVIMAESTEDLQNALNEFYSYCTQWKLNVNVNKTKIMVFSKGPTSKKLFYYKGEVIENVKEFKYLGIVLSRTGSFIKARKHLCEQAQKAMYGVIRKIRNFNLPVNCQFDLFDKVVLPVLLYGCEIWGFENLDIIERVHLKFLKTVLNLRSTTPNFMIYGETGRYPLYINVYTRIITYWGKMLISPENKIVYTVYRYLFSQHFNSDCKSPWIDCIQRILNMCGLQYVWQNHNFVNIEWLSATVNQRLKDQFMQIWSNDINCSSRGQVYKILKPYFGFEKYLDILPVKLRKKFIKFRTSNHRFPVETGRWYNIPLNERLCLLCNKGLIGDEFHYILECSALEEIRKKYINTKYWKRPNFFKFSELMTNCNCKSLRKLCVFISKIFDAVCSS

SEQ ID NO: 3100 - protein, 1164 aa, synthetic construct
  source 1..1164: note = Description of Artificial Sequence: Synthetic polypeptide
  VARIANT 36: note = Any amino acid
  VARIANT 366: note = Any amino acid
  VARIANT 996: note = Any amino acid
  VARIANT 1046: note = Any amino acid
  VARIANT 1096: note = Ile or Leu
MAGDTIEQYRAAIGLFYCCVRCVKKCFYLNLFQLRXLFKCLLQYLLWFGNLYKTLSMCLAQHSLVIDYFFQVIFMLLFLSGDIETNPGPCTGTQYTLDIFHLNIRSIRNKLDSLLSLVSDFDVLCFTESHLNSSIPDRNLFIDGFNTIFRKDRNSFGGGIIVYVSNSLRVKRRTDLEPTNIECIMGNQQTLNALWVEISDPTCNILLCCTYRPPNCDNSFWRNLSWSIEKAYDESDKIIVVGDLNVDFLNIPHTHLVKDLLSSHFLENTITEPTRVTQNTSTLIDPILVTRDVSFFDSGVLDVHHTISDHKATYIYVKSNLNLNSAYKRKVWLYKNADFDKLNFLITHTDWETLIMGADDVDQAAXNFSETFLSHIRKSVPEKTVTIRPKDKPWFDSALRKEIRQRNRLRKIAMNSRNALDMQKFKKSRNKVNNMKKYAIDNYYNNLEINLLDSSKNNSKLYWRLLKNVFDIKMSTEIPPLQFALKNGNQSIAYTNTEKAEVLNDYFSSISCLDDNDARLPEFNSECNNFICDVCISEQDVIDIISIIQVNKAVGPDNISHKMLKNTMYTIAKPLCSLFNRSLRDCTFPSSWKISNVLPLYKKGDSSQMSNYRPVSLLSCVSKIMERIIFRHVYNFFHDNNLFYKYQAGFLPGHSTVYQLIETYDHILRAIDQGQSCCMIFCDLSKAFDRVWHKGLLFKLHTYGITGNLFKWFNSYLVNRKQRVMYREVLSSIKSINAGVPQGSVLGPLLFLIYVNDIADNMLTFCRLFADDNSLQHAAINVHDMESYLNRDLLTLEVWSKKWLLNFNPSKTKAVYFSNKLTQTNTVTPTLKFQGCDLEFVPTHKHLGVIFSEDLSWSSYINSIIANAQKKLGLMKKLKFKLNRKSLSLLYTSFIRPQLEYASDVWGGCSINDSDKLEKIQLIAARIVTGLPIFASRESLYFETGWETLYSRRKISRLKTMYKIDRNLLPSYVMDIFPNKRANVSNYSTRNAHNYXIPKCRLELYKSSFVPTVVDEWNALSTDVRGSDSVRIFKEKIHVSVKNENXLTCRTRPNFFTYGDRFLNIIHTKLRHNCALNNDLFRCNIINSPLCSCGKXEDTYHYFFTCNKYKDARNVLFNDVFQIVNLNIVNTHVLLWGDSSISDNENKHLFTLVYNFIKNTERFN

SEQ ID NO: 3101 - protein, 390 aa, synthetic construct
  source 1..390: note = Description of Artificial Sequence: Synthetic polypeptide
CESALNLLLLKWKQCIEKGNIVLSVFVDLKRAFETIDRTKLIRVLKKSGIRGTVLKWFSSYLENRKQVTRYNDAVSAETAVDLGVPQGSVLGPLLFILYINDIKQALKRVQVNLFADDTVLFVVGDSFDECFDIMNEELGGFSEWLKWKKLQLNITKTKCMLVTTRQTKDCRRSVQMDGGIVERVETMKYLGVMLDEKLNFNEHIDYTIRKAARKFGVLCRINRYLTAETKVQLYNSLIAPHFDYCSSILFLATQRQMKRMQVLQSKIMRLILRCDRLTPRRSMLECLQWMSVKQRIEYNTLVFVFRVKERMAPQYLTEAMVRGRDIHEHDTRGADDLRLQIWRKACTQNSLFYKGFKLYNQLPEAAKMTSNINEFKRSCKEFVRQRPLE

SEQ ID NO: 3102 - protein, 701 aa, synthetic construct
  source 1..701: note = Description of Artificial Sequence: Synthetic polypeptide
  VARIANT 35: note = Any amino acid
  VARIANT 65: note = Any amino acid
  VARIANT 142: note = Any amino acid
  VARIANT 453: note = Any amino acid
  VARIANT 466: note = Any amino acid
  VARIANT 589: note = Any amino acid
RRADFESLSRALRGIEWSSVLDPVDIDLAVDTYTXILGRLIEQFVPKIRKVVSHHLPWQTQELRXLKTQKRAAFKVSNGSVHLRDYYLRINHSYQRLSRRCFANYQRKMQKKLKTDPKKFWKFVNESRRESGLPTSMRLADXEGDDADKICQLFAKKFAGVFCAEPITDEEVRAAAENVPRRDELLASIEIDEGTIQAAAAKLKHSCSPGPDGIPSTLLKRCSSSLSAPLLHLFRLSLSSGKFPVAWKQAYMFPVHKKGDRTNVENYRGISALCATSKLLELVVIDPVFSHCRQDLADEQHGFFPKRSTATNLLCFTESIINSFDAHSQTDAIYTDLSAAFDKINHRIAVAKLERLGFRGSLLAWFKSYLTGRSLRVRIGDALSDIIDATSGIAQGSHLGPVVFLFYFNDVNYTVTGPRLVYADDLKLFARIDNSNDAEALQRDLDRFAGWCXVNRMILNPGKCQXITFSRRHFPVTFDYRINDTSVERVTHVKDLGVILDTQLTFKQHLSYIIAKASRQLGLVIRMTRKFTDIYCLKTLYCSLVRSTLEYCSTVWSPHYNNAVCRLESIQRRFVRYALRQLPWTNPLXLPPYEQRCRLIDLDTLQLRRDLARAMTSADVLLGRIDCPDLRNQIQLRVPTRQLRHTPALEVPFRRTNYSANGAINGLKRAFNKVSSVFSLDVSRTTLRFKFVSLLRSLLRM

SEQ ID NO: 3103 - protein, 1378 aa, synthetic construct
  source 1..1378: note = Description of Artificial Sequence: Synthetic polypeptide
  VARIANT 14: note = Any amino acid
  VARIANT 20: note = Any amino acid
RALRRIFLGADKRXQPDSAXSASSSCPTCTNKTVNAESHAKVNAETNTKVNVEVNPEIYAGHGADPKGYGTNFACESQWFTYGSRDRLTNTLRSTPSLPQQSSVQHLPASSPGRAVESIMRAPRLPDATAPSPSYRTRSPASRSHQRRPGAGVGVGGGVSQTAPLGKYPSQLQVSLPDACPTYSSSLITSSSTRTANASPPAQAIQSSPGRTVESIMRAPRLPDATTSSFSYRTRSPAGCSHQSRPGAGVGVGGGVSQPVLFGKYPFQSQRVLPDASPTHRSCPSTSTSTRTANASPLPAQAIQSSPGRTVESIMRAPRLPDATTSSFSYRTRSPAGCSHQSRPGAGVGVGGGVSQPVLFGKYQFSTPHTSPDARSDFSATVPPSTFVTLAAPGCVYHGTMEDLGSANSGMPAALTASDPASASSERGFLNVYYQNVRGLRTKTNSVLLALSSCDYDVIIFTETWLVPGIKNSEFAAGYDIFRCDRSAETSSLQRGGGVLVAVKTGRNCKDVELVGCGSLEQIAVRIVLPHQALFICCIYIRPASNIDVYQLHTGAVQQILGMAGVRDLVLVVGDYNLPALTWFFDDDTHSFLPINASAEQEVLLLESMLSCGLLQINNLASAHGNLLDLAFVSDATAAELIDPPCPLLKPDAHHKPILLKLDYDHGGNDDLDDADEIFDFNQCDYALLNERISAVDWDTLLDTSSVDESTANFYERLNSILHEVVPKKIRRMSHRYKLPWWNDELRTLRNRLRKATSRYMESKTAWDKVTVQNIEDEYNALNQESFRSYINNTQRSLKSDPSKFWSYVNSRKNANRTPTDVSYRDLNSTSPAIAANFFADFFKSVHSSDAIPPRDHEFEYVPTHYLPLPLPVLNDEETLKALSGVDGAKGPGPDGIPPSLIKACADSLTVPVKRIFNDSLRKGVYPAMWKVASITPIHKSGSTKKVENYRPISILNCLAKVLEKIVYDRLYAVVRPIISDDQHGFMQKRSTTTNLLTFVHSTVNALESGEQVDAIYIDFEKAFDKVPHALTVRKLRKLGLPAWITNWLLSYLTNRKAFVNLRIARSSTFDIPSGVPQGSHLGPLIFILFVNEICALTNSNTLMYADDLKLFRSVKNNVDCCSLQMDVNALLHWCESNGMKVHVKKCKVISFSRSRNPLRFDYTMGDGCPLDRVNSIRDLGVTVDRKMKFNEHIALTTGKAFAMLGFLKRNTAHFDDPFALKVLYASLVRSVLEYAAVVWAPYHVTLAARIERVQRAFVRFALRKLPWNNPLILPSYEGRCLLFRLQSLAERRTLMQRLFVFDLLRGNIDCRSIRNNVRFNEPARQGLRGERPLLWIPRHIFDYGYNNPLDVCFRQFNEICSCFDYVVSKTVFKTRIS

SEQ ID NO: 3104 - protein, 1354 aa, synthetic construct
  source 1..1354: note = Description of Artificial Sequence: Synthetic polypeptide
  VARIANT 79: note = Any amino acid
  VARIANT 81: note = Any amino acid
  VARIANT 84: note = Any amino acid
  VARIANT 333: note = Any amino acid
GESESRGREHGRVTRPPLAASPGRAVESHVRVPRLPDTTTSSPSHRLIRPACCSLQSRPGAGVGAGGGVSQTATLGKYXSXSQXPLPDARPTSSSCAISSTSPPVRTPNAVRAFWSSPGRAVESHVRVPHLPDTTTSSPSHRLISPACCSLQSRPGAGVGAGGGVSQTATLGKYHSSLQNPLPDARPTSSSCATSPPVRTPNAVRAFRSSPGRAVESHVRVPRLPDTTTSSPSHRLISSACCSLQSRPGAGVGAGGGVSQTATLGKYHSSLQNPLPDARPTSSSCATSPPVRTPNAVRAFWSSPGRAVESHVRVPRLPDTTTSSPSHRPISPXCCSLQSRPGAGVGAGGGVSQTATLGKYPSGLQNPLSDARPTSSSAAFPSTINAKGTSTPCKLRIYYQNVRGLRTKIDAFFLAVTECDYDVIVLTETWLDIEILSPQLFGSTYRVFRNDRNERNSDKKSGGGVLIAISSRLDCVLDPTPVCDTLEQLWVRLTVGASQRVCIGAFYLPPGLNRSIDLIKDHLESIGNVLSHLNLNDSFIQFGDYNQPGLKWIPSEEGGLEIDPVQSRVPLVSSYLIDGFNLHGLSQLNPCVNVYNNCLDLVLVNEVALPNCAVLAAVDPLLPQDIAHPALEMFVDVPAPSATAEPPLNSQQSFNFRKANYAAIQEELSRIDWSFLETAPSIDAAVDAFQSILNNLFTEHVPLRRPPQKPPWSNPTLRKLNRLKTAALQEFSNHRSPFFKSKFNLASKRYRGYNRTLYRRYVIRTQRDLRRNPKNFWSFVNSKRKADGLPPTLYLDDVAAATSEEKCALFAAHFKDAFNSRFASEAEIIEATRNTPINAIECSLTEVANCQVSAAINKLKLSYSPGPDGIPSSVIKRCSGALLSPLTCLFNLSLRQSTFPDKWKASFMFPVHKKGDKSSVKNYRGITSLSACSKVFEILVNNVLFDSCKNYISTDQHGFYPKRSVVTNLAQFVSHCLQEMDAGAQVDAVYTDLKAAFDRVDHGVLLKRLERLGVSASLVRWLKSYLTNRILRVKIGNSESDMFISLSGVPQGSNLGPLLFILFANELSMLLSEGCRLFYADDVKIFTVVRSVLNCSALQRQLNHFNEWCVRNFLTISIEKCSTISFHRKLKPVVFDYAIAGNTLARVTQVRDLGVTLDSELCFTIHLHDIVSRANRQLGFIFRIADDFRDVACLRSLYCALVRSILEFCSVVWCPYQSTWTAKIESVQRKFTRLALRRARNPAGWNTYEERCRVLQLETLERRRHVSQATFVAKVLAGEVDTPWIRAQIQIYTPARPLRQRQYLQLAHRDTNYGQHEPVRFMCSRFNVFSHLYDPNISTPQFQQRARLWYSHQL

SEQ ID NO: 3105 - protein, 947 aa, synthetic construct
  source 1..947: note = Description of Artificial Sequence: Synthetic polypeptide
MNTRALEYRLACSAISYDVIAVTETWLKNNTLSSQVFGNGYEVFRCDREQFINSQKKDGGGVAIAVRQGLNARIVSSDEWKCVEQVWVAIDLADHTVYICVVYIPPDQTNNASVFEINSSSVSTVSSMARPYDELVILGDFNLPRLIWRPSRDGFLYADPELSTQTLHVTEFLDNYSSALLQQINQFPNENNVLLDLCFVSCPDIAPPIAIAPAPLVKDVRHHPPLHLSLPVHLASEFTPIVCEVRYDYRKSDVPSMLELLRSIDWENTLDKDNLDDAVQTFTNIIGYVIDRHVPKKPVTNARVPWQTSELRRVKAAKRSALKKYSKHRTLPLHNYYVRLNSCYKRMSKQCHADHEVRTQKKLKSNPKGFWKYINEQRKEIGLPSSMFLGDKTASNTEDICQLFAAKFSSMFTQEDLSQQQITAAANNVLPNGLALNRITIDRSQILEAATKLKSSNTAGPDGVPSIVLKKCIDGLLDPLAHLFSLSLSTGSFPKLWKHAYMFPVHKKGDKRNADNYRGISALCATSKLFELAVMDPVFFFCKNLISDDQHGFMPSRSTTTNLLTFTTFVTDSFTAKSQTDAVYTDLSAAFDKLNHSIAIAKLERMGIGGVLLRWFQSYLTGRKISVKIGDWLSAVFEAFSGIAQGSHLGPLVFLLYYNDCIHSISVPRLSYADDMKIYCRIDNASDAQVLQQQLINFAEWCKINRMVVNPTKCSVISFSRKRNPIKFEYQICGTSIPRENCVKDLGVLLDTELTYKQHISYIVSKASRQLGFVFRTAKNFTDIYCLKALYCALVRSTLEYCCSVWSPYYENSVARIESVQRRFIRYALRSLPWRDPFRLPSYESRCELINLDTLAVRRNVCRSLLVADVLTSRVQCPAILRGLNIFAPIRTFRNSPFLRVPIRQTNYAMYSALTGLHRAFNFVASLFDFNLSRDVIKRKFLLFFRR

SEQ ID NO: 3106 - protein, 1005 aa, synthetic construct
  source 1..1005: note = Description of Artificial Sequence: Synthetic polypeptide
  VARIANT 155: note = Any amino acid
  VARIANT 192: note = Any amino acid
  VARIANT 303: note = Any amino acid
  VARIANT 1004: note = Any amino acid
MEPESGLRATETARRKTDWRNGTTLGMKTRTRIGTWNVLTLAQAGKLETLGREAVRLKLEILGLSEVRWPDSAEHKMPTGQVLLYSGLRSENAQRGFLLSPNARSALITWKPINERIIVARFRTRVRNLTFVQVYAPTDAADLQEKEEFYSQLSXVVNEIPKGDIRIYAGDFNAKIGSDNTDLERIMGPHGXGEMSENGELFTEFCGNQDMVIGGSLFPHRSVHKVTWVSRDGKTENQIDHICISRKWRRSLLDVRNMRSADIASDHHLVVGEIRLRVARVVRQEEKVGCRFNVQRLSNPEVXRAFVGELQARALEIPDSTVEEEWQFIKDAFAVTGENTLGMLRTQRKEWISDATWDKIEERKQAKAAIVSARTRATKARTRQTYAELEKAVKRSCRRDKRAWTDSLADEGEKAANNGDMRLLYDISRRLCGARTNTRIPVKDRSGQLITDPADQLKRWFEHFEQLLQISHPRPSPQYHPQNVRRINRVNSSPPTLREIEEAVKGMKSGKAPGIDRISAEMLKADAHLSARMLHRLFSKIWDTATFPVDWMQGILVKVPKKGDLTNCDNWRGITLLCIALKVLCKVILCRIKSKIDESLRRQQAGFRSGRSCVDHIVTLRVILEQVNEFQDSLHLVFVDYEKAFDRLDHENLWEALGRKGVPERIINLIKAQYEAFVCRVVHNGVLSDPIRVVAGVRQGCILSPLLFLIVIDEVLAGALDRVQNRGLLWQPIRMEHLNDLDFADDIVLFSQRGNDMQNKLDDLAACSSAAGLKVNVSKTKSMAVNTERAQGFTVAGENVEKVDTFQYLGSQIAPDGGTKLDISTRIKKARSAFAGLRTLWRSNQISLRTKLRIFNSNVKSVLLYGSETWCVSSQNTSKLQVFVNRCLRNILRAWWPRNWVSNAELHRRCQQRPIHVEIRERKWRWIGHTLRKDAHEICREALDWNPQGQRGRGRPRGSWRRSLHQEISAVDGTLSWRQVKAKAENRQQWKSFNAALCSTGEQXA

SEQ ID NO: 3107 - protein, 849 aa, synthetic construct
  source 1..849: note = Description of Artificial Sequence: Synthetic polypeptide
MHSAKTLNQTTITMATKPSEHNKFIGLKKIIAGIHKDIAFLKKCVEHRVTPTSHKIRTKGHTDSKIIRRVELELVKESIKKLYGRLSIKTLECYSLHLKLAKEFPIEFEAFLTKVKVAEKCESERKRKILDNKFRQLISHIAPTMKPVVKPLEEFVVNRSSETFSEEQLTLLNKGLKYAVSSKPNLENIVIDIETVINANSIDEKQTKPPPLLPAQINSVRMTVSKLIREATTKHQDNAEVRVVKELKEKPVYYLKADKGNRVVIMDRDEYDKELLEKLGNREKYSLQRGYTLIDMVKKVENTIKECAGLLKSVGKTAKSLRVPNPTLPRIKALPKVHKPGNEMREIISAVDAPTSRIAKWLVEEFKSMPKPFPSRSIISSQVFTKELLESGPIAEDEIMVSFDVTALFPSIPVKNAIGTLRDWLQSQYEGEPWRQKTIQYITFVKLCMEQSYFQFRDCIYQQRMGASMGNPLSPFMSDVYMAALEHELQTKNLLPERWWRYVDDVFCIIKRDSLTTVLDTINSARRSIKFTYEMEVEGKLPFLDILILREPGCPSSFSFEIYRKPTNTRRTIPATSNHSFQHKMAAYHYFIHRMTTLPLSEAGKQKELEYIFETAEINGYSRTTIQAIIDKKERKLHRTSLTTLTPSAEPLRRAAVEFDYRITRPLRQKLAKFGIDLVFSSRNSQLESILGSTKDPIPTLGKPGIYEVSCGHCDMSYIGQTKRLLQTRLDEHIHTYVKIAMEEKRKGFVPHFKSAVTEHIIEEKHNITASDAVILRHITNPSKLAVAESLEIFKAGNKRLLNKDSGNGSTWLFKLLPIQAQKKNEEVVPTVTTNTDTPAMNLQSRTEH

SEQ ID NO: 3108 - protein, 743 aa, synthetic construct
  source 1..743: note = Description of Artificial Sequence: Synthetic polypeptide
  VARIANT 13: note = Any amino acid
  VARIANT 56: note = Ile or Leu
  VARIANT 84: note = Any amino acid
ARNCFRRVYACNXDTANLQPAELQPKTPGPAVTPVPESTESLTYDFTRCDFEAVNXALSQINWTGILAHCSLDEAVSRFYDALXDVIQLHTPLRRLHPPSNRKPWWNATLRNLRNRLRKARTRLHKRRCQPNIAEVRELEELYESQQNAAFSEYIHRIETDVKQNPRSFWTFLKSRKKGSGIPTEISNGCVEANSVEEQASLFADFFSGVYSTSLPAPCNEVVDHIPTHDLHLPVVHFSIEDVSRALDDVDVTKGPGPDSIHPSFLKNCAASLALPTTIIFNRSLAESTFPTAWKLASITPIHKAGNVHKVENYRGISILSGFAKLFEHLVHGALYPVLKPIIANEQHGFVKRRSTTSNLLLFTSTLLTNIEKGQQIDAVYVDLSKAFDKVPHALLLEKLRRYGLPEWIVRWIHSYLADRKAFVKVRCTSSHLLAIPSGVPQGSVIGPLLFILFVNDLCSVLESDKLMYADDLKVFRSVSSPLDSCALQQDIDRLLRWCTANGMEVNVQKCKIISFTRKRTPLLSSYRMGQNELERVNTIKDLGVTIDSKACFNEHIALTTAKAFATLGFLRRNAADFVDLFALKTIYCSLVRSQLEYAVQVWAPYYAVQAERIERIQRAFTRFAVRRLPWVRPQGLSSYDDNCERLKLPALASRRVLLQRIYVFDLLSCNIDCPTLRDKITLHIPARNLRNPAPFLEVPGHRTNYGYYSPLSACCRVFNDVADVFVFGMSKCVFKTRIKNRT

SEQ ID NO: 3109 - protein, 637 aa, synthetic construct
  source 1..637: note = Description of Artificial Sequence: Synthetic polypeptide
  VARIANT 628: note = Any amino acid
ALKKLKSSKRAALKKFSKCPISVNRLNLNQISNDYRRLNKSLFLAHQSRVQNRLKQNPKGFWKFVNEQRKESGLPSTMIRDGVEVSTSSEICDAFRVQFSSVFADNNLSDPDVAAAADSVPDSGLVCSDLQVSREDFNAACSKLKSSTSPGPDGVPAIVIKKCANSLSEPLLRIFNLSLSLGVFPNNWKESYVFPVFKKGCKQDVKNYRGIAALCAVSKLFEVIVLEFLRHNLSHVVSDDQHGFFPKRSTNTNLVTYISKIQRAISDGYQVDAIYTDLSAAFDKINHRIAIAKLRRVGLHGSLLTWVNSYLTGRTMLVKISDNLSLPFSVTSGVPQGSHLGPFLFLLYINDVNFLLRCPKLCYADDFKLYAIIKRPTDMEDLQAQVDLFADWCRLNQMVLNPSKCSTITFTRKRCPTFFSYKILGNPLTRDSFVKDLGVLLDSKLSFKNHISYLCSKASKQLGMIFRMTKYFRDVNCLKILYLSLVRSTLEYGSVVWAPYYHNDIGRIEAIQRKFTRFALRHLGECPNYETRCSMLHLDPLSVRREAAKAFFVADLFRSNINCPFLTSELNVNIRRRVLRSHSFLVIPGARTNYAFNEPVSSMCRVFERCYPFFDFHLSRPRLKHDIXNFLREAYVF

SEQ ID NO: 3110 - protein, 965 aa, synthetic construct
  source 1..965: note = Description of Artificial Sequence: Synthetic polypeptide
  VARIANT 94: note = Any amino acid
  VARIANT 163: note = Any amino acid
  VARIANT 240: note = Any amino acid
  VARIANT 744: note = Any amino acid
  VARIANT 785: note = Any amino acid
MTNTVNNVQELRFEPINATLKNNLSKENGFKVGHLNTCSIICHHDDVKNIFTRTGFDCIGFTETWLNSDIKDALIKFDNFEILRHDRNSTTRVXGGGVALFVRPEYKTKIIKTSPRDSIEYMFCELKVVSCKLWLVLSINPQPIKSSQLQVVVGVIYKPPTLXDFSFFFEDLGNISSTYNNIILMGDFNINILVSNPMSNNFTRLINSFSLSIVNKSFPTHFHNTGSSLLDYFICSENLXSTLFSQVSVPAVSHHDLIYTVFNLPVPVASLKTISFRNFNRIDKEAVRNDFPNFNFDQLNGIVDCETLASNFNHKLIQLVNKHAPLKTKTILPTSCPWYSREAYNACVDRDLAYRFWKNNRTLENKLIYNRFRNRATNLIRIAKKQYSAKLFDPTLPSKTIWKNFKSLGFRDDPDNLDDKFKPEDVNNCFIQKIENYPTGNRQPTIIPDIVEEDQFKFRAVTEDEVHKAILRIKSDAIGYDEIPLKFVKLFLDLLVPYITLLYNKIISTNTFPTIYKLAIVKPIPKIKNPSNPNDLRPISILPSLSKGCEILLKDQIVQYVTFKKLITPFQSGFREHHSTSTIITKVCQDINASFDSNYVTVLILLDFTKAFDLIDHRIFIDKLKEQFQFSSDACDLMKSYLSDRSQLVQINGVRSQFRSTKRGVPQGSVFGPLAYTLSVNDLPSFITHCNKQSFADDTQIYLSCPVDQLPNKISLINSDLSAISRYCKDNGLVLNTSKTKAIXFSRQNTVLPHLPPIQIDNENVEIVDECLNLGIKMNKHLTWXDHVSLIKKKVYSTLRTLNCHRHTLSIDTKIKLVHTLLMPHFIYGNVIFSKMNVDTERHLQVCFNSCIRFIYNLRRFDHVSQFQRSIFDLSLSKFYQFQLLLFLFKLINFKEPQYLFESLVFSRSNRTNNIIIPVHHTNFMGNSFAVRGARLWNDLPHNLKSITLFSEFKRRCKEHLKNSI

SEQ ID NO: 3111 - protein, 425 aa, synthetic construct
  source 1..425: note = Description of Artificial Sequence: Synthetic polypeptide
LYENIFGCLIANNFVKVVAYADDLNILVRNNHEFDTVLQLVSYFSIYSKIKLNFAKSQYLRFNGCLSGPHQIKEVESLNVLGVLICQNFNKLVEINYDSYLNKLKYTLSLHQKRILNLFQKAWLLNTYVLSKIWYICQIFPPNNKHLAAIKSICGQFIWQGFIFKVPRNELYLPVIKGGLALTDVESKAKSLFIKNILYSNADGNAPLDNFMLGQINNSTLTRNMREWIVKADELKLESHLNSSKKIYDFFIHSLNIKCKTMEDMPNLMWSNLLNNLDSNFLNSKCKTVLFCIFKDIVLNKKKLHLYGIRGTDSKFCENCGLVESVSHLVKYCQTSEEIWRWLKNILNKRLKILVKDPDELLSLSIGDRDFKYKAALWLTVQTIVYNLEKRGFGDLNEFKQGIRIVRFNNKAIFERHFKHFLNIF

SEQ ID NO: 3112 - protein, 1455 aa, synthetic construct
  source 1..1455: note = Description of Artificial Sequence: Synthetic polypeptide
  VARIANT 2: note = Any amino acid
  VARIANT 8: note = Any amino acid
  VARIANT 12: note = Any amino acid
IXRTQRRXFLGXFKCCREHSGKSATPPVPTLNDADDAEFAARVCTAIDSKDTGACFGVDWRSGRFTHGSSDRITCGTIVPTIPASFRSSSQHLPVRVLQSSPGRAVESLMRAPRLPDATTSSPRQRLRTPASRSHQSRPGAGVGVGGGVSQPAPFGKYPSRSQHFLPDVRPTSSSCASTSATQTAIVSPPSFRAIQFSPGRAVESPMGAPRLPDATTSSPRQRLRTPASRSHQSRPGAGVGVGGGVSQPAPFGKYPSRSQHFLPDVRPTSSSCASTSATQTAIVSPPSFRAIQFSPGRAVESPMGAPRLPDATTSSPRQRLRTPASRSHQSRPGAGVGVGGGVSQPAPFGKYPSRSQHFLPDVRPTSSSCASTSATQTAIVSPPSFRAIQFSPGRAVESPMGAPRLPDATTSSPRQRLRTPASRSHQSRPGAGVGVGGGVSQPAPFGKYPPRSQHFLPDVRPTSSSCAGPSATQIANASTLSATVPSQLANDVQPQRPGSVDRRDSSLLTIYYQNVRGLRTKTNQLHLSLSSCDYDVIAFSETWLNAKIVDSELSSDYTFYRADRSRETSVLERGGGVLIGVKKRFHPEPIHLRGGEKLEQIAVRIPLPGKTLFVCCVYIPPNSDATIYTQHSSCVQQLCDLAQGPDEVIVVGDYNVPNLTWHFDEDINGYLPSGQSTEQEVALIEDVLGTGLQQMFDLPNANGRLLDLALVSDSSRFQLIEPPRAILKVDAHHRPFILVLETQSTGTAAEQSGTYYDFANCDTMALNNSIASLDWANLLLVGSVDDIVERFYDKLNEIIREVVPLKHRRPHPNSHQPWWNRETRNLRNRLRKARKRFLKHPTEMLGRELADRELHYEMSLEAAFRGYISGIESNLKREPKSFWAFVKKRKQDKGIPQDMVYRDSSASTPDDSVQLFADFFKTVYSANQPTTSNESLDKILPHELHMPLVCLTEEDVRKVLASTDASKGPGPDCIPPSIVKQCAATLANPLAIIFNRSLESGVFPAKWKVASITPIHKSGNVHNVENYRSISILSCLPKVFEKIVHEFLSRAVQPIISACQHGFMAKRSTTTNLMTFVTDVLRSMESRCQVDAVYVDFAKAFDRVPHQLAVEKLRRLGLPEWITTWLHSYLTSRSAYVKLGGSKSGLFMIPSGVPQGSHLGPLIFLLFIDDLCHWIKNDKVLYADDLKFYRTITSPLDCLALQSDIDSLMRWCDQNGMEANAKKCQVITFDRKLRPITHAYMMGISLLDRVCSVKDLGVTLDRKMTFNEHITSVTAKAFATIGFIRRNTTAFKDIHALKALYSALVRSQLEYAAQVWAPYHNVHIARLERVQRAFVRLALRTLPWRNPPEQTSIEDRRRLLGLDTLLKRRQRMQQLFIFDLLTKRLDCQKLSQLLIVYVPPRNLRRNPSMFRLSVHHTVYGHNQPFDVCCRLFNVVSDRFVLNMTKDSFKKLISC

SEQ ID NO: 3113 - protein, 1002 aa, synthetic construct
  source 1..1002: note = Description of Artificial Sequence: Synthetic polypeptide
  VARIANT 43: note = Any amino acid
  VARIANT 78: note = Any amino acid
  VARIANT 107: note = Any amino acid
  VARIANT 680: note = Any amino acid
  VARIANT 700: note = Any amino acid
MARRLEIRNKRQKPIEKQTTDWRLGSWNCRSLNFLGFEFALAXELQPRNFDVVALQEVCLEEEQVLDWPGRQTNSRFXLSGGKDKKLGTGFIVRGKMQDRVFGFTAXSERMCKLRIRGRFFNYSIINVHCPHEEKTDDEKEAFYATLEEVYDGCPRQDVKIIIGDMNARFGREEMFRPTIGPESLHAVTNDNGQRCIDFAASRGMVVRSTYFPRKDIHKATWTSPDQRTKTQIDHVLIDGRFFSDVTHVRTFRGANIDSDHYLVGVDMRSKLSTVFNQRRSRRAPPFNTACLQNGEVAHSYAQQLEANLPGEEELGAASLEDGWSRIRSAIGSAAEATLGSAIRVSRNDWYDDECQRITAEKKAAYDRKLHKATRGNVERYRQARNRQVAVFKLKKRQQEDRDCAEMEQLFRANETRKFYEKVNRSRKGFVPRADVCRDNGGNLIVNKSEVLDRWKQYFNEHLNGDEADGDGVGVNLGAPAADEQFPAPDLETVKREIRKLKNNRAAGKDRLPGELFKYGGEKLARALHCVISKIWEEEKLPEEWMDGVVCPIYKKGDKLDCGNYRGITLINAAYKILSQILCRQLSPHARRFVGPYQAGFTGARATTDQIFCLRQILEKCREYNVPTHHIFIDFKAAYDTVDREQLWQIMHENGFPDKLTRLIKATLDGVMCHVRVSGXLAEPFGSRRGLRQGDGLSCXLFNIVLEGIIRRAGIETSGTIMNKSYQLLAFADDIDIVARNLETVMDVYTRLKVQARRVGLGMNTTKTKYMRGRGSKDVGPPSLTPLTVDGDELEEVSEFVYLGSLVTADNDTSKEIRTRIFAGNRAYFGLRKTLTSDRVQRRTKLTMYRTLIRPVVLYGHETWTMRQEDERALGVFERKVLRTIYGGVQVSDGVWRRRMNHELHAFLEEPTIATQAKIGRLRWAGHVARMDESQPVRLLFDRAEPAGGTGRRAGKPRARWGDQVNGDIRKICNLGNWRVAAQDRERWKRLLATARVPGALC

SEQ ID NO: 3114 - protein, 1013 aa, synthetic construct
  source 1..1013: note = Description of Artificial Sequence: Synthetic polypeptide
  VARIANT 388: note = Any amino acid
MAARPHAAASLCPDRTVFSCFLSCESQCFCTSSSRLSVFKRAYSREFLLDVGRAAFLELNSAHAEQLRDLGLLRRPTSSPTPTTASRPQRRRHKRRERKQKRGKRGGIRARLTANPHKPSIPTIVLANVRSLDNKLDYIRLLRSTQRTVRDCCVFVFTETWLSDSVPDCAIQLDQLTCYRADRARVAGGKTRGGGLCVYINDAWCRDAVVICKHCSPLVEFMIIKCRPFYLPREYTAILLVSVYIPPNNNNSNRNDALNELYQHISEQQTAHPDAFLIIAGDFNHADLKSVFPKIHQHINFPTRGNNILDFVYTTQRGAYKALPLPHLGASDHITVMLMPAYRPLVKVAKPVQKQIQVWPEGSSDALQDCFDTTDWNMFKQAATYNNXTDLQEYSETVTAYITKCIEDVTVTKTITVRANQKPWMTGEVYRLLETRNAAFRAGDEGGLRTARANLSRGIREAKRQYSRRIAHQFSDSRDTRSLWQGIQTITDYKPPQRTCDSNISLLNELNTFFARFEAQNSTTAQKTPPPPSDQVMMLTPDSVRRSFSRINARKAPGPDNIPGRVLRDCAAELTDVFTDIFNISLSQAVVPTCFKATTIIPVPKKPSPSCFNDYRPVALTPILMKCFERLVMHHIKSALPPSLDPFQFAYRSNRSTDDAISTTLHSALTHLEKKDSYVRMLFIDFSSAFNTIIPQQLIHKLVELGLNTSLCNWLLDFLTGRPQAVRVGSNTSSTITLNTGAPQGCVLSPLLFTLLTHDCTPSHNSNLFIKFADDTTVVGLISNRDETNYRSEVSRLAGWCSDNNLSLNVEKTKEIVVDFRRAHTQHVPLTINGATVERVSSTKFLGVHITEDLSWTDNTAALAKKSQQRLYFLRKLRRARAPPPIMYTFYRGTIESILTSCITVWYGACNASCRKTLQRIVRAAEKIIGVSLPSLQDIYGTRLTRKALCIAGDPTHPSHSFFSLLPSGRRLRSLQARTSRLKDSFIHQAVRKLNSLPNLPPRPSSASGTTEL

SEQ ID NO: 3115 - protein, 985 aa, synthetic construct
  source 1..985: note = Description of Artificial Sequence: Synthetic polypeptide
MVAKVYGLGTARASPINDAQAHRPTPAISGQGLPCQVRARLKTLVPQRKLRFATWNIGSLTGRCRELADVLMRRRVQCAFLQETRWKGNKSRNIGQGYRLIYTGSPSGKAGVAVVLSEELRNGLLEVDRRCDRLMRVRVLIEGVITNLISAYTPQAGCSGSEKESFWEQFEEVLRAIPAAEVIIVGGDLNGHVGRAAETFDRVHGGFGYGRRNAEGENILRTCIASDLAVVNTFFQKTPQHLITYKSGSHSTQIDYLLTRRCHISKVTNCKVIPGESLTAQHRLLVMDYVVTPKKKVAEKRKPRIRWWLLNGTMQTSFRAEVESQNLSTNTETAQEVWDRAQSAIITAGKRVLGLSKGGRVIDKETWWWNDEVQEVIREKKTAFKKWQQSNSPEDRLEYIAAKRASKRAVARARSDRLSPLYDTLETAEGQKLIYKLARARDKATQDIAKCLSVKDSQGTLLCNHASVKERWRCYFKELLNTQHPCSLPTEIPPNLGLIAPITPDETRNCLRRMKNRKAVGPDDIPIEAWKSLGSLGVLILTDLFNRVLNTGTMPHQWRYSYITPIYKGRGSVQDCGSYRGVKIMSHTMKLFERMIDLRLRRECTVSECQYGFQPGSGTLDAIFAIRTLMEAYREKRRALHVAFLDLQKAFDCVPRQCIWWALRFKGIPEAYIDIIRDMYRDSVSMVRTAVGDTKPFPISVGLHQGSALSPFLFNVVLDTVSANIQDQPPWLMMYADDIALIDESRLTLERRVNLWKGTLENGGLKLNVTKTEYMACGSPDSCTIHIGPEPAVKSEKFRYLGSILHESGGIDHDVQARISAAWAKWRDVTGVVCDRRIPTKLKGIIYKSIIRPVLLYGSECWPTLSRHTQELHVTEMKMLRWMCGVTRADRIRNTFIRGSLGVRDVADKLQESRLRWYGHVARRPENYVGKICLDMSVPGARPPGRPRKRWLDTVKQDMRANGLTTADAKDRAKWRSLSRKADPG

SEQ ID NO: 3116 - protein, 946 aa, synthetic construct
  source 1..946: note = Description of Artificial Sequence: Synthetic polypeptide
GHSENTGSPWFVIPGNNGRRREQKAETRKKSGCVDDSGKPHTSHRSPASSYECQIIANKMDELGFSWTMQGLLPLMLTESWLHPGIPDAAVELTDFTLHRHDRNHLSQKQRGGGLCIYISEKWAKDTKAVESLLPRFGVSDSNHCSPDLEYLTVKCRPFFLPREFSSAVFITAVYIAPDANANSALNLLHNAISSQLNKYPEAAHIIAGDFNHVDLKIVFPKLHQHVNCATRGGNLLDKVYSNIKRGYKTIPAPHIGQSDHISLFMLPVYSSLRKRDPPTLKTVTVWPEGASLQLQDCFAHTDWSVFESQDLEEYTTSVLSYIKHCTDTVTTEKHIRVYANQKPWMTGGLGFCALYRHCHHRETHQSVCQPKTLDDRGVRILLKERNIAFKSGDKERYSAARANLKTGIRGAKLKYKHKIEGYLHSNNSRQVWQGIQNITNYRPNPRSVGVDNTLAEELNCFFARFEQQSAEEATLHSLSNPSHVFTVEEDDVRKVLRTVNPRKAAGPDGITGRVLKDCADELTGVFTKIFNLSLSQAIVPLCLKASTIIPVPKKTTINSLNDYRPVALTPVVMKCFEKLVRSHILQRLPPAFDAHQFAYRENRSTEDAIAIALHTTLTHLEHKDSYARILFIDFSSAFNTIIPKRLVSKLNHLGFPFSICLWIQDFLSNRSQRVKVEHHVSSALSLSTGSPQGCVLSPLLYTLYTHDCTPFHSSNTILKFADDIAVVGLITDGDETAYRDEVNQLALWCTDNNLALNTLKTKEIIVDFRRNRPDTLPIHIHGDCVEIVSNFKYLGLHLDQNISWKTNTIALVKKAQQRLHFLRVLKNNNLAQELLVSFYRCTIESVLSYCIPVWYASCTAQEKAALQRVVNTAHKIIGCTLPSLEELFKARCYSKACSILKDSSHPAYHLFQMLPSGRRYRTIKAKTNRLKNSTYPRAVAIMNGH

SEQ ID NO: 3117 - protein, 987 aa, synthetic construct
  source 1..987: note = Description of Artificial Sequence: Synthetic polypeptide
MAARAQREAQGLSSFCIFAVLFLLISGLFVQNSGAFTSYTRQELLDIGLCIPDSFISNLRLIHEIARTPRAGRPARPGGSARRPRRERKQRRGKRGGLRAKLKLTPHRLSLPSIFLANVRSLVNKMDEIRLRINHSKRLWNCNVMIFTETWLNSGIPDNAVSLTEHHTFRADRTADDSGKTRGGGLCIYINKAWCTNSVVVGRHCSANLEFLMVKCRPFYLPREFTSTIISAAYIPPDADAKLAMNELHAAISKQQTAHPEAAFIVAGDFNHSNLKTVLPKFHQNILCHTRGNKTLDHVYTNIAEAYAVTPLPHLGQSDHLSLFLTPKYSPLIDRVKPSVRTIKVWPAGVDSTLQDRFQHTDWGMFASQATHGSHTDIDSYTSSVLEYINTTIDSVTTQKQITTYPNQKPWMNKEVRLLLKARNTAFRSGDAQAYSTSRANLKRGIKKAKHCYKLKLEEHFSNSDPRRMWQGIQAITNYKPSQSTPTATDVSFLNELNDFYARFDRDNKEPYTRITSSTDHSPITLTSSEVHTALSRINGRKAAGPDGIPGRVLKVCAEQLAGVFTDIFNLSLNLAAVPTCFKTTSIVPVPKHSSPTCLNDYRPVALTPIIMKCFERLVLAHLKDSLPSTLDPHQFAYRGNRSTDDAVSIALHSVLTHLDNKNTYARMLFVDFSSAFNTVIPSKLLIKLRDLDIDTSLCNWIMDFLTNRPQNVRSGHICSTTVTLNTGVPQGCVLSPFLYSLFTVDCRPVNRSNTIIKFADDTTVIGLISNNDETAYREEIQHLATWCTDNNLLLNTNKTKELIVDFRKGRTGSHDPIHINGMAVEPVSSFKFLGTHISKDLSWTTNTSSLIKKAHQRLFFLRQLKKNQLSSAVLVNFYRCTIESILTNCVTVWYGSCSVAERKALQRVVKTAQRITGTTLPAIEDIQKKHCLRRARSILKDTFHPAHRQFSLLPSGRRFRLPRTKTSRLRNSFFPRAVSLLNSAPH

SEQ ID NO: 3118 - protein, 1229 aa, synthetic construct
  source 1..1229: note = Description of Artificial Sequence: Synthetic polypeptide
  VARIANT 983: note = Any amino acid
  VARIANT 1073: note = Any amino acid
  VARIANT 1087: note = Any amino acid
  VARIANT 1128: note = Any amino acid
MATGGTGVVITLLVYCYFTSLTAAIRVDPVRMFCSIYPLSYHNDNPHIYKDLGYKRKGNELAKTSTGYGTYALAVTMVYPSLYNKITKKKKAMTTTQSSRTGLIIAICLMLSGDIHPCPGPHHFKTPREANPQTEDKRATLTLQVCSSCTLLCSSAQQANPLLSLCPTPNTLKLSVQGVECVKGAAAVPGWSDGERQGEKTHPRLCVGMSDRSFGREFAGRVCAFRGNKRPDPETQQQQQTFLNDSASTMATNSVNRKRLNPGVVKNRKHAFFNTVNNSKIVWDPKMKPKGLLGRHLNIRSILSKSEQITHLLTNSNLDYLCLSETWLYKYAPSAAFNISGYTMFRKDREGAKGGGVMIYVKDNLQCEEINWLCDYEFECLGLNVRLSPQMSFKIIVIYRPPSSDGTFYDRFEKLLKESNLNKETVILGDFNINWEDTSCRNKLKRITDKFDLVQMINGPTKITTSSSTQIDLIFTNRPERIIKTYNMLAGISDHNLTLVARKLSKKRFKFSAREHEFIGIPRNRRDGFKNAVEQIDWDRLLLGTDLEKDRGSFVGTIEKTVKNSALNLNANTIKIYYPGLTLTYHTKTNERERFCVKKVIKSKSASDRNMFTTLRNRVVKNIRKAKADYFLTLIEKAKGDSKTIWNQLKKVVRHDTKNKKMLEVMIDGHITNNACKIAEAFNNFLLTQFQIWSHCVHQKFLTCALFFINSVSNMVPLCPSKISNMCSLNSSQPIFSISNISESDALQAIKSLKSSRTKETFGIDSLMLKELSSTLLTPITKLLNRSISEAIFPCVWKSSAVIPIFKNGDHYSLSNYRPISIIPTVSKVAEKLIANQLIKHLNTTTFSLHPMQFGFRSQHSTETANCFLIENIKHLLDKGGVVGAVILDLKKAFDTVNHKILLSKLTKFNMSPESLKWFESYLSNRSQSVRINNYHSSPLSLPTGVPQGSILGPLLFSLYINDLPSVCQNILIQMYADETVIXTHGKNTTQVAEKLTQAMAHVSEWLNQSCLKLNVSKTVAMYFSKTNIVNNLTDIYVDGDKLQIVSDFKYLGVQIDSKLTFKSQIKKVCNRXKFNIRSHLSLQAAXIFMHSMILSHITYCLTTWSQANKTTLKPIESLYKQSIKILXKKPLRHHHCSILQKHKLLSWENVIKYSNICLLYKIIHGLSSPPLSQFVNIRNSTHRATRGAARGELYRPTPEKYLWSGCLFSYSCTGVEFCPWQHQRYNLL

SEQ ID NO: 3119 - protein, 290 aa, synthetic construct
  source 1..290: note = Description of Artificial Sequence: Synthetic polypeptide
  VARIANT 26: note = Any amino acid
  VARIANT 226: note = Any amino acid
  VARIANT 274: note = Any amino acid
VRNHSINFHCYADDTQLYLSIKPDEXNQLSKLQTCLKDIKSWMSCNFLMLNSEKNEILVLGPKNLRDSLSKDIVTLDGITLASSTTVRNLGVIFDQDLSFNSHIKQTSRTAFFHLRNITKIRHILSQTDAEKLIHAFVTSRLDYCNSLLSGCPNKSIKTLQLIQNAAARVLTGTRKRDHISPVLASLHWLPVKCRIEFKILLLTYKALHGQAPSYLKELIVPYYPXRTLRSLNAGLLVVPIVSKSRTGARAFSYQAPLLWNQLPVVVREADTLXTFKSRLKTFLFDKAYS

SEQ ID NO: 3120 - protein, 1142 aa, synthetic construct
  source 1..1142: note = Description of Artificial Sequence: Synthetic polypeptide
MKAFMRQTRKALTEFRKQLTSSFEVFSIMETQFLDCKLLNESPKRKIANNNKNSLQIPSPCIAAVGIPSPISACLNSILAVNNSAGPGTSGLQSSFAFNNTSPGSEPGASGLQPNQNTGTTAEGSSTPQQLAPGPGSLHINPDHATTIAPAALPSSQPAANQPLSAIPLSGVAPRSNAADLPLRGIAPNRSVFVSRLNPEATADCVKSYLCQKLGAQPNSISVFKFNFKQPRNISSFKITLPESMFSNALDPTIWPEHTIMHEYIRKGASQDPNSVDAKNCKKLNRSISVAYQNVRSLLGKLKRVYSNSTLLDFDIIAITETWLNTTVYDQEIFVNKFAIYRLDRPTRGGGVLIAVLNSHSSELIPYDNMHSIEFIAVKVTTDKCNVFLTCSYIPPGSDPAIYLHHLSAISAVSLAVGDADQLIVLGDFNLPHLSWLPNSDSNILFPENQHEFIDGLTNLSLGQVNSIKNSRERILDLIFVSDVSVATVSRCDPVSTPEDSYHPALYLSVHINFETTNQSASQRGNTIRDNYESICLTTREHYTGLNSHFDRLNWSTLYSFTDLDSAVLWFNESVCSALDTFVPSYRWKLIKASLVLQAFVLHIPLSQVTVGNSLKPPWFSRHLSYIKNTKSLLKDIKNPRFFYAEYIAECRQNIRSDPKKFYSFVNSKRKSNVFPPCLHLGNLSESSDINISNLFATFFQSTYSLPHINNIHIPPFKISDVLNGMLTIDESFSAGPDKIPSCIIKQCAASLCGPITFLFNLSLQLSFFPSVWKTSFLIPLHKKGSKTDVGNYRGIAKLSAIPKLFERLVTCQIQHMCSSIISTSQHGFVKKRSPSTNLLEFSRLIHCSFLQKKQADVIFTDFSKAFDSVNHSLLIYKLSLIGFPPYLLDWISSYLSNRSQRVLFKNVVSSLVNVTSGVPQATSHLGPLLFILFINDLPQVMSYCTTFMYSDDVKICMSFSNLSSHLLIQSDLNKFQAWASTKLLSLNYSKCKTMSFSRTTFHTTSYTLGNSLLERVVKINDLGVLFDQKLCFNSHISVMVNKATGVLAFIKRWAKEFNDPYTTKSLYVSLVRPIMEYCSEVWNPQYVYQQNLIESVQKQFLLFALRNLNWDPDRHLPPHLSRLKLIDLNTLKHREFNCKIF

SEQ ID NO: 3121 - protein, 824 aa, synthetic construct
  source 1..824: note = Description of Artificial Sequence: Synthetic polypeptide
  VARIANT 759: note = Any amino acid
  VARIANT 806: note = Any amino acid
MGDFNAKIGPNFTRMRSATGGHGIGTRNNNGDRLVEVCQMFQLIIGGSMFPHRDIHKYTWTSPSGNTRNQIDHICISRKWRKSLLDVRNKRGASIDSDHELIIGELSIKLDRNRPRNADDSRNHRPSPLNIHLLGETDISARLASTLRTHLLPQQGQTWEQTCDTLRTTAEGIIGTQQRRRNNWISSATWDTINKRNSLKLLADRDSNRRDEHRALCKAVKRAARNDKRALLDRLADNAERAANENNMRSLYQTIEQISGGYRRKTQPVKDANGILLTSDDDQIHRWRQHFMEISNSDMPSRSDDYRSVAPANGNRRISSAPPSVREIGNAIKKLKNNKAAGMDGIPAEILQVDTQLMAEILHPHFSSAWESEHIPDSWKCGVIVKIPKKGDLSDCNNWRGITLLNTSYKVLATILNERLTEKFEPTLRDEQAGFRPHRSCVDQANTLRIITEQAVEWRAPLYLLFIDFKKAFDSINRAAIWGALARKGVPHKVIALIKALYDDANLAVLHNGKTSAPFQTNTGVKQGCPLSPLLFNIVVDEVMREVCKHKRGITWSFTRHLEDLDYADDICLISHKLSDIQSKVDDLVNLASRVGLQINTAKTKAMRLNHASQGNIIVDGNPIEYVESFPYLGTVISSNGGVTEDVTSRLAKARSAFGRLYRIWRSRQIRRKTKIRIFNSCVKSVLLYGSETWLTTKTIIQQLQAFTNKCLRIICGIFWPNRISNIDLWNMTGETAIRLQIRKKKWRWIGHALRKDQXSIVRTALEWNPQGSRRVGRPKATWRRTALQELSQYNITWDTAKQTAXNRVRWRNLVEALCSQEEL

SEQ ID NO: 3122 - protein, 393 aa, synthetic construct
  source 1..393: note = Description of Artificial Sequence: Synthetic polypeptide
  VARIANT 14: note = Any amino acid
  VARIANT 41: note = Any amino acid
  VARIANT 43: note = Any amino acid
  VARIANT 62: note = Any amino acid
  VARIANT 108: note = Any amino acid
  VARIANT 113: note = Any amino acid
IVNNKWTILKEHTXTPSKVFLDIVKFCIQDNRYLKYETKLXIXLKGMPMGSPASPVVADIVXETLLQNTTEKLRRPPRLLTKYVDDLFGIIKEDEIENTLTTLNAFNXNIKFXMELEKDNCIAYLDTVVIRRGNELKLKWYKKPIASGRIINFNSRHPKMMIRNTASSCINRMLRISDAIFHEEIINEIKTILTNNDFPKHMIKSLLDKYLKSDNNQRPPKKERTYISVTYVPGLSERLAQSDCYDKENILIAHKPDNTLKQIFNKTKSKIAPTDKKDVVYRIPCNGDGKNNCNSIYIGTTKSKLKTRLSQHKSDFKLRHQTNTQKTALMSHCAKQGHSPNFEETTILAQEQHYRKRYMMEMLHIINTPTNIRMNYKTDTENCAHIYRHLLGK

SEQ ID NO: 3123 - protein, 996 aa, synthetic construct
  source 1..996: note = Description of Artificial Sequence: Synthetic polypeptide
  VARIANT 400: note = Any amino acid
MKEAEEASERDRFNVDDHGKRKKDNDLRVCTWNVRTLYRPGAAQQLADTLKKCRADIAAIQEMRWIGQGCIKKKDCDIYYSCHPERHEFGCGFVVGARLRRRVSHFLPINERLATIRITAKFFNISLICAHAPTEEKDDVTKDTFYAELDRAYGRCPSHDIKILLGDFNAKVGREDIFGATVGRFSLHETTSSNGLRLIGFAAAHNMVVRSTGFRHLDIHKATWLSPDRLTRNQIDHVVIDARHASSVLDVRSCRGPNIDSDHYLVAAKIRTRLCVAKVARRGLLRRLDIGKLQSQQTRDAFSTQVSGLLSRTTPTPEDISDQWALISHSLRTSAEEVIGFQRPPTRNPWYDQECRDATAAKDAAYRRTLQAGATRAVVEVYRLRRRDEKRLFRRKKREXEKRECESIESSRCRNEARNFYQRVKRLTQGCKTGGVACKDNDGNLVTDAEIVLKLWRDHFSSLLAGSGTGYEDYDPQTPIYGTDIDVPTPSHAEVKDAIQRLKNNKSAGADGLPAELFKAAGDMLVGSMHQLISKIWRTESMPEDWNLSMICPVLKKGDATLRTNYRGISLLPVAYKVLSSVLCENLKPHAEALIGPYQCGFRPGKSTIDQIFTLRQILEKSYENQIDTHHLFVDYKAAFDSPRRDRLYAAMSELGIPAKLIRLCRMTLSNTISSVKVGNDQSETFSTKCGLRQGDSLSCMLFNILMESIVRKAGVHRTGTILSNRCVQLLGYADDIDIIGRTKRDVTAAFGAIEKESAKVGLAVNMDKTKFMVCSSRESRRLDSQLTADSYSFESVKEFIYLGTAITSTNDVSLEIKRRVTLANRCYFGLSRHFNSRALSRQAKITLYKTLILPVLLYGAECWTVVQSDAAALGVFERKILRKIFGPICVGDAYRIRWNHELYELYGDVDVVSRVKIHRLRWLGHIARMEEDAPARKVFDAVIVGKRRRGRPRMRWQDQVMEALSTSGAANWRRRAQDRDAWRQIVQQAVTRQGL

SEQ ID NO: 3124 - protein, 996 aa, synthetic construct
  source 1..996: note = Description of Artificial Sequence: Synthetic polypeptide
  VARIANT 835: note = Any amino acid
  VARIANT 955: note = Any amino acid
MQLIQLNLNHCRAAQDLLTQTVRERGSEVAILSEPYRIGNSRDWATDRTGKAALWLCGVGAQQMCDIKAADGFVRANVGGTWLYSCYLAPSLSLESFGRILDELSIDLRGHSNVVVGGDFNAWAIEWGSSRTNARGRAVLETFASLDVVLLNEGSRQTFSRAGAGSVIDLTFVSSALARRARWTIGEVYTASDHEAIECSLGMAGRPSGPPPLPRRAFRQDTFRPRAFASALEGFAVDEADGANVMANKLADAVEDACDRSMLQRRPFRGNHRPVFWWSEEIAELRRICHRSRRLLQRARGSPLLVECSERYKAARKALKIAIRDSKRESFLKLCDAAEEDPWGGAYKMTVKKLNAGGNAPSDPEALEGIVRALFPDGQPVGNFPRAEPGEFRSVTEAEVLQAGRNIKPKKAPGPDGIPSRATKLALALLPEQVAGLFNKCLQEGTFPVRWKRQRLLLLAKPGKPPGEASSYRPICLLDIIGKVFERVIATRMTEAVEAAGGLSTEQYGFRKGRSTMDAIMKVVKTAREAIAGSRWKGGTKSYCLVVTLDIRNAFNTADWGRTLESLRMFNIPSYLLNVALSYFSNRVLTTDTCLGSRAYKVSAGVPQGSVLGPLLWNAMYDGVLRLPMPEGTSLVGFADDVAIVVVAKELATVEAHADAAVQAVESWLANAGLQLAAHKTEAVLVSSRKAVETASVRVGGTTIRSQRAIRYLGVLLDTRLCFKEHLEFVHKKASGTAGALSRMLLNTRGPKQATRKLLTTVVTSQMLYAAPVWAEAAKVKSYVRGVEATYRLCAVRIACAFRTISEDAALVIAGQVPLTELVRERAEIYAAAQXREATQQTRAESKITARRRSLENWQNRWDSSQKGRWTHTLIPNLTSWVERSHGQVDFYLTQVISGHGCFRSYLKRFGHETEDWCPVCGSGVVEDARHVLFECHRFDHERQELEAVAGSSIXAETLVPMMLADQRVWEATATFAADVMKSLREQERRRKEQTE

SEQ ID NO: 3125 - protein, 430 aa, synthetic construct
  source 1..430: note = Description of Artificial Sequence: Synthetic polypeptide
SVAPCDNIFNFVCVSQCDVLDCILKVKSNAEGLDNINPKFLKLLLPCLLPYVTYIFNSILTQSSFPTAWKLAKILPIPKQNNEYRPISILPFLSKVFENVLAGQIQGFLDRNLLLHNKQSGFRRKRSCLTAITDITEDIRQQLDKNHVTILTLLDHSKAFDSVNHNILCTKLKNLFNFSDSSVRLIASYLTDRLQAVVAGAVTSAVKKLTRGIPQGSVLGPLLFAIYVNDLPNVLSDCEVHLYADDVQIYVSSPVREINVCISTCNRMLSLVQTWAEHNGLSINPKKSKSILISRRPIDTNDLTKPIINNIPISYVDHAVNLGLTFNNTLSWGNHISKATGRVYGILRQLANTRNFLPEHIRLLISKTILIPTLFYGIEIFGFCDTRDTRKLVTALNSIVRYVFNLNRFDHVSHLTTKLLDLNLNSWINL

SEQ ID NO: 3126 - protein, 846 aa, synthetic construct
  source 1..846: note = Description of Artificial Sequence: Synthetic polypeptide
  VARIANT 284: note = Any amino acid
  VARIANT 286: note = Any amino acid
TIDPAEIANTLGDLWSKQAKDSNFSPEFRTNKMLITPHNTYAPTPTAIEIEKNINLIELNSAINSLKGHTPGLDRISYSMIKNTPISFKFRILQHFNDILDSHIPQSYKLSLVLPILKPNKPKTNPNSYRPISLNPCLAKVLDKVVANRLWWFVLSNKLIHNNQFGFKRGRSVLDSLLYVDHLATRSLSLKKHISIISLDFAKAFDKIGIHSLIHQLEKWKLGPRIIKYVWNFMTNRKIIVKNGTSLSISFPLDNGIPQGSPISVILFLIAYNSLTNIISIPNXLXFTAYADDFHLILQHNRNNNPQVNLSTLFHQIGEWCSYSGSSLSIDKCQLLHICRKRSCRANIITGSINIPTTDHTKILGLTINKRYSWNHHITNLKTSLSRPLNIIKHLSSRKYNCNTTSLIQIVNSILISKIDYCLPIYGKAPTSILNCLKSTQNSAIRAALGAFRTTPINNLLIEAKINTLENRCKLLTSKLGTKLILSHNSPIGKLSKSIAKTKRNYRYPSTLDRIIDSCKSFSLPFSPAKFYTSKKYNPGIILKATNTSLSLYNKNTTSPITYHQLFHSIKNSLHDHKFIYTDGSKTNDTVGYSVTNNTDIIKSGLLPQYSSVISSELIAIHEAIKICSGSPGKYAICSDSLSSIKSISNVNNYSYYPNTIRSLITKLFPKIRLIWIPSHIGIQGNERADTAAKETHKYPLIFTDNFNTKDITQLLKKHYTDKLNSLQAQTTQWYKQILLNTPANFSFKTTNLNRQQQIIINRLRLGHTQLTNAHYMNRSLTSICPFCNTSAIDIQHILIDCTALSHVRTICFSNDNPIHLLANPTAANSNKIIYFLHKMNLIHKI

SEQ ID NO: 3127 - protein, 900 aa, synthetic construct
  source 1..900: note = Description of Artificial Sequence: Synthetic polypeptide
  VARIANT 405: note = Any amino acid
  VARIANT 469: note = Any amino acid
MHNICATGNFSYILEMEGSVDVSHSHTLLRILAKQRSGLKICHINAQSLPKKIEEFRYMFVNSGLDVICVSETWFVQDFRDSLISCDGYYVYRGDRVSHGGGVAIFVSKKLKTKFVCKHPDNSQIEYIFLEISNKFASSKILIGCIYRPRCDITYNEIISLLGDISLNYADIIVAGDLNSNMLRETHLKNEFESIGVHLVNSVFPTHFSRTCSSLLDVFFVSDVKKVYLFDQLIVPSFSKHDLIYLTYNFDLQYNDESIVFRDFKNLDYGLLMTEFDKCNWNNIFVSPTVDQQLAQFQNNISYLYENFVPVKTKVIKHSVKSWFNNDIKLAIKSRNDAYQKWKRYRTPEHYGRFKLLRKTVTKLIDSAKTNFYSSRFQTTASTSRTWKEIKSLGIGRKPAAPEQXVDIEELNTSLSKCNVPEICENNMYLRSVPRNLCDSRFRFVCVNQCEVLVNILKIKSDAVGLDDXNPKFIKVLLPKILKYITYIFNTAFTTSTFPDRWKIAKIIPVPKANKEYRPISILPYLSKAFENIMASQINSFIHDNALLNNNQSGFRKHRSCTSAILKIANDIREYADNSNVTLLVLLDYSKAFDTVNHNVLCAKLVNQFKFSKTAVKLMTSYLQNRRQSVVVSNVSSSFAFTKRGVPQGSVLGPLLFTLYVNDLPSMLSSCDVHMYADDVQMYVSRPLNRINECVDICNNELVKISNWAKENGLGLNPSKSKCIIIYKKKLSLNIGPLLLNDSPIEYVERATNLGFIFNNTLNWSDHINTAVGKTYGLLRSLYLVRNFLPLNVRMLLAKSCLIPTLFYGIELFANCDSNSQHKLKMAFNSITRFVFNLRRFDHVTRLSYNIFELHLADWIKMRVLVYLQKIIFSKLPIYLYETLRFSTSRRSNIIIQIRH

SEQ ID NO: 3128 - protein, 966 aa, synthetic construct
  source 1..966: note = Description of Artificial Sequence: Synthetic polypeptide
SSGPRASDSFNQRSKKLNNSFSLHYQNVRSLLGKLSKLHVNSVSFDANVIAFTETWLNSSVSDCEIFAGSYVIYRCDRSMRLGGGVLIAVKSDLVSQRIPIIGTDSILEFVAVRIKLHDYFVFISCSYIPPRSDISLYLQHLAQIQSIHSTLGYNDHLIVMGDFNLPDISWMTSTDSIALVPTTAHEFVHGLIDLSLGQLNSILNCSKKVLDLIFVSEFANAFVTRISPLSNPEDAYHPTLEVTLEASAPLQSCSEIEPASFRCFRRAKFAELNRHLSELDWSFMDSNDDPLHIVEQFYGILYSAFDTFVPSFPSANAPQKPPWFSRRLSFLKNSMSRLFKKFKRTGLQVDHSMYLIARSNFLVHNSVCYNGYLNRCRIEFQDNPKQFYAFVNSKRKSQQFPSCLHLDTTSASSDADIANLFAKFFQSTYSSFSYDNTSSYPYPFLTPTVIFTPLISEDDVLQNLKTIKMSFSSGPDLVPSCVIKKCADALCKPLSKLFQISLLHSFFPEVWKESFIIPLHKKGSKSDIKNYRGIAKLSAIPKFFEQLITAQLQHQCSSVMSPTQHGFMKRRSTTTNLLEFTSVIRSAFKNNIQTDVIFTDFSKAFDSVNHQLLLKKLTLLGFPIMLTKWISTYLSNRTQRVAFKSTISNSVHVNSGVPQGSHLGPLLFGIFINDLPQVVLSSYVMMYADDVKLCLPLSNPNSHDLLQADLNNLHSWCIQNLLFLNNSKCKLMSFYRKRLLLTSYSIGSNDLERINSVTDLGVLFNHNLNFSDHIGTIVSKAKGVFAFVKRWSKEFEDPYTTKHLYISLVRPILEYCSCVWSPQYTNHQDLIESVQKQFLLFALRGLNWETHRHLPSYVDRLRLLNLPSLKDRRTCHGVMFLHKLITGLVNSSYLLGQIRFSIPVRSTRYFRPIALDICKTNFEVHDPFRVLCSQYNELYFLIYSECSVNLIVTNILTHLSLPPPT

SEQ ID NO: 3129 - protein, 998 aa, synthetic construct
  source 1..998: note = Description of Artificial Sequence: Synthetic polypeptide
MMRLIQLNLNHCTAAQDLLVQTVRERRVELALLSEPYRTPASPDWAFDRTKKAAIWRCSRETQQITDVLSDIGFVRARVGRWWVYSVYLAPSLTLIAFSRALDRLAADARGRTQVLIAGDFNAWSESWGSSTTNARGRMVLEAFATLDLALLNHGNRHTFRRAGLGSVVDLTFTSGSSYRLARWRLSEDYTGSDHLAIICDLGSPPSSQAQTPAQARIKYKTDSLDTQVFREQFLPTASRQGAELTAVELMRRLKAACDASMQSSRPHSRQRAPVYWWNQEIETARRECLSARRRYQRARGAESFAERQSEYRARRKTLKLAIRESKRKCFLDLCDSADSDPWGSAYKVVVKKAYTRTPKLLDPAMLRSVAEHLFPVMDGLRPADPATGDHVDSDATVSSDEILELAKLLKDGKAPGPDGIPNRALRLALHLQPDSFAKAFTKCLEEGVFPSCWKIQKLLLLPKPGKPPEEPSSFRPICLIDGTGKLLEKLVCIRLERAIADAGDLSRSQFGFRKARSTVDAVNRVVEVAAQAIDGTRWKGGSKEYCLMVTLDIRNAFNTARWDRILEALIGFSVPAYLVRIIRSYFSDRVLLCESSEGVFRHQVTGGVPQGSVLGPLLWNTMYDGILRLPLVGRSEIVGFADDVALLVVDKYPGKAEESCNQNIRAIEHWLSSMGLELAPEKTEAVLISSRKAVETATVEVGCTKVSSSRAIKYLGVMIDTRLSFREHLAYANSKAAGVNRALSNIMLNSRGPKQASRRLLTSVTRATMLYAAPVWAKALGTESYAQGLNATHRLSALRVCCAFRTVSNAAALVIAGIPPLDLLAKENEVVFNQTHGRRLSPGVKKAIRAEARQHTLETWQHRWTNEPKGRWTQQLIPNLKPWLERKHGDITFHLTQLISGHGCFRSYLMRFGHEDADDCPWCGGGRSETAEHVLFSCVKYARERSSLETVLGGRLNADNLVPFMLQGEAEWQAVNSFAAAITTELRRAERARRVHE

SEQ ID NO: 3130 - protein, 1029 aa, synthetic construct
  source 1..1029: note = Description of Artificial Sequence: Synthetic polypeptide
  VARIANT 910: note = Any amino acid
LRRLPHLPRPKPQNNYQPNCPTHLSKSHRNRLYTKCSHSPNPLKWHPCKYDNCCPIYCPPVYKWTHENFHKLFSHFETLLDGKSNFILSGDCNSKHRCWGNYSSCARGRSLMQAIMANKLLDVVATGQATHFPFDRRKQPSALDFAICKGLRRRITRTFSSDDLSSDHLPIQIILDLEEANLQLKKVSNSILKRNTNMEKFKRILEDKMLLNTEIRTGQDIDDCIDIFLNNIKTAANEATPKNRPFTNPRENSRRRENNLSLDEATTRLLDEKKELNRILRAAGTEEAKKWFKSAQNKLAKEIRKLRTSQINNELQLIDTTDRYRMQKLWKWTNNVKKQPQPIWPLKKDDDCISMRTASPWTRTLDERAEAFASHLESRFKANLRNSIEDREIIKKELDKFKSLKPRIETGTSGLKPVTLAELDLLIKSLESKKAPGADNISNKVISNLPKKARIYLILIYNKILNTGHFPKKWKHACITMILKPGKSPSLLNSYRPISLLSGLSKIFERIILNRLYNIESFSKAIPNHQFGFRKGHGAEHQLARVTQFILKAYEDKEVCSATFLDITEAFDRVWHDGLLLKLTKLIPKQLFNVLESYLTGRTFQVRINNETCSRIGTINAGVPQGSILGPVLYSIYTSDMPFPIIKGYIRNISLPDYHPKNIILATYADDTIIISRSNNTRSAININQTYINKFCRWAKKWDIAINGKKTGHVLFSLKNISENVHTTPIVDGQRAIKLCKHGYLGVMLDRRLTFGAHLILLKGKIIAAYKRLEWLLGKNSHLPKRTKLLLWKQIISPIWHYAIAIWGSLTSATQTKKIQTLENKLIRRIIKANRYTKQSAIREKYKIKSFEEVFDQASKRYANSIADHENPLIKELLTKSFKPIRLAASRTRYVNQYTKYLLPLLQNIXKPPDEPTYKSLYSYTDKEELEIVSKIRYDYRQTLPTLLQLEDEEMEARDCKAEEERKEREKEERKKALEKGPPDRWCELLINKFSKMYKKGMITRERVIELMLGQPPTVIKLVIPDYEP

SEQ ID NO: 3131 - protein, 861 aa, synthetic construct
  source 1..861: note = Description of Artificial Sequence: Synthetic polypeptide
MSTTGKKEIRKEIGREEQPSEEDTKEFLNKIYNRGKRIKKENERIKEIIEESNRRNLKRIIITKENIENVITRIPSWKAPGIENMHGYYWKRLESVRDRLVIVFNEWLDTPENIPIEMLTGRTILIHKGGDSKKAENYRPITCLNVIMKIFTSIINRKIEEQLANNEEKYQINKSQYGNKKRSLAAKEVNINSLLERNEREVQKKRYLESFYDIRKAYDTVNDEWLENVLRYFKIPFQITELIKSMSSRWRIRIGYRYKEEIREVKIKNGILQGDSISPLLFILQMNIISDVIDRTNEKRLKVKHVLYMDDIKVTSETKKGMEMVHKNIIETIEVIGMEVNVNKSGVMKKGNIGIQDNMKDIPIVDSEHQYKYLGVYQFTRNDDVGCIERISKSIEEGIKENNKGNDSSMNYINRINTEIIPKFTYSASVVKLPIMKLIEIDKMIRIEVKEGKIIGAGMCTSRLYVNRNKMGDGLKSIRDEYAIKLIRSILYYTWKRGNRIGDMIGINENKNRMLNRLYKSMLKKRINKEEFRKIVEEERGKRDKNRIIKYVREKFQEDYINKWRNKKVNSEILKGFEDKTMEQKKTIKVWKGINVIRKAYIQIKKMEEKARNVGVRKALMKHDMRYAICPICNKIATINHILLNCIVTKKTQMNKHDRIGEYIWRSLKIKYQLYENKEKMKMREEENTKKLIIRKEELGKNERRIEKDKILIVWNHEVVNRSEDKFHKRIDIYVRDLNKKEAMIIDMTIVRDKNISKAFTDKINMYSKLHEHIRKIERLVRVIVIPVVITVSGLINKETVILLNAEGIEIPREIMTREIVISNMKDLMRYCGDHSGEYSNVEIPEEEDSQESEGREEILT

SEQ ID NO: 3132 - protein, 982 aa, synthetic construct
  source 1..982: note = Description of Artificial Sequence: Synthetic polypeptide
MVQNNPMYKRGRGGVTLPGGSPGPPSGARPRGRARRRAPGGRVCHGARSGIARKSNVAPPSPSYGPTTHGRNRWGRVRCHMGGSEGQGPRRTRPGRQGLALGTWNVTSLWGKEPELVREVERYQLDLVGLTSTHSLGSGTVLLDRGWTLFFSGVAQGVRRRAGVGILTSPRLSAAMLEFTPVDERVASLRLRVVGGGISDCCLCICPEQQFGVFGLLGDPEWSPVWGSSRGLHNSAGGLQRTRGQFCDRVIGSETACFGHSGKERGGAVNRSPSGGELGQGVGEDSGQTGKTQTGSAGELGTSGGGPRPKDLHSHLRRSFSGIPVEVGGIEPEWSMFKASIAEAAAGSCGLKVLGASRGGNPRTPWWTPVVREAVRLKKEAFRDMLSRRTPETVAVYRQTRRAATSAVKEAKQRVWEEFGEAMEKDFRSAPRCFWKTVRHLRRGKRGTIQAVYSKDGTLLTSTEEVIGRWKEHFEELLNPTNTPSIVEAELEADGEASSISMAEVTEVVKQLHSGKAPGIDEIRPEMLKALGVEGMSWMTRLFNIAWESGKVPKEWRTGVVVPLFKKGDQRVCANYRGITLLSLPGKVYSKVLERRVRQIVEPQIEEEQCGFRPGRGTTDQLFTLARILEGAWEYAHPVYMCFVDLEKAYDRVPREILWEVLREYGVRRSLLRAIQSLYVQSESCVRVLGSKSDSFQVGVGLRQGCALSPILFVTFMDRISRRSRGGEGLQFGGLGISSLLFADDVVLMASSVCDLQHSLDRFAAECEAVGMRISTSKSEAMVLSRKPMECLLRVGNEALPQVKEFKYLGVLFASEGTMEREIGRRIGAAGAVLHSLYRTVVTKRELSRKAKLSIYRSIFLPTLTYGHEGWVMTERTRSRVQAAEMGFLRRVAGFSLRDRVRSSAIREELGVEPLLLCIERSQLRWFGHLVRMPPGRLPREVFQARPAGRRPRGRPRTRWRDYISTLAWERLGIPQSELANV

SEQ ID NO: 3133 - protein, 1080 aa, synthetic construct
  source 1..1080: note = Description of Artificial Sequence: Synthetic polypeptide
MMTPTSTTAANLSTHDDQHCPISTCPGASNTDQWILCDHCQKWYHTACVAVVIIPEEEWLCPTCVISVTSSQSQVTPSSLNTTTTTKKKHIIATTQYWLKSNLVEDPLGLIPKSEIVARYAHHIQTSGEGRVVDATVGKYILQLFPSTKFSRPPTRGAANAYIGIRWKDQPPLLPHAPRNWGAELSQLKNTVPTLRRVPKGARMEVAKALAKIIEEVTTTNSEESWFKLFSFPYAVVPVPTKSDKVKNLTTWVKSRVLQWSITQIVTPSRPRPQFAKPSRPQETIAKKVEAKLADGDVRGAIRLLTSDDTIAPNNQETLDALITKHPPHPEPTYFPNAPDKAEVLAPVDPKEVLIAISSFAPGSAGGLDSLRPQILKDLVISENGEPATNLLNAMLKFLDLVLRGDVPKSICPIFFGASMTALRKKTGGIRPVAVGNTWRRLISKIAVARMSSTLVEIFSPHQLGVGIKGGAEAAAHAARIYWNYSHDSPKAFLKLDFRNAFNEIRRDTLLQIIREKFPNFYRFVSQAYSSPSEIFFAGTPISSLCGVQQGDPLGPALYALVIQPIVDLIDTELNMWYLDDSTIADSPEKVLMAMQTITRMGTEVGLHLNTTKCEVGILGVVDDQTRDEIFELFRSTAPGIQKISPESAMLLGVPLTDEAIPTILGAKTEEMEKISTRLLKLSSHSAFFLLRASISTPRLIYFLRCAPTWRRFDALTLYDAKLKNAMEGIINCSLSPQSWLQSSLPVNKGGLGVRHAIDVAIPCFLASIYSSLPLAERLLPPHLHGIDTAIQEGEERWKSLGSSPLPPLEIRGIQAIWEIPQQEGVINHLTTNATTLEDKARYHAMSQPNVGAWLNAIPSPQLGTHLPNETFRIAAALRLGCDICQPHKCSCGEQVSTKGYHGLSCKNSAGRHSRHAAANDVIARALRSAGVPIIKEPAGCAREDGKRPDGLTLIPWARGKSVVWDFTCSDTFAPSYLPQTSIRPGVAAEKAEDRKKKRYEQLMDSFLFVPIAIETTGIWGKDGLSFIKEIGSRITNITEEKRATSFLLQRMSITVQRGNVASILGSLPKGHKLEEIFML

SEQ ID NO: 3134 - protein, 877 aa, synthetic construct
  source 1..877: note = Description of Artificial Sequence: Synthetic polypeptide
MRRDRDFSTSSVLCFTETWLCGSIPDSALQLAGFQLLRADRDTELSGKTKGGGICFYFNNSWCNDVTVILQHCSPDLETFFINCKPFYSPREFASFILVGVYMPPAGNVHEAQRTLADQIRRVERTNPDSLVIVLGDFNKGNLTHELPKYRQFIKCPTREENTLDHCYTTVSRAYHAVPRAALGHSDHVMVHLIPAYRQKLKLCKPAVREFKKWTSEALEDLRACFDCTDWDVFRTATDSLDEFTEAVTSYIGFCEDSCVPSCTRVSYNNDKPWFTAELRTLRLQKDQAFRSGDKDLYTEAKYKFSKAVRDAKRLYSEKLQQQFSASDSASVWRGLKHLTNYKPKTPHSMNDLRLADELNEFYCRFERQCPDPIPHSSTNLLQSPSPPSPSPSGAHASSSISPSPPPPATTLSILERDVNRLFRRLNPRKAAGPDSVSPHSLKHCADQLSPVFTDIFNTSLETCHVPACFKASTIIPVPKKPRITGLNDYRPVALTSVVMKSFERLVLTHLKSLTDPLLDPLQFAYRANRSVDDAVNMALHYILQHLDSPGTYARILFVDFSSAFNTIIPSLLQDKLSQLHVPDSTCKWITDFLSDRKQHVKLGKHVSASRTISTGSPQGCVLSPLLFSLYTNSCTSSHQSVKLLKFADDTTLIGLISGGDESAYRWESDHLVSWCSQNNLELNALKTVEMVVDFRRNRAPPSPITLCDSPVTIVDSFRFLGSIITQDLKWELNISSITKKAQQRLFFLRQLKKFNLPKTMMVHFYTAIIESILCSSITVWYAAATAKDKGRLQRVIRSAERVIGCNLPSLQDLFASRSLKRAKKIAADPSHPGQKLFVPLPSGRRLRSIRTKTSRHTNSFFPSAVGLINRARSPTA

SEQ ID NO: 3135 - protein, 1060 aa, synthetic construct
  source 1..1060: note = Description of Artificial Sequence: Synthetic polypeptide
MKKRKREGVTRPGGSPGPPFGARPRWRARQRASGGRVYRGARPGTARRSDAAAQHSTPHGLTTCGGNRWGRVRCYKGGSDSGGSRRNRPGRQMLALGTWNVTSLGGKEPELVREVERYQLDLVGLTSTHSLGSGTKLLDRGWTLFYSGVAHGVRRQAGVGILISPRLSAATLEFTPVDKRVASLRLRVVGGKTLTVVCAYAPNSSSEYSAFLETLNGVLHGAPVGDSIVLLGDFNAHVGDDGDNWRGVIGRNGLPDLNPSGCLLLDFCASHGLSITNTMFEHKDVHKCTWYQSTLGQRSMIDFVIVSSDLRPHVLDTRVKRGAELSTDHHLVVSWVRGWGKTRDRPGKPKRVVRVNWERLEEAPVQKIFNSHLRRSFSHIPVEVGDIEPEWSMFKTSIAEAAAVSCGLKVLGASRGGNPRTPWWTPVVREAVRLKKEAFRVMISGGTPEAVAVYRQARRAAASAVMEAKQRVWEEFGVTMEKDFRSAPKCFWKTIRHLRRGKRGTIQAVYSKDGTLLTATEEVIGRWKEHFEELLNPTTTPSLVEAELEAEEGSSSISLVEVTEVVKQLRSGKAPGIDEIRPEMLKAMGVGGLSWMTRLFNIAWKSGTVPKEWQIGVVVPLFKKGDQRVCANYRGITLLSLPGKVYSKVLERRVRPIVEPRIEEEQCGFRPGRGTTDQLFTLSRIIEGAWEYAQPVYMCFVDLEKAYDRVPREILWEVLREYGVRGSLLGAIQSLYAQSESCVRVLGSKSKAFPVGVGLRQGCALSPILFVVFMDRISRRSRGEEGLQFGGLRISSLLFADDVVLMASSVCDLQLSLERFAVECEAVGMRISTSKSEAMVLSRKPMDCLLQVGNVSLPQVKEFKYLGVLFTSEGKMECEFGRRIGAAGAVLHSLYRTVVTKRELSRKAKLSIYRSIFVPTLTYGHEGWVMTERTRSRVQAAEMGFLRRVAGVSLRDRVRSSAIREELGVEPLLLCVERSQLRWFGHLVRMPPGRLPREVFQARPAGKRPRGRPRTRWRDYISALAWERLGIPQSELVDVAREREVWGPLLELLPPRPDPG

SEQ ID NO: 3136 - protein, 962 aa, synthetic construct
  source 1..962: note = Description of Artificial Sequence: Synthetic polypeptide
  VARIANT 3: note = Any amino acid
  VARIANT 6: note = Any amino acid
  VARIANT 9: note = Any amino acid
  VARIANT 10: note = Any amino acid
  VARIANT 19: note = Any amino acid
  VARIANT 34: note = Any amino acid
  VARIANT 43: note = Any amino acid
  VARIANT 59: note = Any amino acid
  VARIANT 86: note = Any amino acid
  VARIANT 147: note = Any amino acid
  VARIANT 192: note = Any amino acid
LDXRHXGIXXVQEGSYWKXGGVALYVKEHYTSLXVKIGCKEGXLETLWVKIRGERREEXLIVGVYYRPLTKNSLENWQRLHGIMGXFNYPDISWDEYSARSDRSQSFLTCIEELYLTQEVYEPTRGKALLDLVLAKGDDLVSNLRIXGKLGNSDHEMITFSIHCKPGKSASRVEIPDFRKADFHKLRRLVGXGLRSNEEGNTRRVVFPQGSNPKSSKKVYSLSQERQQKSWETPLAQQGSHGPPEIKARSLQGMEVRNNYQRGVLSSCPHLKSLILGKLISTNSGDWLVRDYGPMRKGIQEEWSFLKEAILKAQRKSIPSHKKGSKRAGRPPWLNREVMDLLKLKREAYKGWKSGTTTKEEYSAAARTCREQIRTAKALTEHKLATRIKDNKKSFFRYVGSCKRNKGSIGPLINEMGRLLTDTQDKTELLNEYFMSVFHQSKGISLLDRIQDDHGGGDHPPIVDVDLVGEHLQRLNIYKSAGPDELHPRVLKELADVIAQPMAKLFEDSWHSGEVPEDWKKANVVPIFKKGRREDPGNYRPISLTSIPGKILEKIIKETITHRLTEGSILKGSQHGFIMGRSCQTNLISFYDQVTCHLDRGNEVDVIYLDFKKAFDLVSHDVLMVKLGKCGLDYFMVWWLGNWLCGRTQRVLIDGTESSWQRVTSGIPQGSVLGPVLFNMFINDLDSGITSNLAKFADDTKLWGSVVTLKDRLAIQADLDRLMKWADLNLMSFNTEKCKVLHLGRNNPQHTYRLGSALLASTTTERDLGVMTDNKMNMSHQCDAVAGRANQTLACIHRGILSKAKDVILPLYSALVRPQLEYCVQFWVLHFKKDVEKLKRVQRRATCMIRGLETKTYEERLRDLGLFSLEKRRLRGDLVAAYKYIRGVHQGLGEHLFTKAPQGRTRNNGHKLIEDRFRLDIRKNFFTSRVPRVWNRLPPEVVQSSTLAIFKKRLDAHLAGII

SEQ ID NO: 3137 - protein, 729 aa, synthetic construct
  source 1..729: note = Description of Artificial Sequence: Synthetic polypeptide
LVRGLRVLDPLGDSDHCLLEFTIQRKVAKASSQVVALDFRRANFNELRRIVGEALKTQRGGEPGVQGEWSLLKETILQAQRKVIPRRVKGGRRAYKPPWLTKNIRECLLAKKEAYSQWKGGVITKEDYSAVARGCRGMVRKAKAEMEQGLASRIKDNKKSFFKYIGSRKKAPGNVGPLQDKTGNLVVTPDDKANIFNNFFASVFLSKDQNCHLPAGPPLGPGGGSPGPRVSEDLVRELLEGLDVFKSAGPDDLHPRVLKELAGVIASPLARLYEHSWCSGEVPEDWKRANVVPIFKKGRKEDPGNYRPVSLTSILGKLFEKIILAHIQEGPAGNGMLRGNQHGFISGRSCQTNLVAFYDQVTKSLDAGVAVDIVFLDFRKAFDTVSHPILIRKLGDCGVDTHTVQWVANWLESRTQRVVVDGSFSTWKDVGSGVPQGSVLGPALFNIFISDLDEGVQSTLFKFADDTKMWGDVGTIEGSNRLQLDLDRLQGWAEENRMGFNTDKCKVMHLGRNNRHHTYRLGNSPLVSTEVEKDLGVIIDSKMNMSRQCGEAARKANCTLSCIHRCISSRSKEVILPLYAALVRPQLEYCVQFWAPHFKRDVDSIERVQRRATRMIKGQQGRSYEERLRDLNLFSLQKRRLRGDLVACYKLVRGDQQALGESLFPRAPQGVTRNNGHKLAEGRFKLDIRRRYFTVRAARVWNQLPSEVVQAPTLGVFKRRLDDHLTGVI

SEQ ID NO: 3138 - protein, 666 aa, synthetic construct
  source 1..666: note = Description of Artificial Sequence: Synthetic polypeptide
MGVQDGWSFLKETILRAQRESVPMHTKGGKSAKKPPWLSKGIQECLRAKKEAYIRWKQGAITKEDHTSVARGCRAAVRKAKAEMELGLVTRIKDNKKSFFKYIGSKKAAPGNVGPLQDALGNLVIAANEKADLFNKFFASIFLSRDRDISPTGSTEGLRGGTARPKVRDDVVRELLEGLDVFKSAGPDALHPRVLRELAGVIAGPLARLYEHSWSSGQVPDDWKKANVVPIYKKGRKEDPGNYRPVSLTSVLGKIFEKIIKEHICEGPAGEIMLRGNQHGFIKGRSCQTNLISFYDQVTKSLDEGVGVDVIFLDFKKAFDTVSHPILIKKLGDCGIDAYTVRWVANWLDGRTQRVVVDGSFSTWRDVGSGVPQGSVLGPVLFNIFINDLDEGVESTLSKFADDTKMWGEVGTPEGRDRIQLDLDRLQRWADENRMEFNADKCRVLHLGRRNQQHTYRLGNTLLISTEAERDLGVIVDSRLNMSRQCEEAVSKANRTLSCIHRCITSRSREVILPLYAALVRPQLEYCVQFWAPHFKRDVASIERVQRRATRMIRGQQGRPYEERLEGLNLFSLHKRRLRGDLVAVYKFTRGDQQGIGDALFPRAPHGVTRNNGHKLIESRFRLDIRRHYFMVRVARTWNQLPREVVLAPTLGVFKRRLDRHLTGVI

SEQ ID NO: 3139 - protein, 1318 aa, synthetic construct
  source 1..1318: note = Description of Artificial Sequence: Synthetic polypeptide
MKFMCWNCRGLGNPAKLRELKQLIAANNPDLIFLSETKMSANDFRRVQNKCRMQNGLAVNSEGRSGGLALMWRDGMNVSIQNYSKHHIDSMVKLENNDNIRVTGFYGHANPNLRSSSWDILRRVGESVREEWIVGGDFNAILNDAEKEGGRRGVRAQMNEFKEVMDDLALVDIKPDSGWFTWVNNRRGGVTWGGLIKERIDRFISSVSVAEKFPFISTKVVRQTQSDHDAIILDLWGRKPKAYPTDKRLCFKFDVCWAGDVEAKNVIERAWNRAATDFGEKIERVRLALGPWQRKKYGNLKRDMQKLEKHIDWIIDSVSSEESGRTLKETRRRLDFLYAREESYWAQRSRSIWLREGDRNTRYFHAKATGRLKKNVIEKLQNAEGQWVTNSEDINKVAKDYFVKLFRSNGQNANTQEMGFIKDCVTRETNEWLCMDYTEKEVLQAIKQMDPNKAPGIDGLSGSFFKHHWDIVGKDTISYCLEVLNGNKNISSVNETMIILIPKIKNPCELTNFRPISLCRFVYKIISKVLANRLKAALPSCISQNQSAFVPGRMIHDNVLIAHELLHYLQSSKNGPNKGLVVKLDMSKAYDRVEWNFIENVMKKMGFVDKWIAKIMECVRSVTYTVKCNNTLSDIFVPERGLRQGDPLSPYLFLFCMEAFSRMLIHAQENNTLRGIRASRNGPRINHLFFADDALLFVRNKRSDIECLVTMLDIFSNISGQEINFDKSMILFSPNTPRAQRILFSDLLGMTVVEKLNNYLGLPIPIGKKKTEAFKEITNRMSCRINSWTKRLLSFEGKEVFIKAVLQSIPTYAMSIFLAPKGIIDDIQAMLSRTWWSGKDKGGFWTMIPWKTLCKPKGMGGLGFRDVRLFNLALLGRQVWRLLNNTDSLCFKVLSSKYFPDGNIFHAKKVDKASFTWSSIAKAVEAFQDGFGWQVGNGEKINIWADNWGMEGLNGAAVISNTLNHSEKFVKDLWHLDRRSWDENKVKQAYGQDWGDKICDIPIGDEVQEDKIIWFHNTHGCFTSKSAYSWLLLKEMGCGPHRFFWRALWKLDTLPKVRVFTWRVGHEILPTNGKIASIRPGFNKGCPRCGAEVETLLHALRDCPTSRAVLSIGGWSRSFISKSYDHCIDWLEDLMRVLDKRAMADLMTILWNCWNNRNNFIFRGKEEEAQLIWERASNLSKEFRICNMLHAPLISQNIAEKRWVKPPKGFLKINFDATVGETGIGYGTVIRDEEGFVLGGGGGFKEGRRSVEEAECVAFEQSIDVACKLNIKDHVLFETDHAGLVNRINNLANDVTIIGARLKDCTVAFTFFKSASLI

SEQ ID NO: 3140 - protein, 1164 aa, synthetic construct
  source 1..1164: note = Description of Artificial Sequence: Synthetic polypeptide
  VARIANT 1036: note = Ile or Leu
MQRMSELGAGLGVVAEPYWVPVRSVNWFGSPDGSVAMVANPAAGTPPCVFRENGSSYVAVDWGPITVVGVYLPHHRNKAGLGELAPVKRVLDRIGELVRRCHPRPVVIAGDFNAHSEGWGCSPRQRDPRGEAVIGWAAGLGLLLMNRGSTSTCVRPGGQSVIDLTWATPSAAGLFQEWRVEAEGESLSDHRHIAWALRLPKPARVLARCPGEGNFPLPKRWALNRLDTDRFRAAVLAATWHLDVGPGEWDPSPAEGAGEIVGIVASACDAAMPQSHPRRRRATYWWTEELENLRDSSVQARRRYYRARRRGGDVAGTKEGYLRAREALKAAIVEAKRAAWEQMVSSLDDDPWGRPYKRVMGKIRPWAPPPTESLDRQALEGLLDALFPRAEGGPPEIPTPPLGEGDWDEGLAVSPEELTAARRRLGAKGKAPGPDGIPGRAWALALGEGNLSAATCRVLSGCLREGVFPPEWRRAKLVLLPKEGKAPGSASAYRPICLLDEAGKMLERIVADRLVQHLSSKGPNLHDRQYGFRPGRSTLDAIQCFRDLTRAVVEEEGGVLLAVSLDITNAFNTLPWPEIGRALEHHGVPVYLRRILSAYFGGRDLAFPVEGGVQGRRAMERGVPQGSVLGPLLWDIAFDRVLRTPLPPGCHVVCYADDTLVVAGGRAGGKPASERRRHWHRWWEPSETWVSRWRPKRPRPCSFTAGVGGRRRRPGSSPGGELGGSPPPSGDGIGIGGGNHQRPGSQGGAPKDPGRVLSRQGSGGAAGDPGPRRWRPRPRRADDEISRPDAGQPMELRTPLQGTGPQGAQGRTGCSQPDAHPRGPRLEGSPPVRHGGALDRPVRGAHMGATAGGLPRRKARAAAGPEARANQGDSGVPYRVVHGGDHPGRRPPCGAPRRGEAPPLLEGEGAPRGGEPVGQGPEGSEAPGRGPDPGEVEGLAVRPPGARASDGRGCPPLPVRVAGRRGRGLSFRLAQVLTGHGCFGRYLRRIGKELTTRCHHCPALEDTAHHTLAACPAWAGERRVLAGAVGCREGEXSLPRMVKAMCGSEEAWAAAVSFCEAVMSQKETAEWGRRPHRARGAAPGGRGTRQRARGGAGRGGLPDPRGPGAPSAARARHRSQGGSRGRRAAFPAFPPPSDRTSRDRGERCPGWGWARSPTNPPLPD

SEQ ID NO: 3141 - protein, 1030 aa, synthetic construct
  source 1..1030: note = Description of Artificial Sequence: Synthetic polypeptide
MDSTYRNDFEKISNLFQTNTFNLDNESDPDINYFNEINGSKFECSYFYPDKIKSIFKNNDNRDYFNIIHINIRSLKKNFDNFLNMICQTENFFNVICLTETWCTEEDFKSNSNLHLTGFNTVFLERNVNKRGGGVLFYIKENLAYNIRSDMSVSDDNIEILTVEIINKKSKNILLSCCYRPPTGRTEYLSNYLVHNIIEKTSQEKKKNYILGDFNLDCFQYNEKKYITKFYNHLFETGTIPIINKPTRITKSSSSLIDNVLTNDYFNITLKKGIIKTDVSDHFPIFFCLGADHKTNTNGKITLKKRIYSNNNLNLFKEQLLHQDWSYINFNEDINIIYKSFFNIFYKIYEANFPIREIVLNAKDISCPWITKGIKKSSKIKQKLYIKYLKNKSDKHKNNYTVYKNLFEKLRKKAKQIYYSDLLIKHKHNSRRVWQIMKEITSKHKTNTNTMPNAIKFENKLITDSNEIAAEFNNFFSSIGHNLSNKIPYVDNNSVDEFISSPNSTINFSNLTYNEFEIAFKSLKRNKAIGPDDINGNIVIDSFNEIKDILFKVFKASITQGSFPNSLKIAKVTPIFKTGDHTNITNYRPISVLPVFSKILERIMYNRIYTYLIDNKLLYKNQFGFQRNSSTEHAILQVTRSIADSFKNSQFTLGIFIDLSKAFDTVNHHILIKKLESYGIKDKTLNWFKSYLSNRKQFVYNKESSSQIIKNITCGVPQGSILGPLLFLLYINDLYKASTLTTVNFADDTNLFQSHENIEILFNNMNNELKRISYWFRKNKLSLNTDKTKFILFHPTSKKKRIQNILPDLFIDNTIIKREKFTKFLGVIIDENLSWSQQIDSISMKVAKNIGVLYKARYILNKKQLTQLYYSFIHCHINYANIIWGSAHKTKLKSLYRHQKHAARIINFGNRFSSSTPLLIEMKALNIYELNIFNILCFMFKCKENLSPSVFINLYNLKPKNKYELRDSKNIQEPFCKTKIDQFCISYRGPFLWNKIVLPNFDFSFKWSYSSFKKKTKEIIFSTQNIFIYF

SEQ ID NO: 3142 - protein, 1206 aa, synthetic construct
  source 1..1206: note = Description of Artificial Sequence: Synthetic polypeptide
  VARIANT 239: note = Any amino acid
MVRKEDFEALVSRVLKLEAELQIKDKEINDLKIVVNDMKNQSKLVSNSNDVSNTWSDVVKGRKKNTSVQLDLLNVVVKESHDREIRQKNLVVFGFKTSTNKDESVAKEDDKQELQNLFKQINVKVTIQRVFKLNTKTDKPPPVIVVLTNKEERNAVLKTAKNLRNSPETNNIFINADMTEAERFKMKALREERAKLNEANQDLKYYYGIRNERVVKLLKKLYESTQPYQQISPKKVLYXNLNNITKNPNDRHLLNSNKRLIVYYTNSTSLNNKKNDFRALIDIEKPDVFAVTETWYTPLSDVNIEGYVIYRNDRLNGKKGGGVCIYVNSSIKSYEISNIELKSDLIEQIWTWIEYGQEKVLLGCIYRPPDSSCVTNKNIINSIIAAKRAQDKKQFTSIIITGDFNYNTLKWKDSVEESHSQQAEDFVACLNDCFFEQCVTEATFQSNENELTNILDLVIVDDSNRIFGLSHLPPLGLSSKGHHILKWFYKMKDRIDDFSSSTKKFAYRRGNYEKINVYIKSINWADEFQNKCIDKCYDKFLYHYNQSCKNYIPIVKLKNKASEVWMSNSLRKEIKYKNNYWTTNKKMNWSIAGSKEKYNKMKRNILKQINNSVKNYERNLVNQVKNEPKLLYSYIRKKQKVKNHIRALNDNIGSTMYDKHSIVDIFNKYFHSVYIKEENINDCNFEVQTNSRFGKIFVDQALVKSYLSKLDINKSSGYDEVNPYVLKVCSESFSIPLSIIYQQSLTNSDIPDLWKMANVSPIFKNGSKLQAINYRPVSLTSIPCKVLEKIISDNLKNYLESNNLFCKQQHGFLKGKNCITNLLESLDFLTYQLMIGNSIDILYTDFQKAFDRVPHKRLISKLCGYGIEKEMLNWIETYLSNRKQRVIIGDTKSDWLEVLSGVPQGSVLGPLLFLLYINDLPSKIKNKCELYADDNKIIAVVNNQVDSKSLQDDINNLTEWSDKWMINFNIKKCKIMHFGKHNKNFEYFIKDSKLDSTTNEKDIGLLISNTMKWNQHVNMVVNKANSRLGLLSKSFTYKDKNTMKILYCTFVRPILEYASPIWNPYNKNDIHKLEIVQQRATKLIPELRHLPYEERLKKLQLTSLKIRRLRYDLIQYYKIFHNLDKVCWYQQPKTAISISANGPASNIRGHKARVDIELIKRNRPRENFFTNRVAKWWNKLPEEIISAKSVNIFKDKLDKHMVIMKL

SEQ ID NO: 3143 - protein, 717 aa, synthetic construct
  source 1..717: note = Description of Artificial Sequence: Synthetic polypeptide
MMPIINKSTRITQHSCSAIDNIFTNTLFHSTFKSGIIRSDITDHFPVFAIFKKPKDLQKKDWYFKKRIFTTRAKNMFKLELSTVNWNFVFLETCANNSYDLFLDKFFNLYDKHFPNKIIRIKTKGLLNPWFTKSLLKSSKRKQKLYIRFINSKKERDKHNYLEHKRLYERTKKIARTTYFKNKLLELKGNCKKTWDAIKEILGKQKIHNKALPSVITVDGTQISDVKSVATKFNEFFVNIGPNLASKIKHTPAHFLSYLSKSDKSLAFKKLTSKELDDSIKKLNKNKATGYDAISASVIKDCYELIKDVLLDIFNKSLKTGVFPDKMKVAIITPIFKSGDESLVTNYRPISVLPVFSKILERIMYNRIFAFLYDNNLLYYNQYGFRSNYSTEHALMQLVEVISEASSHNKFTLGIFLDLSKAFDTVNHQILLEKLKYYGISHEYHKWFTSYLTDRKQFISLNDGFQTNKLKISCGVPQGSILGPLLFLIYVNDLYKASNTMSTIMFADDTTLFYSHSNIISLFQVANNELEQISNWLIANSLSLNADKTKFSLFHSKRKFQSIPKSLPMLYINNINIERSFTNKLLGILIDENLSWRDHINHISNKISRSIGILYKTRQILDKSTLTQLYFAFINSYLSYGNIVWGSTNKSKLDCLLKQQNHAARIIHFQNRFTNAKPLLKSMRALDIYELNIFQNYTIYVSTSVKKNAEGFRKYFP

SEQ ID NO: 3144 - protein, 1018 aa, synthetic construct
  source 1..1018: note = Description of Artificial Sequence: Synthetic polypeptide
  VARIANT 348: note = Any amino acid
  VARIANT 617: note = Any amino acid
MENNLSYNINAKNIVFSDNNSDNHTETLLQSEYYSIPESTQYLCENKNKFSILHINIRSMNKNFENFKCLLGELNHDFKIICFTETWLKSNETNSNFELRNYTSVHQMRDICVGGGISIYVHNSIDFIQRKDLNVNNTDCEALCVEIINKLAKNFIINAIYRTPAGSLKTFKTYLRTFLTTKNILQKHVYVVGDINIDLLNHALNSEAKTFIDILLEYNLIPTINKATRVTKKSSTLLDNVITNNFHNSRFKTGIIKTDLTDHFPIFFITESVTLNNATHKSTVFMRQINESSICQFKNLLNNYVDWNLVLQSHDVNNAYDLFLNQFSKMYDKAFPLKVKLINSKSVXSPWMTKGLLKSSRKKQKLYDKYLKNKTYKNETNYKNYKNLFEKTKKQSKVNYYAKLLEKNKGNPQKTWSVIRDLIGKNKIEKNNLPQKLIIEGKMIYHKEVIIEKLNNFFLDVGPNLAAKIPIGQKKFDSYLATTDLIMEEPILTKSELHTAFNSLKKNKSAGIDQINVNVIKSVFDIIEPSLFHIFNLSLKSGHIPDKLKIAKITPIFKSGDETNISNYRPISVLPCFSKLIERIMYNRLYKYLSENKILYNNQYGFKKNHSTDHAIXELVKHISNGFNSDCYTIGVFIDLSKAFDTVNHEILLKKLENYGVKNQSLLWFKSYLTNRKQFILKESKDSKNNLITCGVPQGSILGPLLFLLYINDLYLSSKVLNTILFADDTNLFYSHKDITVLFKIFNEELDKINEWFISNRLSLNVEKTKFILFHKPSKAENIPLKLPNLLINNKIIKRESTTNFLGVLLDEKLSWKFHIKYIEGKISKNIAMLYRTKPFLNNESLKNLYFSFIHSYLSYCNISWGSTNHAKLKKIYSKQKHACRIVFGANRKTQCEPLLRQLGALNIYKLNIHQVMIFMFKAKLGFSPVTFQSYFNEISHKYPTKFSVNNFVVPINFLKLSSYQIQYRGPLVWKEFLPIFSKKQNFVLNCTLQSFKDDSKRHLLNMEFDILDFKYLF

SEQ ID NO: 3145 - protein, 1089 aa, synthetic construct
  source 1..1089: note = Description of Artificial Sequence: Synthetic polypeptide
MKNKTLCIFCFKTVTDNHKAIYCDCCSSWVHAKCNQIDLLTYNLLSEDSSEWYCFNCISKNMPFGLLTDNELLTTLSCKNPQTASSNFLVSPIHSRNILKELNTISGSAINCKFYDVVDFNKAIKPNSDIYLHLNIASLPYHIDDLCSLISTLNIIPMAIGITESNLYLNDTNITDITINGFNIEHCPTEAKKGGALLYLQSNLNYVVRHDLKIYLPKLLESVFVEIIKPHKTNVLIGCIYRHPSMNQNEFNTTFLTPLLEKLSKEQKLIFLMGDFNVDLLSYSESNPTSNYLDTLCSYSFNPSIILPTRITTKSQTLIDNIFMNFYSSDHLSGNLTISISDHTAQFVCVPGTSNQPNKVKISRCLKRCLKKFDPNKFIIEISKINWELIIKKDDNINESINNFLKSFNRVLDQCAPYKTLTKNQIKLKSKPWISKGLLKSISVKNKLYKKFVRCKNINTKNELFTKFKFYRNKISNLLKSSKKSYYITYFNNNINNIKNTWKGIKDIINIKGSLHKTPTQLNLNENIITDHATVSNIFNNYFVSIREKLLNNIMPSEYTYSDFLNFPNANSFFIDPVSEDEVSSLISNTLKNDKSYGPNSIPTFFLKLTSHIISKPLSIMINNSFKNGKFPDVFKVAQVIPIYKAGSLLDFSNYRPISLLSNLSKLFEKAMHNRLYKFLDKFKCLYQHQYGFRSKHSTTLALIEITEKIRRALDNKHFACGVFVDLQKAFDTVDHSILLTKLEYYGIRGIPLKWFTSYLKNRTQFVSINSTKSDLQNCSNGVPQGSVLGPLLFLLFINDLNTSFKFATAYHFADDTNMLLVDKSLKKINKHINHDLGNLVQWLRSNKLSLNSNKTELIIFKSNLAPIKKQLNFRLSGQKIYPLDSIKYLGIKIDSNLSFQGHLNDLAMKLSRSNGMLAKVRHYVNLETLLNIYHAIFGSHLRYACQVWGQSHKQIILRLSHLQNKALKIIYFQYNNSKSNVLYLISKILKISDLVVFLNCLFVWNYHHKNLPLSFNNFFSITNCHYPLRSISSLNLVIPKHQSAKYGNKSIKYQCISSWNKLPPDLKSLNSISEFKIKLFNYLLKKYN

SEQ ID NO: 3146 - protein, 945 aa, synthetic construct
  source 1..945: note = Description of Artificial Sequence: Synthetic polypeptide
  VARIANT 87: note = Any amino acid
MSENSLYNLVSYKMISQPRVNSKGGGVAVYILDKFEFKKNNTFSKTNKHIETLCIEVLNTSGKSFLISSLYRPPCGKQVNFLNILKXFMSQMSKQNKHVFFAGDTNMDALSYEKFANIKNFFNLLFEFNIIPTIFKPTRITNQSSSVIDNILTNCSLNTKFESGLFIADFSDHFPVFHIAREVLSNIDNKKCFVTYRNLSIKKLKKNLNNFKNKLQVEQWDKVYSSTDPNIAFDHFSSTFQNIFDNVCPKITTEIKNKEYKNPWMTITLIKASKRKQKLYVKFLKSKNKEDEKIYKNYKKFFQHSMKEEKIRYFSNQLDKHKFDIKRTWAVINELTGREKKKHTCTCLPQKLISDKKNYNKYNKNMSRIFPIKKIITSTTKICQEFNKYFVNVGPSLASNIVQPNKTFDNFLGEKPTTSINNEKITKLEFNKAIIELKRNKSCGYDGISSNVAIYIMDSISKPLFYLISSSFENSIFPNKLKLAKINPILKKGDCNNVSNYRPISLLPVLSKVFERIIYNRVNNYFTLNNLLYKNQFGFQSKCSTEHAIIKLADKIFKSFDSDELVLGVFVDLSKAFDTVDHSILLSKLKYYGIIGSTFKWIQSYLSNRKQFVLLEKSGALDITCGVPQGSILGPLLFLIYINDMHKASQKISTIMYADDTNLFFNHPBAKTLFETMNIELEKFNLWFIANKLSLNCQKTSFTLFHKKKNNQLISLKKKQSINLPLKLPKLLINKNEIKREKCTKFLGVLFDENLSWRNHIGLLETKMSSVIGVLYKSRPFLDSKSRNMLYFSLVHSQLLYANIVWASTHKTKLLKLQSLQNHACKVINYLNRLVNPAPVMKSMMVLDIEKLNTLQILIFMYKYKNNLLPSVFSDIFLISFSEKYNLRSNTRYNYHLGKIKSHQSNFLITNRGPSIWNHFQNKNIKDLKSISSFKRETKMHLLNS

SEQ ID NO: 3147 - protein, 1087 aa, synthetic construct
  source 1..1087: note = Description of Artificial Sequence: Synthetic polypeptide
MKICHHCKFCNKKIKDNHRAIQCDCCSFWIHAKCIPVDKHAYNMLSNDSSEWFCPNCISNNMPFGVLSDLELKSTLSCKNPSNKIKFHEPPDYLKNLFKTMNNVFNPTTKCKYLDVNELNKSINPGTEIYLHLNISSLPFHINDLSSFVGTINTPPMVIGITESNLYANDSNITDITIQGYNIEHCPTESKKGGALLYLNSNLNYIVRSDLQIYATKFLESIFVEVIYPLKSNTIFGCIYRHPSLNITEFLSIHFNPLLEKLSHEAKNIVLMGDFNIDLLNYRESQVISNYFESLCSHSLFPTIILPTRVTAKTKTLIDNIFMNSFPTDIVSGNLTISISDHMAQFVCIPNNPPIKKKVKMFKRSFKKFDSDSFIQEISDINWELLIKDDDNINESINFFLKTFEKILDRYAPYKELTKKQIKLQSKPWITSGILKSISNKNILYKKFTRSKNVNTKNILFTKFKLYRNKISNLLRYSKKLYYASFFNNNINNVKNTWKGIKEIINIKPSTSTKSFNLKINENVISDHTSVANIFNNYFTTIQDELLKNTVPSKCAFGNFLKIPSINSFFIEPVTENEVANLIKDTLKNNKSLGPNSLPTFLLKLVSHIISKPLCTMMNNSFKNGIFPEAFKVAKVIPIHKMGSYLDYSNYRPISLLSNLSKLFEKAMFQRLEHFLEKHKFIYKHQYGFRNKHSTTHSLIEITEKIRQAIDNKHFACGVFIDIRKAFDTVEHTILLEKLKHYGIRGIPFLWFSSYLCNRTQFVSINGINSGLAKSFNGVPQGSVLGPLLFLIFINDLNVSLKFSTAYHFADDTNLLLINKSLKKLNKNMNHDLANVVQWLRSNKLSLNSKKTEIIIFKSAKTKINKQLNFRLSGQKINPVNSIKYLGIKIDSNLSFASHLQDLALKLSRSNGILAKIRHFVNHETLLNLYHAIFHSHLRYACQVWGQSKQLAFLRLTYLQNKALKLIYFQHTNSNCSILYFLSKVLKLCDLIQLSNCLFVWNQNHNNLPLTFINFFSYRENCKYILRSALNFKLSVPKYRTVHYGYESIQHKSIQTWNNLPSQLKSLKSFSKFKTALFNHFLEKYSL

SEQ ID NO: 3148 - protein, 931 aa, synthetic construct
  source 1..931: note = Description of Artificial Sequence: Synthetic polypeptide
  VARIANT 777: note = Any amino acid
  VARIANT 928: note = Any amino acid
MEGNIESKTFENISFCAYNCQSFKSNSIYISELVKSFDIIFLSEHWLLNIELFVLKNIALPTHKVFFHAAEKKAFGRPFGGNAFIIKKDVLLSPHIIYEDDNILAIKGKNKCHNLVFIGIYLTSCRNNEESLSKYEQQLNLITSIVKNYEDVSECIIAGDFQSYPETLYDSEIRNNKKRNKFSNHLTNFIKSNKLSFIDIISGAGPTYTYQHKTLSNSSYIDHIAALKESSLSFINTSVIPPSPFNFSDHLPIATNIVVTHTNLSTVINSIMHKYNYIPKYAWNNEKFINIYNHNLSVAFNYYTFNEEEIEQELKQTCEKIQNAALLAVKQCFKQQICKYSKSWWTTDLKKCKENLSFNYKQWQKSNYNKTQECIEYKRYIFSRKNFRKAVKAAHNKKIHEKTINIENLRTTNPQRFWDNIRKIKTKATTRLFTINKSQNIKDIVQEFRQHFQTLLNTPLITNNNHNPSQIPPLSKEPNSLIITSADIINCISQLNSNKSPDSCGLSAEHLKNSHNNNLLLWLAKFYNSILSNGKVPNDLSTSTIIPLVKSYKKSLNNPDNYRGISILPIFTKLLEYLILLICPSITDSHSHQFGFKKNSSTLHAEFLLSETVKHYKNNNTPLYMCSLDANKAFDTCNWDLLFEKLYFQKKLPLSVVHTISSLYHSGTANVSYQGVTSNQFSLSQGVRQGSILSPHLYNIYTESILNEIVSECKVGSTINGIYTGVIAYADDVILLSPTISGLQELINRFQTYGVANFIKLNTEKTEFLISGKSYIXNNVIKINGVSIYLQNKLKHLGFQWDNDTSKNKIATLQKTNLNERITQFQSVAKALIDSGIRYCQPSTIVHLYNTLTVPKLIYGLELCKYDTNFLSKIDAVGRAVLKSFFCISKYSKNYLHSFFKIEDISTILLRNKVNLFIRLLKNQTCLXTDN

SEQ ID NO: 3149 - protein, 694 aa, synthetic construct
  source 1..694: note = Description of Artificial Sequence: Synthetic polypeptide
  VARIANT 309: note = Ile or Leu
  VARIANT 529: note = Any amino acid
MIFLRFYIIFLNFNIALSYFLFKMADETVLTNLNFNSFESKKSILLNNYSDPDINFYNNDEVIKNINPLYYNPNSKNIANGMDDNSFSMLHINIRSIQKNFESLKQFLYKIKINFQIICLSETWCHDKNIENNSNFQLPNYKVIHQVRASNKEGGGLCIFIKNSLLYKVKPNLSSTTNDYESLCIEIINETSKNIIIHALYRPPSGSIKVFENHIKKIIKNKSSINKTVYFVGDINLNILDYDKNKNIKNFFNVIFQNSYIPLINKPTRITKESATSIDQIITNEFINKKIKTGIFKTDISDHFPIFIXSQKCIYNAQNKRKKIITTRLINDNSIKHFHNLLSCVNWDTLKLNLNABKAYDIFLTEFLKLYNKAFPEITKFIKTKTLLNPWITKGILKSSKKKQRLYNKFLKKKTLKNETDYKNYKRLFESILKRSKKHYYSEQLIKHKNDSQKTWQIIKEVIGKKNLYRNLLPKNLKFNNKYIVNKSLVAETLNQFFVNIGPTLASKIATTQLNFKSYLTSNNINVMXNYKLTEKELLDAVSLLKPNESLGFDDISSNVIIKSIKYITIPLLHIFNLSLKQGVFPEKLKIAKVIPIFKSGDPSNVANYRPISILPCFSKILERIMYNRLYSFLNINNILYNKQFGFKSGHSTDHAIIHLVHDIFKAFDEKKFTLGVFIDLSKAFDTVDHKILL

SEQ ID NO: 3150 - protein, 1027 aa, synthetic construct
  source 1..1027: note = Description of Artificial Sequence: Synthetic polypeptide
MALISDFETLVFNFFETKFFSLHENSDPDINYFHDTKIECSYYYPNELKGILFKNVNNDQIRILHVNIRSINCNFEKFQNLLEETKYFFNIICLTETWATSNDIKKNFNFYLSHFEMISLERQINKRGGGVLIYIHKDIKHCCRNDLSVSDGDGEILTIEIINERTKNILVSCCYRPPDGVSENLSMFLQQNVIAKGNNEKKKNFLVGDFNMNCFVYNDDNKVKNFYDTIFESGAIPLINRPTRITKNSATLLDNIITTDLFNNDIKLGILKTDISDHFPIFLTINTDQLPKQKLNKIVKKRFYTSSNIEAFKNQLSLLHWKHLNFNENANNLYEKFYETFISVYESNFPIVTITLKTKHFDNPWITKGFKKSSKTKQRLYIKYLKTKTPDSEKIYKDYKNLFEKIRKKLKKNYYSKLINKAKNDSKRTWQILKEITGKQKTCSSSLPQMLKVDNNSLHEPQIIAHEFNKYFTEIGSILSSKIQKTQTSFYDFLLPFDKNISSEELSAELSFDEFEKAFKSLKKNKAPGADEINGNIVIDCYEQLKNILFKIFRASIHQGIFPERLKLARVTPLHKEGDRSNINNYRPISVLSIFSKILERIIFNRVYNYFNYNNLLYNNQYGFRKGSSTEHAIIQFIHNISKSFEKSQYTLGVFIDLSKAFDTVDHHILIQKIKYYGLNNKILKWFESYLTNRKQLVYSNDGYQSEPLSITCGVPQGSILGPLLFLIYVNDLNKASKLKSIMFADDTNLFLSHTDIYELFSTTNKELKHISNWFKANKLTLNINKTKWIIFHSCAKKRFLTNNMPQIYIDETIIKRDTVIKFLGVYLDENITWRKHIDHISTKVSKNIGILYKARNYLNKKNLTQLYYSFIHNYINYAIIAWGSTEKSKLQHLYRRQKHAIRVVNYADRFSRSKYFFDYMNVLDVYKLNIFNVLCFTFMWKNDLSLFVFNDLFSLKPINKYTLRSNSFLNEPFCKTKFNQFCIAYRAPHLWNKIVLPNFDPSTTLPVFKTKLKNFILCMDNILKFY

SEQ ID NO: 3151 - protein, 879 aa, synthetic construct
  source 1..879: note = Description of Artificial Sequence: Synthetic polypeptide
  VARIANT 82: note = Any amino acid
  VARIANT 133: note = Ile or Leu
  VARIANT 139: note = Any amino acid
  VARIANT 141: note = Any amino acid
  VARIANT 292: note = Any amino acid
  VARIANT 741: note = Any amino acid
  VARIANT 804: note = Any amino acid
MDSNEPVNFESTLFNFFQTNDFLLDSDSDPDLNYFSEAGALQNKCSYFYNHEIKEFLDRDNFNVIHINIRSLKKNFENFRNXIEETFNIFSIICLTETWCDSDDVNFNSNFHLPGFNLISLARKTNKRGGGVXIYVKEXLXFFTRLDMSISDGDKEVLTIEILTKKTKNIIISCCYRPPSGVIESFNSFLRNDIIKKSNHEKKFNYLIGDLNLNCFEYHVNNNIKRFYNDIFENGAIPLINKPTRITQSTSSLIDNIITTDVFNESLKKGIIKSDISDHFPIFFSINTNNEXVTKTHSLCLKTIKFNDKFLYDKKEIANELNKYFVSVGPNLAKKIPKAINPINNLFIPNTSQFNSFELSFEEFESAFKMLKPDKAVGPDDINGNIVINSYDIIKDILFKIFSCSIKQGIFPDQLKIAKVIPIFKGGDLTNVSNYRPISILSVFSKVLERISYNKIYNHLSVNNLLYSNQYGFKKNNSTEHAILQFTRSITDSFENSQFTLGVFIDLAKAFDTIDHKILFKKLKYYGITGNVLNWLKSYLNNRKQFVYVDVVSPVNLFDITCGVPQGSILGPLLFLIYVNDLHKASNLMTIMFADDTNLFLSHNNITTLFQNMNIELVKISDWFKLNKLSLNIDKTKWIFFHPNRKKHLLPSEMPLLFIDNILIKRVTVTNFLGIYIDENLSWKNHIENLCSKISKSIGILYKARSVLNKHTLIQLYYSFIHCHINYANIAWGSTNKSKLXPLYRQQKHVARLINFKDRFTHAKPLLFEMKVFNIYELNIFNVLCFMFKCKTNISPVSFHNLYXKKEKNKYILRNDNFIRQPVFQTNFGKFCISFRGAFLWNKIVLKNFKDFSQECNYRSFKQKLKKVIFSIDDISIYF

SEQ ID NO: 3152 - protein, 1254 aa, synthetic construct
  source 1..1254: note = Description of Artificial Sequence: Synthetic polypeptide
MVNLQLGDFNTYKCEQEAIIVDLKKLIETLRTDNANLTKRVLDLENSKSKSSSAVTGDWASKVKKTPDQMQIINTIANETKERDKRENNLVIFGLEESTLSDKVKAIEEDKQNIETIMKKLKVNVKIKNVIKLKSKNGYKAPYIVVLNDKLERNSVLKNAKELKKDKTYESVFINPDLTESERYKSKLLREECKKLNNDNINKANFYFGIRNDKVVKIKKQLNAKKDLNHIRCFNYETNNKINLFSGGGQNLNKLLSNKRQLDIEIVNFHERKKCDLSINKEHDTQKCNELMIWYTNATSLNNKIDELRLQCEIYKPDVICVTETWFKAESDVNIISYNIFRSDRKTHGGGVCIYVKQCINQFETNNLQLNNNFIEQIWTCICFKNNKMLIGCIYRPPDISHEYNNYVLLSINAAKMSIYQKEYSDLIITGDFNYNTIDWSDNNCPFSATDNESQTNKFIECLEDCFLFQCVCEPTFQIANYKSTNILDLIITNDKNKIVSITHSAPLGNVKQGHHLLKCCYLMNDYKFSTEHKKSIRLYQKGNYELFSCHFNNVDWENGFKSKSINEMYDLFLYHYNYATNLFIPRINYQNRRNRNKWITPELKHKIRTKNNIWLANKRNGWNEESTKIQYNKLKIRIKNDIKNNIKQFESTLASKFKSNPKLLYKYINEKKSVKTHIRALEIDNGEIINDQFAIATELNKYFHSVYVNDNCTNIIEFHNIPSNLLLNTVLITQNDVQTRLQALDKSKSVGFDFVHPYVLKECSSSISYPLYLIFKKSMETGTLPDMWKKANVMPLFKKGSKLKASNYRPVSLTSIPCKVLERIIADCIMQHLIKNNLLSKKQHGFMKSKSCTTNLLEYLDILTDAFHNRTPVDVLYTDFKKAFDSVSHKKLLSKLLTFGISGKLLTWIVCFLANRKQRVVLGKSVTDWVDVLSGVPQGSVLGPLLFLVFINDLPENFINECRLYADDNKIIAPISSQNDSQLFQNDINKLDEWSTKWKLGLNFEKCKIMHFGSNNNEYSYFMNNNNTLMEIEKSKLEKDIGVYISSDLKWAKQVKYAASKANSILSLLNNTFKYKDKDLIKTLYCTYVRPNLEFSIQAWSPYYTKDINELEKVQRRATKMIPELRHLEYKKRLEILGLTTLETRRLRCDLIQQFKIFKGIEIIDIKQNQTMNSICSSGPAANIRGAKHRMKPELVRNCLKRQYFFSNRVVDGWNSLPAEVVQSTTVKSFKLNLQSVDLEAITNKIKTKKAYY

SEQ ID NO: 3153 - protein, 1232 aa, synthetic construct
  source 1..1232: note = Description of Artificial Sequence: Synthetic polypeptide
  VARIANT 581: note = Any amino acid
  VARIANT 989: note = Any amino acid
RWQPKFCIKYYNFNFLPKLKIFIQLTLIKMVRKEDFEALVSRVLKLEAELLTKDKEITQLKILVNDLKNQPSNVLNSSACAWSDVVKGKKSNKAAQLDLVNVVVKESQDRDLRQKNLIVFGFNTSKNKNDDVAREEDILGIQNIFNQINAKATIQRVFKLSIKSDKPPPVIVVLTNKEERNAVLKTAKTLRNLPETNNIFINADLTVAERLKMKALREERAKLNETNKDLQYYYGIRNERVVKLIKRQFISSQQDQLLFSKNLLFKNSNKFIEKNNKRQLINLKNQELFNHPKNNYCGKWALTNIRSLGNKIADFQHFVHLHSLDICCVIETWLNKNLPDSLLCPRFYTVLRCDRSSKGGGIAIFFRSFIQFTKVDIPPEFHELEIVCADLNLNGQSFRVIGYYRSGGFGKVAIDYMQSSVKCFSILCSTKKNVVILGDFNLPDIDWHYYHGPDSVIHNSFLHFINRYSLTQHVDQPTRENSILDLILSSSSSFISNLCIEPPIGTSDHNVIIFTPNLSCLYNKTEVPVQQFFCWKNADYQVINKYLKSVDWSIIFQTCFNIEACWHTFSTILNNIITQHXPKVRVCEEHKLSHKIHYPYYVKRLINNKAMAWKRSKVTGKSNDKAAYKSIAAQCSDSIRKYHAAKELKMIRKDNLGSFFNFVNGKLKTCSKLNDIRRSDNTLCHDKEEISCIFNNFFASVFTVDNGLSPKFTDRVNVHSTCLSSINFSPSTVEKALRALKPTTSTGLDGIPNVFLKNCANSLSIPLSHLFDTSFKDGAIPLDWKVASVIPIHKKGPTVDPGNYRPISLTSTCCRVMERIINNKLINYLLLNNLITKEQHGFIRKRSTCTNILESLHDWTLNLQRRIPTDIIYFDFKKAFDSVSHPKLLMKLPAYGIVGNLLNWLTNFLHMRSQVVNLNNVTSHAISVTSGVPQGSVLGPTLFLLFINDVSHINKQLDVKLKLFADDIKLYSVYDVRGLQSDLHTAVNXLYEWSCTWQLQIATEKSFVCTIANQSQNIAQRVYTINNHELAHVNCIRDLGVTIDRNLKFNQHINLIVHKAMSRAFLILKSFYSRDRLLMVKAYCTYVRPMLEYCSSVWSPYTICLINKVEKVQRFFTKRIAGLWSVSYDKRLAILKLNTLEYRRVFKDLVLCYKILNGKLDTDLSNILILNSYLNNRGHNFKLYKHHCSLNSTKCFFSNRIVNVWNSLSEDVVSASSVLMFKKRLAVLLCSS

SEQ ID NO: 3154 - protein, 577 aa, synthetic construct
  source 1..577: note = Description of Artificial Sequence: Synthetic polypeptide
  VARIANT 39: note = Any amino acid
  VARIANT 66: note = Ile or Leu
  VARIANT 248: note = Ile or Leu
  VARIANT 311: note = Any amino acid
MLKKEISESEIKQALGQMKNNKSPGSDGLTIEFYKHFFXLIKKDLIESLNNVLFTGEMTNSQKEAXITCIFKKGNKNDIGNWRPISLTNVDYKILTKVLANRLKDVLPNIIHSNQTACIKNRTIYYNLSYTRDIISIAKKSKLDACILSIDQVKAFDRVDRAFLFDSLKHFGFGKIFISFIKTIYNNINAKVKINGLLSEKIDILRGVRQGCPLSMILYIIQAEIFSCYVRQNKNIKGIHVKESETKXQQYADDTNFFLIGDDSIREVGKALKLNQKATGAKINIAKCQGIWLGKNIFKDKSEYLNFNWDXNTFKSLGIFFSNNANFQYETHWKERFNKMENSMRKWEKYKLSIKGRKTIINSLIIPQALHLAFIAPLPSNGILNKIEAKINNFYWGGKICRLNKTKTQQKINEGGAGVNSLTNKLKAIQLQWISKLYNESICGPWKDAMVYILNLYRNANQSKHTFETIPTQMKLLPPFYSQLLVNWHSLKQKHVLPITKIEEILNQPLFFNSMIKTMPNKFLTPSETHIKNDIILVADITKTFQPGFLHHKSIGLTEKELEFLTKALPRKWYKKF

SEQ ID NO: 3155 - protein, 1155 aa, synthetic construct
  source 1..1155: note = Description of Artificial Sequence: Synthetic polypeptide
  VARIANT 394: note = Ile or Leu
  VARIANT 434: note = Any amino acid
  VARIANT 444: note = Any amino acid
  VARIANT 467: note = Any amino acid
  VARIANT 487: note = Any amino acid
  VARIANT 525: note = Any amino acid
  VARIANT 576: note = Any amino acid
  VARIANT 593: note = Any amino acid
  VARIANT 751: note = Any amino acid
  VARIANT 796: note = Any amino acid
  VARIANT 970: note = Any amino acid
  VARIANT 982: note = Any amino acid
  VARIANT 1078: note = Any amino acid
  VARIANT 1117: note = Any amino acid
MKVKKIFEDILSVKNVQIERAHRTGNKKLKMPRTIVIKLLDFRDKVAILSKSSKLKGKNIYINEDFCFETTQIRKNLREKMKIERAAGKFAFISYDKLIIRDWVAKKSKNLSSTVLKMEENVIFKSSNENDIIGDNDTDSNYFNHKMLESQYYSVSESSQYLGQTKNTFSILNINIRSLNKNFENLKILLDEIKHDFKIICLTETWCKCGETNYEFELVNYTSIHQPREVNAGGGVSIFIHNSVNYILRNDLCVNETDYESLCVELVNNKEKNIIINTTYRPPSGNLKKFKTHLKTFLNKITNSRKHIYLVGDFNINLINYASNNNAKNFINTLLQYNFIPTINKSTRITNRSSTLLDNIITNNFHNNPLYTGIIQTDLSDHFPTFLATNNILXNNISTKSTIFRRQINENSLKQFKNCLKNCVDWNLILQSNXANNAYDLFLXQFCEQYEIAFPEIKKVINTKSLXNPWMSKGLLKSSKKKEKLYXKYLKKKTYKNEITYKNYKNIFEKTKKRSKKLFYDQLLXKTNGNTKKTWNLIKDIIGKNKRKKNNLPKNLLIDGELVYDKSIIAEELNNXFLNIGPNLAAKIPTNSXPFDSYLKTYDKLMDETNLKPSELRTAFSSLKSKKSEGFDKISVDVVKSVFDIIEPSLFHVFDLSLKSGIVPDKLKIARITPIFKSGDKSNILNYRPISVLPCFSKLLERIMYNRLYNYLTENNMLYCKQFGFKKKQFNLRTICCIVNNLVLKKNNSTXHAVVELFNQISNAFNNDCFTLGVFVDLSKAFDTVNHDILIKKLEXYGVKNKNLLWFEDYPTNRKQFLYYNQNNTIKHSITCGVPQGSILGPLLFILYINDLYLASNLLBLILFADDSNLFYSHRDIKALFKIVNEELCKVNEWFISNKLSLNVEKTKFMLFHKPNKSENIPLKLPDLIINKTYIKRESNINFLGVILDENLSWNSHINSIEKKISKNIXMMYKAKPFLNIXSLKKLYFSFIHSYLSYCNIAWASTNYTKLKKLYSKQKHACRIVFGANRNVPCEPLLSELGALNVYKLNIHQVLLFMFKTKNELSPKIFQSYFNEIXHKYPTKFSDNNFVVPKYNLKLTSYSIQYRGPYLWKKFPXIVNKKKTLRDISLEQFKNESKRLLLFMDLNKFDFKCFF

SEQ ID NO: 3156 - protein, 1246 aa, synthetic construct
  source 1..1246: note = Description of Artificial Sequence: Synthetic polypeptide
MTNLTPAQLKQVEDAIKKLIHAETAKWSAKISELEQVIKQQQLIIDKLIQNPNELTNTTTSSIESSWVTVASKNIKKKQPIEQLKIINTFAIEQQQKKKREKNVIIYGIKESAKLSVADKHIDDKETVQNILVTISSDAKPKSVKRIKSTSSKPGPIIVELSDVSERNPLLTAAKKLKNSDNYKNIFISPDLTEAERYLNYQLRMKRNELNSNINLKTSPFRYGIRSSGVVKLKNIQTTTKHRPLDTVYEAAESSNSKIYKPLHKHYYPSSTLLPANLKYKSKNLHNKKTNYSVNCYYTNATSLDNKMADLISISRTFDYHVIAISETWFRNDSVPNIDGYSLYRKDRQDGRRGGGVAIYITDVFNSHEVNQFYTNLLEQVWVSVKFNNKHILIGCIYRPNDASLIKYVAESFKLAHSLIKKPYDDCLIVGDFNFPNIKWSNDGIESFNPNNPTEYDFWNIFQNSLFTQHITFPTFQTDYGSSNNMLDLLFTYNSNSILNLSPSTILGNTTKGHFSITWRFLVSELFTESESQSFNYKKGDYDSISNFIASIDWEFLFLHKTADQMFNILISNYRTACTYFIPKINKTKKKYDPWVTPHIKNLIREKKSAWHINCSTKWENSELKIKYNRLNRSVKTEIFKAKKAHEKEIISKSQNNPKIVYKYINKQLKIKDRIRSLKDTSGRIIEALPDIVDLLNSQFKSMFTLESSENFPLLNKSGILSECIYNENLDFSISDIIQELADLKPYKSFGSDGLHPLILKICAKSFAIPLTKIFHKSFNSGVVPTQWKLANISPIYKKKGDKLLAENYRPISLTSVACKIFEKLVKKKILKHINDNKMLSANQHGFLYHKSCVTNLIETFDIISSSIASHQFIDVIYLDFAKAFDSVPHNRLLLKLRSFGINGKLLQWIKSFLVGRKQRVTINNTSSAWVDVLSGVPQGSVLGPLLFILYTNDLAKLTETSEIFADDTKLFSKTLSQSNFVDLQDRLRLVYEWSNTWLLKLNTSKCCVIHYGRNNPHYNYFLQNNQGINQSLRSSTKERDLGVIFTSNLKWSAHIQTVVSKSLQILGMLKKTFTFIDEKMALKLYKVFIRPHLEYGVSIWAPFLKADMALVESVQRKATKWAYSLRHLQYCERLKRLNLPSLEFRRLRCDLIQIFKLIHRFDIVNDKYLPKYINSVSRGHHSKIRREYVLNCLPRYNHLYNRSAKYWNNLPEQITLYSTVLSFKNRLDSWLWKKFGTNIYKTGCL

SEQ ID NO: 3157 - protein, 1239 aa, synthetic construct
  source 1..1239: note = Description of Artificial Sequence: Synthetic polypeptide
NLIKILIANMVNVQSTEFNVYKADQDKLIKSLIKTIDELKNCNLLLTERLNVLEKAKVVPSTSISWASVVSGNMPPKRSTEQLHLMNAVVAEAKEREKRESNVVVFGIEASKKADLLSAREEEKNSILHMMNSINAKIEIKQIIKLKSKSDKESPFVIVLNNRNDRNSFLKAAKSLKNSTEFNKVFINPDLTVAERYKAKLLREECKQKNLENSEPSLFYYGIRNEKVIKISKQSFYNCKNQKYFSHGSLTSLVIPKSLQKNHASSISKQRITAVNNKSIKKVICSKRSNFINSYNHLTTNSFNNFTVYLFNARSLANKLNDFFLYVESNKPALICVCETFFNDKLPNSMVCPKNYSIYRKDRVRIGGGVAIYCRNDVKSAIVSITQTDKDIDIICVDLIFGSSKLRLITCYRPPSYSLDDYIYLESMISIISNLCESVPQFVIVGDFNLPKIDWVNYVSPIEKCHNLFLTLVNNLGMYQYVLEPTRENNILDLVLSNIISLLSNISVECPFSTSDHNSVFFYINTFNYYQPETNSESFYDFKNTDIIAFNSYLSKISWDFDFSFVFTTEEYWNIFSNHLRKGIDRFVPIRTIYHNKKSRSYPKYIYKMLIRKSFLWKRWSITKTTLHKKAFIQYASKCKKAISTHHKNVELKLVKENNLSKFFSYVNKNLNNPKKIYPLKTNSNFTTTNVEIAEVFNKHFGSVFTIDDGILPKINTFVSEHIKMNFVDFSAKIVYQKLKNLKPSTSFGPDGIPNILLKQLAHIICIPLSYIFESSFTSSSLPKQWLQATVSPIFKKGSTSDANNYRPISLTCTSCRVMESIVSSSIADYLNINNLITPNQHGFLSKRSTCTNLLESTNDWNKALDSNLITDVVYIDFQKAFDSVPHPKLLKKLAMYGIIDNLLHWISAFLSNRYQRVLVGNSLSNPTCILSGVPQGSVLGPTLFLLFINDLPSIVKDLNCSLMLYADDIKLYSSFKDADYSHDLAVAIYKVYLWSKKWQLKIANNKCFTHRIAPTSFCKDINYNYQLGDHNLTWSTNPKDLGVTMDSYLNYSNHISNIVRASNIRGYLILKCFKSRDPRVIVKAYTTYIRPILEYCSPVWSPNRTKMNNTVERVQRRFTKRISNLNNVSYSSRLSILGLELLEIRRLKQDMITCYKILNNLVCLNKSSFFLFNNYIYTRGHNFKLRKLKCKLDVRKHSFSLRVVNIWNNLPSDVVNAKNIKSFKIKINSIDFEKYCSG

SEQ ID NO: 3158 - protein, 1290 aa, synthetic construct
  source 1..1290: note = Description of Artificial Sequence: Synthetic polypeptide
  VARIANT 1048: note = Any amino acid
MVNVQSTEFNVFKAEQEKLIKALNRTIEELKNLNLLLSERVKMLENAESVKSSPLLSWASVVSGKTPVKKTVEQLNLINVVTAEKKEREKRENNVIIFGINPSKAIDKSSAIKEDKNSIQEVLNSINLKVEVKQIIKLKSKIDNQPPFVIVLNNKTDRNSILKAAKLLKNSSEFKNVYINPDLTEAERYKAKLLRDECKKNNLENSESLLYYYGIRNDRVVKIAKQLLFNNRKLSHMSHCATELANSSRISCEYLISKSSKPDKIICTKKCRNKPINLNLINGNSNNGCNSNNGCSSNPYSKNSVYLLNARSLANKLHEFFMFTEANKPAIICVCETFFTSKISDSIVCPKDYSIYRKDRIKIGGGVAIYCRNDIKSEQVQITQTDTDIDIVCIDLIFSSHNLRLITCYRPPFYSIADVAYIELMTAFIYNLCHSVSQFVIVGDFNFPKMDWLNYVSPNEKCHILFLNLVNNLGLHQFVQEPTRENNILDLVFSNNISFLSLISVECPFSTSDHNTVHFSININDLDQSNKNIESFYDFVNADIDGFQSYLLNINWDFEFSFLFLQLKIIGTFSPIIFAMVFINLFQLERVILIKKLGLRVFLFVFTVEDYWNVFSNHFCNGIHQFVPIRKSNLNKKIKHYPSFIGKMLNRKAFLWKRWSNTKNITHKKAYNKYASKCKKSLLTYQMRVELKLVKENNISKFFNYVNRKLNNSKSIFPLKDKNNNNKITCSNEEIADVFNKHFGSVFTNDNNYSPFINSYVDDSIGIEDCTISTRSSVLVVTKKSLTCLTNTLAVSLQMITITLHLLIVMLMIQLVLKTVLFPPEAVYKSLKEIKASTSYGPDGIPNILLKKLAHLLCIPLSFIFDASFKSSSLPKQWRQAFVSPVFKKGATADPNNYRPISLTCTCCRVMERMINVYVIKYLGHHNLISLNQHGFLNKRSTSTNLLESANDWNTALDNHQITDVVYIDFQKAFDSVSHTKLLVKLASYNIKGNLLNWISAFLTDRYQQVKVGNSISNSIRIVSGVPQGSVLGPTLFLLYVNDLTAIXNNLDCCVKLYADDIKLYSSYCDMDLSQDLVVALNRLLQWAETWQLTIACSKCFALRIAPPSLCKGIKVNYKLGEYSLAWSSNPKDLGVTMDCNLNYKKHIFNVIHQANSRAYLILKCFKTRDPCILVRAFTTYIRPILEYCSPVWSPHQIGLIKSVESVQQKFTKKIRSLRNLSYHNRLQLLGIESLEVRRLKNDLVTCFKIFRKLVCTDQSMFFAIDNNSHTRGHNYKISKQSCRLDIKKI

SEQ ID NO: 3159 - protein, 1088 aa, synthetic construct
  source 1..1088: note = Description of Artificial Sequence: Synthetic polypeptide
  VARIANT 493: note = Any amino acid
MLIRNLCKFCNKTVVDSHKGILCNYCSSWLHPKCNYINKHTYSLIEKDSTDWYCSDCINKNLPFCSLSDFELSLTLSSQTIPTNNLKSLKSPPHFKKLFNNINKISNKSINCKYYDILELNKVLNNNCNLYLHLNIASLPYHIDGLRSLISSLTTLPIVIGISESRLNINDSSKTDVNINGFTIEHSPTEAKKGGALLYLRSNLNYFIRSDLIVYSPKYLESIFVEIVNPLKQNIIVGSIYRHPSMNSNEFITDHFNPLLERLSLENKQVVLMGDFNMDLLNYNESKVISSYLDTLCSYSFFPSIIQPTRITATSKTLIDNIFLNFQTPDLISGNLTISISDHMAQFICIPCLSPKKTKEVIFRRTFQNFDNKKFIKDISNADWQIQITNNDNVNESLHYFFKTFNKILDQHAPYKKLTAKQIKLKSKPWITNGILKSISIKNKLYKQYIKAKNHNIKIHIFNKFKWYRNNICNLLKLSKKSYYINFFNNNLXNVKNTWKGIKEIINIKPSSFSSKSINLKFNGNTISDSKAVSNIFNNYFVNTQQTLLTKIVSPKCNFSDYLNNPNINSFFIDPVTENEVSNLIKSLQSKKSLGINSIPTFLLKLVSHIISKPLCTMINSSFENGLFPDVFKIAKVIPLYKKGSRTDHTNYRPISLLSNISKIFEKAMHNRLYNFLDKYQCLYKHQYGFRSKHSTTHALIEITEVIRKALDDKLFACGVFVDLQKAFDTVDHSILLSKLEYYGIRGISLQWFTSYLYNRFQFVSINGNTSSLVKCTTGVPQGSVLGPLLFLVFINDLNLSLKYTTSYHFADDTNLLLINKSLKKINKYINHDLSNLIQWLRSNKLSLNTSKTEIIIFKSKQSKISKHLNFRLSGQKINPVMYLKYLGIKIDSNLTFSQHLKDLSIKLCRSNGMLAKIRHYVNLETLINIYHAIFGSHLRYACQVWGQIRTQEILRLSNLQNKALKIIYFQHYQSNSDHLYFLSKILKIDDLVQLLNCHFVFNYKQKCLPSTFTNFFTVRESCRYHLRSANSYNLHVPNHSSVKYGLKSIKYQSVKSWNSLPSPLKSIDSITNFKNCLFNYFLARYYT

SEQ ID NO: 3160 - protein, 1147 aa, synthetic construct
  source 1..1147: note = Description of Artificial Sequence: Synthetic polypeptide
  VARIANT 289: note = Any amino acid
  VARIANT 422: note = Any amino acid
MTSLKRNSNRRNRPCQGEPQLLQILQWNAGGMSQDKKIQIQKILDTYNIDIFTIMESNLTDDKLTYYQFPGYTLHLLPKDRQVASGILTGVKEGLTSHCEIIKSMGSMQDICEIIRLNVWKSQNHFKMYAVYNPPQNRPNFDLLNISHKTIVLGDFNAHSTRWGYKNRNTAGKEIEDILNSSPLELIYSDEDPATYLHYNGTRTTPDLLLVSSDISELTQRKIIDDPGSGHKPVIASITINSKSMTPKMPTKVLWKFKKADWPKFTNLLETELNASPINYNQHPDKLCXNITNIIIKCAKKTIPRGKVKHYRVFWSKNLEELKRKREVLRNTAEQTGKTEDVQAWRRQSAVLRQAILQAKRTTFNSFISNINYQNDSQRTFKFLGNLLNNKKKPKKEPIRLNNKLLTTDSEIANSFARFYSXKQKKNPFVRNSSRDIRKQVTKFDEIKEDTAIPHKVLTEPFSSHELNAAIKQLKCKKSPGEDCIHPEFLIRMGPKAKEILLTLFNKIWETSLVPTQWKVAIVIPILKKGKDPSNFDNYRPISLTSMLAKLMERMVNTRLTWFLETNNILGNEQAGFRPQRSTNQQVATLSQHIKDALDARNTLTAVFIDFKSAYDLVWKENLILKLAKIGIRHNMLNWIKAFIGQRTCKVRYGNDLSKSNLLQTGLPQGAVTSCSLFNVFINDIAELVQTVTGVKCLLYADDLVLWYSAPKKNAQKRTEIALNYALKLLANWCDNNGMVINTSKTAYQTFSLAHHSINPHLMYKDTPLEQTNESTYLGVTFDTKLTWKNHIAKIAERASNRLNVLKRLAGSLWGSARSTLNTTYKMFVQPIMLYCCETLVTASEAILKPLEKTHNQALRLITGGIKSTPIDAMLLVTGNSTIRSSVEEKALTLYEKLLRIPSDTFWSSYENRPRHLKTQVGLIQKAIELKKRLQTTDKPESLSLPQNPLADNEVQFCTQLLGHSMKADTPPDQMRLLALETINANYPADQWLQVFTDGSYVENQANVGAGVYSELFTFFAAAGQNRSAFEGEIEAIKIALGQLCCRDTKFTNAVILSDSQSAIQSIGNREPPKTAEIHECKKLYQLLKEKNKTIVLQWIPGHCGIIGNERADTLAKKGTTILQANIFLHNEDLNQERIQDSKKQRT

SEQ ID NO: 3161 - protein, 937 aa, synthetic construct
  source 1..937: note = Description of Artificial Sequence: Synthetic polypeptide
MECTLYYQNVRGLRTKSSEFLSGVIGNSYTIISLTETWLEDTIPSSQYFPPCYSVFRKDRDYAATRQRYGGGVLTAVDTSLCARRRYDLELYSECVWIEVTCRDGLNFLIGNYYFPPHLSSDVFARHFRDLEGKLDVTKFRVHIYGDFNLPGIDWLANYNLITSDVTSLKASSLFDFIYFNGFEQRNTIQNSAGNVLDLVLVSTPINYISPITDPLTRVDHFHPPFAVSFCFPLRKQALCSYEYLLYSSGDYLNMYKYFQCYDWKPILNNKCADSAAEALTEVVSSAINDFVPKRVSRLNKYPAWFSKELRSCLRRKLHYHRLFKRSGLDKWYAKFSECRALAKWLFKKDESAHLHGLESDMYAKPQNFWKYVPTKKKRNSSVAPMRNSSGYTCDSIEIANMFAEHFKSCFSSASVPDNNATCHGTSDFLSFIPIDEPEIRESIRNMKSKLSAGSDGIPSFIVKGCAELLTPVLLHIFNLSIHSGIFPSIWKRSVVVPIHKAGDPSTVNNYRPVSLLCSFSKVFEMIMHKRLYRHFRHKMNPEQHGFLKGKSVETNLCSFLDYAVPLVCNREQVDVIYFDMTKAFDKVNHSTLLTKLDSYGLCLTYCQWFKSYLTCRTNYVRVSGSMSDYFSSPSGVPQGSNLGPLLFLMFVNDISLCAKNSKVLLYADDIKLFRRVQSHSDCVLLQEDALQISQWCAKNYLPLNEQKTRTMSLTRKRDSLAFSYTIGGSVITRVSVIRDLGIFIDSSLNFNHHVLTICNASFRNLGAISRFTRKFSSPVCLVRLFCCLVRTKLEYASSVWNCINLTASCCIERVQKRFIGIIYDRYFDRTCYYSYEQLLKKLGLCTLLDRRRLRDLMFLHKVVNGAVDSPLLLSTVCFHAPLRSNRFQSPFYPSALNVASPLTRMQLEFNKLDQSAVDIFSDLIVFRHRLESIICT

SEQ ID NO: 3162 - protein, 247 aa, synthetic construct
  source 1..247: note = Description of Artificial Sequence: Synthetic polypeptide
RRGIIFFISYAAPLGGSSADTLRTTALGLVYSTAEYCAPVWMNSAHTRKIDVQLNGTMRIVSGTIRSTPTSWLPILSHIPPADLRRSNALLREYRKITNNPRLPIHHDTPDLERNRLRSRHPTMKTAKELHNTDFNLIESWKERWRQACPEQCQALPCITERPPGYELPRKAWSSLNRIRTNHGRCADSLYRWGKIPSPNCDCGADRQTIRHIIEDCEMRAYDGNVSDFLTAKDAAIDYIRNLDVCI

SEQ ID NO: 3163 - protein, 1040 aa, synthetic construct
  source 1..1040: note = Description of Artificial Sequence: Synthetic polypeptide
  VARIANT 62: note = Any amino acid
  VARIANT 221: note = Any amino acid
  VARIANT 478: note = Any amino acid
  VARIANT 538: note = Any amino acid
  VARIANT 564: note = Any amino acid
  VARIANT 670: note = Any amino acid
  VARIANT 717: note = Any amino acid
MIMKKKQQTPESVLTRELGSTTRICQLNVEGLSSSKSQFLSKFLMENDVDVAVLQETHIENXEQQRSRGKIHGYDLLGAVYHRHYGLATYVRSSIENAALVSLSADCFQQIVTKIGELTVVNIYKPPQTEWPQNVIETHPHPTIYAGDFNSHHTDWKYRTTDINGEKLSNWAEENHLHLVFDAKDKNTFKSAIHNTETNPDLSFTTRNSQSHPIPTRRKIXESFPHSQHRPILLEIGINIPLIRSLPRPRWNLQKANWDKFSNDIDQTLRWIPARWYNYDRFVNIIIAAAKRYIPRGYRKEYIPGWNEETEELHQRFLQENDAEIADKLLRNLDVARRKKWEETTEALNFTKSSRKAWNLLRKLGDASAPEREVPGVSPNQIASRIVSLSRAPRDKKRTTFVKRHLKSFRQSVEAPNKISRPFTVEEVNTAISKIKKGKAPGFDGVLPEFLIHSGRRTREWLSQFFSHIMQTGLVPPXFKKAKIISLNNIFVKPGKPKDKPESYRPISLLSTTYKLLERLILGRIEPILEEHLPVEQXGFRHNRGCEDQVLSLTSHIEAGFQQXLKTTVAFVDLTVAYDTVWKDGLLYKLYRTVPCQKLLRLFNNMLRDRTFQIIMGDKASRVRKINNGLPQGSVLAPALFNLYISDMPETKGRKFGYADDLAIAVQAKXMEDADTLLSQDLEVVGKFYADWRLIVSTSKTETTSFHLTIGKQQNLXKYFSTIKCSPIISSQSILVSHWIAPSPSGNTWKQRQPKSTLAITSCTNCVAAGGEHMLPLFSLNNREATKSPKVLLNNKVLPHNQFPKYLGVTLDRTLSFRKHLEATAAKVNTRNNILHKLCGSRWGAHASTLRGSALALVYSAAEYCSSSWLNSSHVSKLDARLHDTMRTISGCIKSTPVQWLPVLSHIAPPPLRRKGCLVRQLKRIQSDPDLPVHKDIPHLSLRRLKSRKPPLVSAQQLQDADFNITEQWRTDWSTVNFTALWPDPTERPTGSNFPADNGKRLTGSEHLTESVRILCTSGAYRKSSVRLWCFASDNRPYCV

SEQ ID NO: 3164 - protein, 1192 aa, synthetic construct
  source 1..1192: note = Description of Artificial Sequence: Synthetic polypeptide
MRCRSSHPSILQWNCGGFFHHLAELQQLMCHSLLCIAYRKRGFLFRGPLPYVATGAISKIAPSVTGSLEVCASMSLPLSPVRCAPHHESQGLWRCVPLCPCHCPQCAVPLTTNLEAVAVRIRVRQELTICSLYLPPDEVVCLADLVPWSLNFPRRFSFWGILMPTTLCGVGRRPRLVVGMPRALVAQLPPPFLLLGDFNAHHPMWGGTQTSARGRDVEMLLTQRNLCLLNTGAPTHFSVARGTYSAIDLSICSPSLLPHLNWNVHDDLCGSDHFPIFLSLPETQAANRLPHWSLHRADWPAYASAAVVTTPLPAGIEVAVQQVTKAIVSAAEKTVPTASASLRRKSVPWWTQEIAEAIRERRRALQRTGDTLLGHPGTSARASAHRRHPSVENLIAFKRLRARARRLIRQSKKDSWERFVASIGSRASPSRVWTQVRRLFGYRPPTGIPSLTIQGALCTDPQAIAEYMAEHYARCSATETYSADFRTFKERVERKQLSFRTRRQELYNAPFSEWEFETALAACPDTSPGPDRIHSQFLRHLSAEFQHQLLSLFNRIWADGVFPSQWRESTVIPVLKPGADPLVADSYRPISLTNVLCKLLERMVSRRLMWILEDRGLLAPQQGGFRQGRSAIDNLVSLESAIRTAFTRREHLVAVFFDLRKAYDTTWRHHILATLHGWGLRGSLPIFIQNFLSPRSFQVRVGTCLSSPHIQENGVPQGSVLSVPLFLIAINGLAAAVGSSVSSSLFADDFCIYFSSATIGVAERRLQGAIRKAQSWASAHGFHFSGSKTRVMHFCRRRALHLDPELYLGNELLRVEETHRFLGMVFDARLTWQPHLRQLRQKCWKHLNILRCLGHTAWGASRPTLLQLYKALIQSRLDYGSIVYDSAAPSALQVLDPVLHSGVRLATGAFRTSPVTSLLAEAGVPPLRFRRQRLLASYAAHVHALPHHPNYRLLFPDVALPSPRRRPRSGLPIAVRVRSLLSSLESLPIPPTFHYPSRAPPWSVPVRSFGIPSYSPHFSLPFPCSSLVRTRPQLRLDLSRDSKASVAPLNLRRQFQAVLGSFHGAEIVYTDGSLVDGRCGYAYAHDEHIEQHSLPCGSSIFTAELIAIRRALEHLRACPGESYVICSDSLSGLQALDQCFPKHPLVRSIQESVTFLFSLAALWSSFGPRDTLEFRGTNAWIGWLSRQLLQAP

SEQ ID NO: 3165 - protein, 497 aa, synthetic construct
  source 1..497: note = Description of Artificial Sequence: Synthetic polypeptide
  VARIANT 28: note = Any amino acid
  VARIANT 29: note = Any amino acid
TKTWCMMGGFPLTLLFICSQTSNRTVIXXEQAGFRPNRNCIDQVLSLTTFIEAGFQNKEKTSVVFIDLTAAYDTVWRPGVILKLLQAIPSIKINHLINEMLSNRCFQVIMGNNISSPMKLNNGLPQGSVLAPLLFSLYISDMPETKSRKFGYADDWALATRHKDLETTESILTNDLSTIGEYFRKWRLQPSATKTEVSTFHLSNKLANKELTVHFEGKVLRHNRNPKYLGVTLDRTLSYKQHLAKTAAKIKTRNNILQKLCGTSWGSSASTLRTSALGLVYPVAEYCSPAWLNSSHTKLVDAQLNHTMRLITGTIRPTPTFWLPILSHIQPPSLRRKNALVSEYKKLQKNPHLPVHEDIPSIRKARLRSRHPPLETARTLVTNSFNTDDCWRQTWQINATPEQLKMPCISTKPPGFDLPRKDWSALNRIRTNTGRCADLLYKWKKIASPSCDCGAEKQTVYHVVQECPLRAFAGDQTEFLMVTEGSLDYIHGLDISL

SEQ ID NO: 3166 - protein, 738 aa, synthetic construct
  source 1..738: note = Description of Artificial Sequence: Synthetic polypeptide
MMNSRDAAHRRFKASTKPEHYEEYRKLRNKVKQCIRNAKIRYARSFVCSNTNPATLWKNLRSLGVGKATPESVFQISADELNEFFSAPINCQAQINNRPEESPSHITNDDTFHLKHVTINTTRKAIMRISSEAIGNDGISITMIKNVADSLLPVLTDIYLISLSFSANQHIACVSKALEYIVHDQITEHLCKFSLFDKYQSGFRKNHSTNTALIKVTDDLKFAMNNREATILTLLDFSKAFDTVNFDILLNKMRQLKFSNSALKWFESYLKNRQQSVVCGNEKSSWRNVVSGVPQGSVLGPLLFSLYVNDISSVLTFCKYHFYADDLQLYQSTRPEDINTAIAQMNEDLSSVVTWAKNLGLKLNAKKSQVILVAHQKLISSELRDQLPPIQLDGIPIPYQKTVKNLGVIIDEHLNWADNTVTVCRKTSACLYALKKFRNIFPQDVKCKLVQSLVLPNLHYCDMIQHGTSSENTRRLELTMNACVRYICNIRRYDHISASYTQLGWLRPDKLRDYHTLCLLHRLLSEQHHSTSPQNLTIFRAIIILTQDPTYLVPLCPFIKRKHLQTPSLSLLFASGTSCPALFARFSLLLRLRKSNTSLCHPLKTLAKTHVYSQVSLCVIVKPMLFSPLFLFLLFLSPNQCSSLRYFSSSSFFHHNLLFRYISLCEYYYTHFSPPFPPLPPCPLLLAAIIKTFPYCNTCHVSYLSNTNINCVYVLLLLVLIENFNFCRFSITSVILEM

SEQ ID NO: 3167 - protein, 552 aa, synthetic construct
  source 1..552: note = Description of Artificial Sequence: Synthetic polypeptide
PHQNLLRPFTQAEVDLALSKCKNGKAAGLDDIRVEQIKNFGPITKAWLMELMNNCVQSCKIPKLWRKAKVIAIRKPGKDQNDPKSYRPISLLCHLYKLLERLILHRLMEKLEEYTYHTGWLTGEELHISSDETYTAHRRWVSKERDHRSCIYRSDSSLRYCKQKIFLSNFRDKEADGDRKRMDYPRESVLAPALFNIYTNDQPLPEGTQSFIYADDCAITAQAHCFETVEENLSKALREMSAYYRENQLRPNPGKTQTCAFHLKNRQAARTLKITWENTTLEHCTYPKYLGVTLDRALTYKRHCLNTKQKVAARNNVIRKLTGTTWGAHPNTVRTSSLALSYSAGEYASPVWFKSSHAKIVDVALNDTCRIITGCLKPTPLNKLYSLAGIAPPDIRREVAAKSERGKSETSEAHPLYGHQPANQRLKSRKSFLRSTEALVGTSQQCRTELWRARYTGTAGWFTPCEKLPPGYTEKWSTWRSLNRLRSGVTKCKSNLVKWGFLVESPLCECGATQTTSHLLQCTQCPATCTPEDLLHATPNAIQVANFWASKV

SEQ ID NO: 3168 - protein, 689 aa, synthetic construct
  source 1..689: note = Description of Artificial Sequence: Synthetic polypeptide
MIAANVSEFSWDWLDGASWTQSDWEFQSVTARHSAKFERFLGSESDSNLISRRSVINLTEKTYDDAALSVLGKGLNFAPTPKRLPVVDFISSIEQAVSKLPSDSAEEARREACRVLTGARPPKCNITAAEASALRSLRMDPDIVILPADKGNATVLLNKDDYIQKMQCLLSDSAYRRIGADPTKSVERKTNNLLKKSPFSQETIKSLNSYCAVPPRLYGLPKVHKENIPLRPIVSNIGAPTYRVAKHLASLLSPMVGRCEHHIKNSADFLRRLQGLRLNDSDILVSFDVVSLFTRVPLSDSLQLIEVKFGVELTNLFRHVLTSTYFLFNGQYYEQTDGVAMGSPLSPIVANLFMEDFEERALVSATLKPACFFRYVDDTFVVWPHGSENLNGFLEHLNSIHPNIQFTMEVEKNGCLPFLDVLVRRKVDGTLGHSVYRKPTHTDLYLRADSCHHPAQREGVLRTLVHRAHVISDPESLSAELSHLEVTFRQNGYSERQIKRALRYQPSVQRVSDDSNEVAPKSMAFLPYAGSISNKIGRILRKYDVKCVFRPPSKIKALLGSVKDDLGLRKAGVYRIPCSCGMSYIGQTIRTVEDRCIEHKRYTRLQQPNKSAVAEHCLGTGHPMEYNNTEILACTSTYWDSVIKEAVEIKLASDLINRDGGFCLNSAWNPALSLVKKQRDKINAASPVD

SEQ ID NO: 3169 - protein, 469 aa, synthetic construct
  source 1..469: note = Description of Artificial Sequence: Synthetic polypeptide
  VARIANT 73: note = Any amino acid
TYENNSLSKSDKLIGNMIGNRGFQVIMGNISSQKFLQNGLPQGSVLAPLLFSLYIADMPETACTKFGYADDWXIATRHTNFDTMZETLTSDLSALAAYFRKWRLRPNATKTEATCFHLNNRGADRTLEVYFDDTRLNYNKEPSIQHTSVNGGLGLMPRRQKRLASISITEERTELWKYTLTTHASTTTRSQVSRVTLDRTLSFKTHVTKTAAKVRTRNNLIHKLCGTTWGSTATTLRTSALSLVYSAAEYCAPVWLNSSHVKKIDVELNNTMRIISGTIRSTPNIWLPVLSHILPPKMRRETALLREYNKIEANPELPIHSDIPDLRIKRLRSRHPPLSLDSLTGADINSWRREWLQNAPQLATHQLLEKRMAPKRPTTCHLMPCITEAVPGFDQPRKIWSTLNRLRTGHGRCADSLFKWGLLSSPACDCGAPKQTIQHIREECSARAFSGDFEEFLMATQKLLNIYKD

SEQ ID NO: 3170 - protein, 425 aa, synthetic construct
  source 1..425: note = Description of Artificial Sequence: Synthetic polypeptide
HKVSHTYLPITKLFSFQWQGIQTVRWSSYGFPLSPILAEIFMDNFENQFLESNPLSSKVGYWFRYVDDVLCLWTGTTRQLQTFLKQLNSAHKSINFTMEFGGNCINYLDLTIDISNHCHTFKIYRKPSTTDTVIPAQSQHPVTHKHAAFHSMIHRLLSIPMSKESFQIELNTIRQIASNNGYPLPWWLPPTLVDSIMHKKQKQHVSSLLYPVINTPTSQDHSKWCTIPYLGKVSVNVAKKLKSRNFKTSFYTHNTIGHFLPNGKDNPPALEKSGVYKITCNCGKFYIGQSGRAICTRLKEHHRSWKLRQGNSTFADHLLKEGHSYNVTHEVLHHVQKGRKMNFFEIMEINRHMYTSPNLVLNDQTQFPYSPLLSAEPNHNPVQTMPCADNVNYHLLPTCLIPLLLFHSHVIKALCNHNCLAAYQI

SEQ ID NO: 3171 - protein, 1124 aa, synthetic construct
  source 1..1124: note = Description of Artificial Sequence: Synthetic polypeptide
  VARIANT 251: note = Any amino acid
  VARIANT 894: note = Any amino acid
MDSTAPCKKVLAKEILQAIKTASVDTFEKLALPAIGLLPMANEKENVPTVHKEETTMATPPEETCPQPTPTSASEALSPVETPEPSVQEESGGARASQAIPGVSQETVTASTPKGGKRSTADEAVSSVVSKRKTVPPLRLNDFLVECRKIKKPTKICIPLLHKKKYVEMTSRISYPDESEADSLVPPCKEKKLIFLHTNVQSLKNKLFELQYWLEKLNCSILMINEHWLSCGELELSVPNGYELATGYCRXNKAHGGVSIYINKMLQLNYETLDVNEFCIESHFEVAAVLLTELEIIAVSVYRPPNHSEDLFIENLQKLIVSLLKKKKSQSSNFWRHLSHSSRKKNHRVLIFGDINIDIRYRSSTVTNLLDTLRSLNFYCINDKPTRKNACLDNIICNFHIGRDQFNTIKLAISDHDGLWLRLPLSHKTDTSQQRIIRPINEQKLNTLKSKLTLVNWNELLTRDMGANESTKRFLEVVTKIFEETCPAYYKKHSKNRSQSKPGTLKQWYTAELNNLRILMLMYYDRSQHSNIDRLRYKNIKKYYRSAIKEAKCKSNDDYILNSVNKCKAAWEVIKTEINHQKKDQNIPISPDTLNKYFANPLMENNTEEDVNKAEELLPQLHNKAMGHFEWNHVTCRQVSVAISKLSNSRTEDHYGLSNFIIKQISQEILTPITNIINKILTEGVYPDSLKISVIKPVHKKGSTLSPDNYRPISLVPIISKITEYCMHQQLNNYFEHNNLICSEQFGFRPTLSTVKAVDNIITKVYDCFEKKTLSCATLLDLRKAFDMVSHNILIRKLQYYGIGENALRLLQLVNVNNKKSDPLPVKKGVPQGSVLSPFLFIVYINDLPSILPCEAVLYADDTTLIAQNSDMDELLLNVAVAIENCNNWFQANXLHINSSKTENIIFDLNAHKHENKSVKLLGFHIDQSLSWETHTDKLCSKLARVIYLLHRLRGCVSKTLLLYAYFAFFSSHLTYGILLWGNSPGSKAVFKWQKKAIRCVAGLAPQESCRHFFKEMKIMTVPSLYIYSCLVYVKENLHKYDLRMSVHNHNTRHRHAIDKPHVRLAKVHSSYKYLGPTFFNKLPNEAHSVPLNKFKNIISKWLKSKAFYTIKEFEESTIDDLEF

SEQ ID NO: 3172 - protein, 1743 aa, synthetic construct
  source 1..1743: note = Description of Artificial Sequence: Synthetic polypeptide
MSKLRDGSVLIQAETPAQSRSLLTCDHLGDIPVSITPHKSLNRVQGVIYHRDLLLQTDEELRDNLQRRGVHFVRRVFRGPKDNRVATGAFVLAFEGDNLPEKVKVMMYRCDVQPYIPPPMRCFKCWRFGHMSSRCNAAATCRDCGRPSHPDTACAPPPYCVNCGGHHSPCSQDCPALHKERKIVEYKTLDRLTYSEARRKYEKLHPVSLLTSYAAATTMAPPPVATSRPALPPSVGPMGRPSTSASQTSGGTPSSAGPVLPPTSGVVTPAPQPEKGSPSLASSSGKGTCSPLPTMSPQKSDTSQRLKDPRPESRLAPQSSHTPQAPPEKPPSSGRPKERREDKKEKKERRKAQGDAGGLGAPSPCTGHPSRDARRFGLCRSRGCHGHGGSDFTARDECSCHPSSIFIVFMHRQSGDSLILQWNCGGFFCHLAELRQLLSSFPTLCVALQETWFPGDRTPTLRGYRGYFNNRTVYNRVSGGVCLYVHTSVYSSPVPLQTALEAVAVRVRASRDITICSLYLPPDADVAPADLAALIAQLPSPFLLLGDFNAHHPMWGSNVTTGRGRDFELLFNQLDLCILNTGAPTHFSVAHGTFSAIDLSVCSPGLRPLLNWWVHDDLCGSDHFPIFLSLPHHQRHARLPRWSFHRADWAAYTSAAMLDTPLPADATMAVDQIISVVVSAAESAIPSSSALPRRRPVPWWSPEIAAAIRNRRRALQQYRRHPTVDHLVAFKRLRAQTRRLIRQRKQACWEEYVSTIGPRVSSTQIWTKIRRISGYHPPAGVAGLSIRGTIHTDPTIIAEYFAAHFALNSASTAYSQGFCTLKERAERKQLVFRTNRQEPYNAPFTEWEFQSILASCPNTSPGPDRIHCQMLKHLSVNSQRHLLDFFNRLWIEGAYPSQWQESIVIPLLKPGADPLNVDSYRPISLTNVLCKLFERLVSRRLLWVLEYRGLLAPQQGAFRQGRSAIDNLLSLESAIRTAFARRHHLVAIFFDLRKAYDTAWRHHILATLHGWGLRGSLPLFIQNFLLSRRFRVRVGTSFSSPHIQENGVPQGSVLSVPLFLVAINGLVAAVGPSVSCSLYADDFCLYYSTASTSVAERRLQAAIHRAQNWASAHGFTFSPAKTRVMHFCRQRTVHPHPELYLDGELLQVVDTHRFLGLLFDSRLTWLPHLRQLKQRCSRHLDVLRCLSHTVWGAARPILLRLYNALVQSRLDYGSQVYGSASPSALRVLDPVHHTGIRLATGAFRTSPVTSLLAEAGVAPLRYRRNTYSPSMLPESTVPLGIQITDSFSRGRSFVCRRGDPGRDSRRSGAVTSGLREPGLWLSLPICTESSRPSPPYRHPSGHWSLSYEPCHESSRRGWSRPIAIPAQHLLAQYAARVHCTPRHPNNRLLFPGEVIRLPQRRPRSGLPIAARVQSLLSTLDSFPLNRPFRSTFHAPPWTIPRPRIRLDLSREPKTSTSPLVLRHQFYALLREFRNSEVIYTDGSSDGDHTGYAYMHGAYVEQRSLPPGSSVFTAELVAIYRALKHIRTCPGTSFLICSDSLSGLQALDQCYPRHTLVRAIQESILALDDSGRSVTFIWTPGHVGIPGNESVDQLAKQATTCRPLAIGLPEADFRPLLRNKIRELWNAEWSALDVPNKLRTIKDTTSVWKSSQLGSRRDSVALCRLRIGHTRLTHGHLLRREDPPVCQCGAPLTVVHLLLHCPILAPLRHSFNLPNTLSLVLGDDASVANMVLRFLRAGGIYQLL

SEQ ID NO: 3173 - protein, 1125 aa, synthetic construct
  source 1..1125: note = Description of Artificial Sequence: Synthetic polypeptide
  VARIANT 107: note = Any amino acid
  VARIANT 113: note = Any amino acid
LYLKQPQQLHKVGLPIIHSLVKCLKPQEQHQKIALSLQCKTVSTPTTSPGRHPRRSYASALNTAATTPSSPVNTEETATVAVPSEEGGGKSASFSSKFFSRKQSKEXHNITRXKTLKEVSGSSEVTKSISCNKQNKSFHIMYHNVQSLTNKLQELEIILSSDLNADVICITEHWLEKHQIEALKIPGFHLATSFCRTTINMVGQLFLQNRITWWDSYFCKTEFKAMQSYSDLIKEKVFEMSAIELTDKHLVIVTVYRSPDGDIEEFLCKFEMMLNIVEPTKKKIICGDFNVDFLKSSNYKEELLYITKNFSLIPTVNTPTRITKHSKTTPDQIFIQGTFSSYNSKVVKMGYSDHEAVLLTLELYSEKTPPIKMIECRDFSDGNIANFCNQLSQETWYEIFYETDVNKMFNTFHQTYKYYFDIAFPLQQRKLKPAKNKCWITNGIKISSTMKRYLHSYKKQNHLSLEMQHYIKEYNKIYRKVIKEAKKMGNDEYIRKSKNKIQATWNIVRYETDTKPVAKSISLKLENRQVSEATTVANIFNDFFTKIADDLIQSNFQTPNLHHTVNYKSPKGSMFLKQVTGSELMLAMSSLKKLSCGFDDIPDYIIKQTGYHIVEPLMHIINHSFSTGTFPNLLKIAKVTPLHKKGATDDVNNYRPVAQLSGFSKISLKSSFLIDCQLQACSSAQWLLKNIFEKLFLNRLLEFVNKNSLLSKHQHGFRKSRSTTTAIYEYLNSILKAVDEKEMATGIFLDLSKAFDVIDHGILLHKLERKGIRGISNEWIKSYLTNRQQRVVLKQDTTIGNISRRSTYTSEKTTIKYGVPQGSTLGPILFLLYIDDLNDTVLAKQKTLFADDTSILITGIDQKHLQQSTDTSLLELTHWFKINKLIINTEKTVAMNFHLSHQKQQNNHTLKINNRSLKLVDDVKFLGIYLQSDLKWNTHIKALTSKLSSICYMLRILSTSCNKEIVIQAYHTHFQSAIRYGVIFWGNAPCSHSVFKMQKRALRIICNMKKQESCRPLFPSLKILNLPCLYMFETIVFVKEYLGSTSAYQLNSSVHSYRTRNDSNIHVSYARTSAYQKSVIHIGTQLYNHLPGNIKSIKEDSIFKNKLKSFLMDHSFYSVDEYLSD

SEQ ID NO: 3174 - protein, 933 aa, synthetic construct
  source 1..933: note = Description of Artificial Sequence: Synthetic polypeptide
MATLVKNEILRNVDTITPPTEHVIGIKLGELTLYNVYKPPSQKWPVDVLPKANPQQFMLAISTPNIPDGVTRDPQLKALDPPAVYAGDFNSQHTRWGYPRSSAEGIGLNDWADNQDLHLLFDAKDKATFKSKAWGTTSTPDLTFVTRGATGLPVQGTRRVVEAFPRSQHHPVIVEIGLSIPVIKSPPIPRWNLRKADWNKYRCFVEKTINRIPPKPENYKRFTNLLHKAALNAIPRGSRKEYTPCWTKECETLMEEFEKCGDTETADRLINAMNEERRSRWKEAMENLDFTHSSRKSWGLLRKLGGATIPQRPSLGTTASEISAVLKHTSKIQLKTAEKKEVSRDLSNLLVHNPTNMDIVKEVETEEITQALKLMKKGKAAGPDEILPEFLKELGTLGRRWLAKLCTECISTGALPKIWKEAKVIAVLKPGKTGDNPKNYRPISLLCTSYKLFERILLTRLTPYIEANLPTYQAGFRAGRNCCDQVLSLTTYTEKGFQNKMKTGLVLIDLTSAYDTVWIEGLLLKLTRIIKCKQTYTLLKNMLTGRKIKVSLHGTNSKSVVLNNGLPQGSALAPALFNLYIADLPETKSRKFAYADDLAIAYQSKNFNDLNETLNADLKVLNTYYSKWHLHPNPNKTTSTIMHLNNREAHTKLQLTMNGQQIRHENKPKYLGVKLDRTLSYNAHLEDTKQKLKSRNAILSKLAGTTWGCGASTLRTSGLALVYSVAEYCSPVWMRSAHVAKVDVQLRETMRIISGTLRATPCAWLPVLANIEPPEIRRSQLAIRTHQKILGNLDLPIHEDLRATDRLKSRTAFWKTSEELQEFNSKTAWKELWATSAPKNSNLVDDPNKKIEGFSLPRKLWTTLNRVRTGVGRCKQLMKKWGLTDSSECECGETQTMDHLLACEVYGYNGDLKDIHRLSDSALKWLEKICNVV

SEQ ID NO: 3175 - protein, 826 aa, synthetic construct
  source 1..826: note = Description of Artificial Sequence: Synthetic polypeptide
NWNHIPLITTTQRPRWNFRKAKWDIHPEKLDKCLGWIHPTANNDRFMGAVKSAAKAAVPRGFRKQYVRGWDKECENKYQRFLESGDPEIADDLLHSLDNARREKWIETVESLDFKTSSRKAWSLLRKLGGANKLHHNSTDISANRISAHIQATSRAPRDKKHTRTIRRELSFLKKNSTPLDQYSSKFTTTEVREALKSVKAGKAPGLDGVHPEFLLTVGNMPKNGLLNFIQMSQRSAEECQGRKGTWIGWSTPRIPSYCGEYAKKWLAEFYSDVMATGNIPQKMKNSKIIALLKPGKPSNQPKSYRPIALLSVLYKLLERLLYNRLSPKILESIPDEQSGFRPNRSCTDQVLSLTTHIEAGYQKSKKHQLHLSSTFPDNAYRGRLSKKQKTSIAFIDLSAAYDTVWIQGLLYKLIKIIPCSSTIRLINNMLTGRAFQVITGERTSSTKVLNNGLPQGSVLAPLFFNLYISDIPNTQSRKFGYADDWAIAAQHESFEATEDILCSDLKLLCGYFRKWRLQPNPTKTEVSSFHLCNHSARRELNVIFEGKRLSHNNYPKYLGVTLDRTLSYKEHLTNTANKMRTRNNIIHKLCGTTWGSTANTLRTSAVGLVYSVAEYCAPVWINSPHTNRIDVVLNDTMRTISGTIKSTPTVWLPTLSHIPPPEMRRKNALLREYNKITNNPQLPIHSDVADLERRRLKSRRPALLSAKEMMNTNFEVEDLWKQHWQEHCPPKCQSFMTGEKPPGFNQPRKVWTTLNRIRTGHGRSADAFYKWGKTPSPNCDCGAEKQTVRHIVEECPFRAYKGTFNDFLAATEEAINYIKCLDVNL

SEQ ID NO: 3176 - protein, 893 aa, synthetic construct
  source 1..893: note = Description of Artificial Sequence: Synthetic polypeptide
PPPVQISSIHSTHQPNPTKPSKPGPNSLAAPHLHRKILLLCNPKYLHPIPQTDVLALQVLEQHSHTTSKKLSNLFTSYSRLGLPLSTPSTTSRHTPQPLIADKPCLADLLHLPHPQKLPHTTTQNPQPKQTVMNLSSKSLSPIEVSVLSKGLTFCPTPKFNHAGLVKDLLSFSQSLQWKHHFATNPTIQTHTNTNIEPCLTQFTPPSSQDPPTLPPNHPLLTFQNFLTSNLASPSFPKSLKMDTNLTPSERNAIYHLKTDPDLMILPADKGSTTVVLDRKDYVAEGLRQLSDSSTYTPCHNDPIPKTQQDLQSLLKSLGPSQDLSPESISLLTPPTPRTPTFYMLPKVHKPNHPGRPIVAGYGAPTERISALVDQHLQPITHNLPSYIKDTNHFLHRLSTVPVPLPPGTMLVTVDATSLYTNIPNAHGLAAVEHYLSQCPTDCKPTTSFLVTLTNYILTRNYFSFEGITYKQICGTAMGTRMAPSYANLFMGHLEESFLTTQNPKPLIWFRFIDDIFIIWTEGEDTLSTFLQNLNTFSSIHFTWSYSTQRATFLDVDLFLKDGLISTSVHIKPTNHQQYLHFDSCHPFHTKKSLPYSLATRGRRICSDKQSLSKYAKRLTEAFTDRNYPPNLVQKQISRALSVQSPSSSPTPTVRPQRSTPLVTQYHPGLEQLNQVLRQGFDYLSSCPEMRNTLPNILPTPSYSGIPPPTKPTEIPYQISSPPPPTVVFRRPPNLRNILVHPYSIPAPNPLPHGSYPCNRPRCKTCPIHHPTTTYSSPVTGISYPIKGRATCESSHVIYKLSCNHCAAFYVGMTSTQLSIRMNGHRQTVARRQLDHPVAEHAALHSVTHFNDCYTACAIWILPTNTSFSELRRWELSLQYILHSRNPPGLNLR

SEQ ID NO: 3177 - protein, 1088 aa, synthetic construct
  source 1..1088: note = Description of Artificial Sequence: Synthetic polypeptide
MKIIGTAELAEEATLQLNVQVVEDDAPLMAANMVRWYRAAAGTSIELMHRANDASDGSRSKTHGRNQSCFRWIKIEDSWAKPIIVWFFGHDTAMWKGNGKTTTLLYFLNVGRRRIMMAFLGVKYSGDKLLPRSDLRVGSISGGVIKRDEHFNLRIGTWNVRTLQRAGKLENLKREMDKCEVNIMGLSEVRWTDSGEIVSGNYTMFYSGGKSFERGVAIVMGNELVQSLTKVVCHSDRLMFVKISAKPVDILIVQVYMPTSDHEDEEVEKMYDEIEDIIQSEGTGKVNTIIMGDWNSVVGQGNEANIVGQYGSKHSWTIWLGKRNDRGGMLVEFCQRNNLVVMNTWFKKRKSKLYTWKSPGDMNRYQIDYILVKQRFRGSVKDAKTMPAADIDSDHNLLVADISTRMKKIQQHGRRKQRWDLEKLRENNVAVRESLEKKFNEDEIRASAEEQWQNVKMILLNTLKSEVGRETKRARKPWITSEMLEKMEERRKCKNVNERNTEDRNRGTTKKRKVRPHVPENEGTGEGENKSVRTFGIEDSRGQVVTEQVEVLKTWEEYIRELYDTEHRPHDIDIEPEEAIDEDEKGPSILTSEVEKAIKDMKSRKATGDDDIPVDLLKDIGNDSLKALTQVINKIYETGEWPKDFLDVTMVTLEKKKQAKKCSDYRTISLISHVAKIIARLLNRRLEHKIEEVMGEDQFGFRKGKGTRDAIGMMRILSERVLAVNEEICACFIDWQKAFDRVNWNILMNILKEIGINWRDRRLIRNLYLGQRVKVRLKCGETNSVEIGRGVRQGCCLSPSLFNLYGEMLAREALKGCGNFKVGGRLINTIKYADDLVVLAKNQRQLQHMMNRLVEMGRKYGMEINIEKSKVMRISKREKHLKIIVDNRELENVNQFKYLGCFITKDAHCTNEIRARIAMAKAAFNKKRTLLTSKLSLALRKKLVKCYIWSIALYGAETWTMRKKEKKYLESFEMWCWRRIEKIKWTDRVTNDDVLRRVGEKKSILRTILQRKANWIGHILRHEGLIHDVIEGKINGTAGRGRRRIQHLDDLKDGRSYIRLKEEAEDREHWHHKFSVRRHGPATRQNTT

SEQ ID NO: 3178 - protein, 645 aa, synthetic construct
  source 1..645: note = Description of Artificial Sequence: Synthetic polypeptide
  VARIANT 40: note = Any amino acid
  VARIANT 531: note = Any amino acid
EFAGRRKLGVLPQTRGTPLSFLKTDYDQKICQLLEDPAYXLLENDPTDKVDRKTRSLLKETGWPEKVVKQLRAKAPVPPRLYGLPKVHKQDVPLRPIVSNIGAATYATASHLKKMLAPYVGKCVHHIRNSTDFVERLKNLRISNTDIMVSFDVVSLFTRVPLQDTLDLISERFDGTVLDLFKHILTSTYFLCGGQFYEQTEGVAMGSPLSPVVANLFMEKFEEEALTTAAYQPTCFFRYVDDTFVIWPHGQNRLDEFLDHLNSRHPNIKFTMELENEGQLPFLDVLVKRKPDGTLGHSVYRKPTHTDLYLQADSCHHPAQKNGVLRTLVHRAKTLSDSDNLAAELDHLQRVFTNNGYSSRDIRKALHPTRRPDTTGEERRRDREGSLPTICRAYICQDQQNLEETQNQKCFLPTKQDQQSWIISSECSQTTATRAETSARRYTPPDAQIQQEKKEEETGKVAFLPYAGPISAKISRILRKHKIKSVFCPPNKIRALIGGVKDDLGLRKPGIYQIPCECGMSYIGQTTRTVXIRCKEHQRHTRLRQATKSAIAEHCLELDHTMDYDKTRILAQTPRFWDSIITESIEIKMGEDLINREAGYQLSTAWNPALELLQKQRKKGHPPVELQTTTRDSSSGWPPCAPTTA

SEQ ID NO: 3179 - protein, 678 aa, synthetic construct
  source 1..678: note = Description of Artificial Sequence: Synthetic polypeptide
WNKHFARCLVNYRQIRRETSHSIQATKTEHDKSRTQWPSELRNDPLIVVLPADKGNAAVIMERATMTRRFERCWRRRHMQKLSRDPTSKILRKTSELLKRSSLEDSVIKNLLPQAPRPPTLYGLPKVHKMNTPLRPIVSTIGAPTYRLAKHLANLLTPHVGHCEHHIKNTADFISRIKCLRLGEEDMMVSFDVVSLFTNVPVKDCIDLLSQLFDDTVVDLFKHTLTSSYFLYGGEYFNQTDGVAMGSPLAPVMANLFMEHFEDIALDTAPVRPSCFYRYVDDTFVVWPMDVKNSVNSSTTSIASMTRSSSRWRWRKRVPCRSLTSSSAVKQMDVSAMVFTENPPTQTGTCTPQAIIIHRRNSLFHVRCLAHGREKLGEFFDHINSIHDKIKFTMEVEKEGALPFLDVLVSRKANGCLSHGVYRKPTHTDRYLHATSHHHPSQKQSVLRTLVHRAEVVSDTENLQKELSHLRKVFRDNGYSNSQITKAIFPKTQKQKTPEEDSKKLAFLPFCGSVTGKISRLLKRHKIDSVFRAPSKIRQLMRPVKDDVGLRTPGVYKIPCGCGQFYIGQTVRTIEQRCVEHERCYRLRYPEKSAIVEHALENRHRIAFEETSIITRTNSFWDSVIKEAIEIKIADNTLNRDGGLQLSTAWNPAIGRLKRARQARDQNIAFYGHVAEHQ

SEQ ID NO: 3180 - protein, 925 aa, synthetic construct
  source 1..925: note = Description of Artificial Sequence: Synthetic polypeptide
MRIGTWNVRTLLKAGKLEEVKMLMEKSQLDILGICETRWGGNGDFMSGDFRIIHSGSARSGRNGVAIILRGKWKNNVLNTYHCSDRIIMIKIKAQPMDLCVIAVYLPTTNSKDEEVEVVYEQIDDLMKLVKEKDNLIVIGDFNASIGEDKKGLWNGKFGLGKMNSRGERLLDFCEQYEMIVTNTCFEMPKRRRYTWKSPVDGERYQIYILVKKKFINQIKSSHSYPGYDIDSDHVLVIADYNSKFKKYKRTNQHRWCVEKLKEKQVAADMKELTDNLIGNREGWEGFKETVEVAAKELVGLRKLEPRKPWMTKEILDLIEERNRLRKKDFDKYKRVKNAITQKCRLEKEKWMHDKHKEIQQDLSGGQTDKAYSKIKTMQTKTRTKTNMVKNKNGDLLFELEDVCERWKEYIEELYEGEDIANEGEILEEENSVDIDMIGPPISKEEFNSALNDLSNGKATGTDNIPAEILKEIGDQQKSTYINFTFKEYYEDGKEPPTDLLNSKTVIIPKKEMLWTVKQEKTNLVSDLEKAKAILALRMVLERRIGVNRKTYLTFIDLQKAFDMVNLEGQRLIWNLYKRQEAEIEVNGVKKKAKIRRGVRQGCPLSPYLFNLFIEKAIEKLKRITKGIKINGERIHCIRFADDIVVLADSVRKWSLCCLSKEMEFMLLKFAKILREFNLKINKKKTKTMVVGKTKEKGKVNIKLEDDVLEQVENFCYLGSTITDDNKCITDIKRRIAWQSKLSKIKGIYMYHRYKEKNSLAKQAFQNKRNLLTDNHISLESRKKFAKTFVWSVLTYGCEAWTLGKAEKKRLEAMEMWIWRRMTKTSWVDRKSNEQVLREVNENRTLLNYIGRRKSKMIGHIMRHNQFLKNVFEGKVLGKKPRGRPRATYFNNIKEDMGIKSYEELKRMTMERGTWLNRQGIAFSL

SEQ ID NO: 3181 - protein, 584 aa, synthetic construct
  source 1..584: note = Description of Artificial Sequence: Synthetic polypeptide
ASVSRIPEDQADEIRQEVAYKLRRAPPPRSNIPSSERAAIRSLREDKDLVILPADKGNATVLLSRGDYVSKMNLLLDDSAYRRLRNDPTERIKRKTFHFSHGTNKTEDLSLLKKSSLSEDVVKKLHPGAAVPPRLYGLPKVHKHGIPLRPIVSNLGAPTYNLAKYLASVLAPHVGKCEHHILNSSHFIRRLKSVCLGPSDLLVSFDVVSLFTRVPLEESLLLISDKLDDETVKLCRHVLTSTYFLFNDAFFEQTDGVAMGSPLSPIVANLFMEDFEDMALRTSFLKPTCFWRYVDDIFMVWPHGMDALNHFEDGKLPFLDVLVQKNSDGTLGHGVYRKPTHTDLYLHATSCHPPHQRMGVLRTLVKRAYAISDAEHLGEELEHLKVVFKQNGYTAQQICRAFQFGPKGEPLEDNYKSIAFLPFVGNISSKISRILRRFDIKSVFMPPPKTRALLGSVKDDLGLRKPGVYRIPCYCGKTYIGQTIRTVQDRCVEHHRHTRLLQPEKSAVAEHCLNEGHKMLYDETKLIAPASRYWECVLKESMEIRMADNIINRDKGFPLSKTWNPILSDIKQQRSSFRPAVSFN

SEQ ID NO: 3182 - protein, 690 aa, synthetic construct
  source 1..690: note = Description of Artificial Sequence: Synthetic polypeptide
  VARIANT 543: note = Any amino acid
MNKELTSKLHEYLRLFDEDPFSTDTIRSGMTLSQELAKAKQKRWSEMVESMDMSKSSRKAWQLLKRLSNDPTTPKERFNVTPNEVAHQVLLNGKTEGRKEKIRITRHNLETNDLSAKFTLEELKAAIKMCKSGKAPGLDDILVEQIKHFGPVTMGWLLRFYNNCLTRRHIPKIWRRTRIIAILKPGKPASDAKNFRPISLLCHLYKVLERMLLNRLSPVIEPQLIPQQAGFRPKKNCTAQILNLTQNIEDGFERGLITGAVFVDLSAAYDTVQHKIMLHKLYQLTRDYDFTSFIGTLLQNRKFYVELDGKKSRWRIQKSGLPQGSVLAPTLFNIYSNDQPQPPNTKSFIYADDLALVSQAKDFETVERHLTYGLKTLSAYYEKNHLKPNPAKTQVCAFHLRNKDANKKLKVIWNGTELEHCHNPKYLGVTLDRALTFRKHCLNIKQKVSARNNIIRKLTNSGWGAQPTVLRTTAIALCYSAAEYACPVWYTSVHARHVDVALNETCRITTGCLRATPTHKLYNLAGIAPPDIRREVAANIERXKVEQNAAHPLHGHQTPPSRLKSRKSFMKTTVNCSTSPSTARQNLWTTRNADIATWIPPLEALPPGENLPWKTWKSLNRLRSGVGRTKDNMARWNYLGDESTLCECGSEQTTKHLYSCPQCPVSCTLEDLLQAKENAVELANFWSDCI

SEQ ID NO: 3183 - protein, 1547 aa, synthetic construct
  source 1..1547: note = Description of Artificial Sequence: Synthetic polypeptide
  VARIANT 97: note = Any amino acid
  VARIANT 116: note = Any amino acid
  VARIANT 299: note = Any amino acid
  VARIANT 329: note = Any amino acid
MKKRVDGELVKSDSFILTFNSPRLRTMLRQASCVSQTPDHVKAGFLRLNVRPYVPNPMRCFKCQRFGHTTLGCKGRLPVANVVRQPMMGLTVLHLRXVSTVQGTTQSGVGIVQCTXRRRKYRKLRPQGVSPMQRPKRSSRPCNLLYFPPPSLQYCKNQLLKLMPPPRLRLLVWAPTPALASARVRQQKLQLRSPTDNADKATGTAFAEPWFHNCRACHHVTATATTPPTPPPHHSCNHNLCLHHQATLQSLPSRHRHRHNPTNATTSPQLQPQPLSPPPSHLNPRRLPANTVTGKTVIXLSDFVEVIPPEPSSDPAPELMELDLPQGQXSRPNTEPPPRSVSPSRKKERVKIQPPRSNLRDRWPQYCSGTCRVSGRMWRNSVILTQGRPICICLQETNFKSTDNPELRGYVLHKKDDLSGERARGGVAIFTNTAYHSEPLSLTTHLQAVAVSVMCVTVAPLSHHTFTSRCSICYVRHRLTVCSLYLPPHDTFDVAALEDLLTQLPQPFILCGDFNAHNVLWGSASTCPRGRATERLLLSSSAHLLNTGQPTHFCTATGSFSAIDLSLCSPALAHTTQWEVVDDLHGSDHFPIWLHLPDRVEPECRPPQWVISKADWTLFSQLAELETRDNVQEWVDCITQTIHSAAEASMPLSLGQPKRQPVPWWTAECRSAIRARRAALRRFKSRPTADNLAAFRMARAKCRQIIRESRKRSWQQFLSTVTRSTKSSTVWETIRRISGKGGRCPVAAVMGNGVLHTSPRDIAQTMAIYFANVTATAHQDPAFQRHRVVAERGNLDFRSTGHQDYNCPFTLWELDSALSVARDTSPGNDRIHYSMLRHLTQRNKEILLNLFNAIRPGHFPDSWREAILIPLLKPGKDRTCPSSYRSVALTSCVGKTLERMVNRRLVWMLESRQLLSRFQCGFRRYRSTFDNLASLEAAIQQAFLRRHHLLGVFFDIEKAYDTTWRHLILRQLHEWGFRGCLPIFIRSFLSPRYFRYRVGGVLSDRFEQENGVPQGSVLSVTLFAIAINSITSVVKSPVQCSLFVDDFSVFCSSSSLATTTRQLQLTLRRLDEWAQKTGFKFSTEKSVCVLFNRSRSIFNLPELRMRDTVLNFKDTVRFLGLTFDCKLTWLPHLKDLKRRCLKALSILKCLSHTSWGADRTRLLQFYRAFVRSRLDYGCTVYGSARPSYLKMLDVVHHEGIRLATGAFRTSPIPSLCAEAAEPPLSIRRQLLMVRQAYAALSTPYTPAYNTVARPPMERLFRNRLRATRPFGIRAKDCFLDMGVSDFTVLRRGWSRYPPWLLQRPSLLLDLTSFKKDCTPDITFQSEFFNILNKHRDCTVVYTDGSKQGDSVGCSAVFPGHIVGIRLPAAYSVFSAELHAILQALEHIRRARGTKFLLCSDSLSALQSLLVMYPAETITQLIHDQLYLLQRRGKEVSFLWVPGHVGIWGNEAADVAAKAACSDPNVTECAIPLRDVYSVLRQRSLQLWEETWLAVTGNKLRLVKPTVRPWRTSCQPFRRFEVTLTRLRIGHSPLTHSFFIPSGGSTDL

SEQ ID NO: 3184 - protein, 498 aa, synthetic construct
  source 1..498: note = Description of Artificial Sequence: Synthetic polypeptide
  VARIANT 281: note = Any amino acid
RNTNSELRKSELKDPGRYNYLGIVTIGLLQDLPNTCTLLSMHVGHCEHHIKNTADFIDRIKGRRLREEDIMVSFDVVSLFTCVPITDSIDLLAQLFDDTIVDLFKHTLTSSYFLYGGDYFNQTDGVAMGSPLAPVVANLFMEHFEEIALDTAPAKPSCFYRYVDDTFVIWPHGQKKLLLSLRRRYLRHLASWTEKIEEFLEHINSIHGHIKFTMEVEKDGSLPFLDVLVRRKPDGSLGHSVYRKPTHTDRYLHATSYHHPAQKQSVLKTLVHRAETVSDAXNLSNELSHLRKVFKDNGYSKRQISQAVSLKARNQKTSEEEVKKTAFLPFCGSTTGKISRLLKRHKIDTIFRPPAKIRQLMKPVKDDVGLRTPGIYKIPCECGQFYVGQTVRTIEQRRIEHERCFRLRYPEKSAVVEHALENGHRIAFDETSIIKRTNSFWDSVINEAVEIKISENTLNKDGGLQLSTAWDPVIAELKRARRTRDQNIALYGQGTGHQ

SEQ ID NO: 3185 - protein, 581 aa, synthetic construct
  source 1..581: note = Description of Artificial Sequence: Synthetic polypeptide
SPIQSHGFKPRAGGSPGKCAYKQSGCFDGIYPEFLKNAGPKTKRWLLQLYNIILTTGKLPTTFRAAKVIAVRKPGKEGSEASHYRPISLLSVVYKLLERMLLNRIQPLIDKATPLHQAGFRKNRSCCDQVLALTSFIEAGYQRKLKTAVAFVDLTAAFDTVWRHGLLLKFAEAIPCQKLVNLMDSMLSNRRFQVFLGDKGSRWRRLNDGLPQGSVLSPTLFNLYTSDMPNTSAKKIQFADDLALAYQARNLEECEGTLTTDLHIMGDYFKSWRLKPNPTKTEVNAYHLNNREANRKLNVVFENVPLEHNPYPKYLGVILDRALTFKNHLEYVAKKVNTRIDIVRKLAGSGWGANADTLRTATLALVYSTAEYCAPVWKNSAHVRKVDVKLHQAMRIISGTTKSTPLPWLPVLCNIPPPSIRREAAAIREFHKSSTHKNSLLYNQLRNIPTSRLKSRKPPWPMQDSPLVYDVCQEWKDVWKKFPPANSRLITDPTKRVNGFGLPRKLWTSLNRFRTGHGRCSACLYEWGYKDAPACDCGAPVQTMQHLIEECPPRKFPGGLSELHLVTTRAVEWLRDLDVQL

SEQ ID NO: 3186 - protein, 495 aa, synthetic construct
  source 1..495: note = Description of Artificial Sequence: Synthetic polypeptide
MNPQPPKLRSQFKVHKLNHPIRPISNSLNSAYHDLARFLHETLKKSFVFQNNYSVPNSHVLVHKVKDLDCGPDTKLFSLDIKNLYTNVPVVETLKIVEKNLCQFKKLSSEQITDFMNLINVVVKYNYFEFNGKLYQQDDGLAMGNPLAGILADIFINSLEEKFFHKFSTTTLGIVSYSRYVDDILVIYEGPTTGIDHIFTLFNGLHENITFTCELENEARQLNFLDLTLTVEENKISFNIYRKETYTDQIVPASSMHPQCHKNAFFHSAIHRAISIPLSKEKFEEEINLIKTIAVNNEYDPAIVDNILKKKTAKRVTTLGTPIESDQKKKYFSIPFLGPISYQIQRLLRNKYNCNVAFSTNNNLKKNFIHNLKSTCSPLDNSGVYKIVCDTCSSYYIGQTGRAFKIRFKEHLLRKNGTNPQNSSFADHLLITGHAPKAIHDLNILHTEKKGHRLDVLEELQIFKHFSRNDGLILNEQLQLRNRSFFNGIKPLLGL

SEQ ID NO: 3187 - protein, 743 aa, synthetic construct
  source 1..743: note = Description of Artificial Sequence: Synthetic polypeptide
MGNAVVVKVHGSRETQESTRCSPGTTFNQTDIGNHRGMHRLIAAGRLQGGDRSLYGKMEYTRDPEEGKALKTQCFQIEGKGAKPEASGGSTIKEALQETAEEVLGLEERVKRADGTMKIVKRLWKKEMRQGRKGKEENDKQDNKIYYRKFMKKRKEADRICRRKKRELERDGLWSRGMDYGAREEYNDEEVRKFYKKVRELKKGFQPRTLQRRKASNHVLCRDKEGNFIGGEEQVLDQWAKYFSELLNVTTEREDKMSLQKEKTNETEGDQPWQNVSQDERPVPIPTIEEVRKAIKSLRNNKAPGNDNISAEMIKGRGEHLTRLVHQLIVEIWEKEEMPDQWNMAIICPIHKKKDKANCENYRGIALVSVVYKVLAKVIAMRFAPITEEILRRLPVRLSAGQINNRPNFHYKANNGKVLDLHQLQKKYSGDYQCGFRQGRSTTDQIFIIRQIMEKCYEYNVDVHQLFVDFKQAYDSVKRKKLYQTLMEMEFPSKLIRLVQMTLTSTKCQVKIEGKLSKEFEVNQGLRQGDVLSTLLFNIVLERVMRRVEIDNPGGTLFNRMNQNLAYVDDVCMLSRRLKELEEGFDRLEKEAEQLGVNNTKTQYLFASRKNAVVKEKYIKLNRGNYERCEKFQSWGAVTEDSRQIREEIKSRIAAGNRAYWAMIKILQSRSLSRKSKVTVYRTVIRPVVMYGSETWTMTVAEEELLRRWERKILRKIFGAVIEVGQWRIRRNKELEELYRNLT

SEQ ID NO: 3188 - protein, 721 aa, synthetic construct
  source 1..721: note = Description of Artificial Sequence: Synthetic polypeptide
  VARIANT 623: note = Any amino acid
MTIKCKNKMYTLVNAHAPTNIDNKKNPTKVQTFWEELEDTIQKIPKENIIILLGDFNAQLGKERKYKNIIGEYPAHKRTNNNGIRLVELCQVFNLKIMTTHFKKHPKKMKTWKAPNQLLGEFQIDHIAISRREFKTIQNIKVQKGAKIDSDHYLVKSKIKFIPNSVKNNKKPTRKNFETNNIDADTKNIFKSKLQGETWEEMKSQIMKAAEESLPTKIKRKNIWWNDKCNEALDNRQTLWQKFKSNPTQINLERFREGRKIASYTIRNEKRLFEKLSLQQIQVHFTQHKSRDYYQSFKRHLNGYEPPSLNFRDKSGKLGTNDQENCNILAHYFKDLLNCKAPPEKPEFKTTEEIPAESHPPSLDEVRQAIKSLKNNKSSGEDGITAELLKLGEEKVTLHLGTIIKEIWQTEKIPEDWRTALIHPLHKKGDRSDVNNYRGISLLSVPYKVLSKILLNRIEPVLDAQIGEYQGGFRKGRSCSEQIINLKNIIRTRAGQPHVTTFIDFRKAYDSIDRESLIRTLEEFGIDRKTREIVKQTLTDTKSKVKFRGKISDPFKIQTGLRQGDGLSPILFNITLEKIIRETLAEYTQEKVKGISFGGSVKGLTIHALAFADDIALLSTNIXDAIKQIEILAKHAAKFGLQISQEKTKFMSNKFKEVNKLHTIIGCIERVKHFKYLGETITDTGTEKEAVKLRVAKLRRAQILTMKLYNKKCLSRNAKLL

SEQ ID NO: 3189 - protein, 1306 aa, synthetic construct
  source 1..1306: note = Description of Artificial Sequence: Synthetic polypeptide
MNRDCDCCVRMQSELVTLRSQLQAVLTSVAQLEAAIEGRRCCWPVVGTERTPVVSTDRPAPATCPDTASSEADTPPVVAWEVAPVRGRRRKTFRGTDREASPVRLANRFEALSVQDNVPESDGVSHPEVTTQPARSGLSQRWVCLRDGCQGGEEGQRALRVHTGGVIPDVERVLPDAMKGTGCSQLQVVAHVGTNDVCRFGSEEILSGFERLSEVVKTASLACKMKAELTICSIVDRTDCGPLVQSRVEGLNQRLRRFCDRVGCRFLDLRHRVVGFRVPLNRSGVHYTQEAATRVAGAVWRGLGGFLGVRSPLYAGSGYTGSGGCVAWTGRFFRIKSFGEIENGQSQRVQVDHRRNVDPETIGITVVNCRSCVGKVPELQALIESTETHIIIGSESWLKPEISSEEVFSKDLTVFRKDRLNKIGGGVFVAVKSSISCSEVEVDSSCELLWVEVVPENRKKLIIGSFYRPPDSDDTIAERFKENLSLITKTYPTHTIIVGGDFNLPSICWQNYIFKSGGRHKTSSENALNAFSENYFEQLVHEPTRIVNGCENTLDLLATNNPELIMSIKTDTGISEHRAVVAKLNIESPKVTKNKRKVYLFRKADRNKIHCFLKDSFHSFLTLNVGVDQMWLKFKEVVSTAIESFIPNKLIKEGGDPPWYTKQVRTLLQKQRKRHTKFKRTRNPQDWRSYTEARNLARTSMRDAYNTYHNETLSRNLTENPKRFWSYVKYTRGKTQTIPSLRDSNGDPADDSATKAELLNIAFRNSFTKEDETNIPDFELRTEARMSNVEVDIIGVVKQLKSLNKNKSSGPDCIPIRFLSDYAEAIAPYLTAIYNRSLKEGSVPKDWKVAQVTPIFKKGSRSNPLNYRPISLTSICSRVLEHILYSNIMNYLEQNDLLTQGQHGFRKYRSCETQLALYSHEVMSAIDKGSQIDSVFLDFQKAFDTVPHKRLLIKLRGYGISPQICDWIGDFLSERTQFVVIDGKASTKTEVISGVPQGSVIGPLLFLIYINDLGEICYWSSAVPYLHKRFRGNLSSSLRLFADDAVIYRLVKSSEDQNQLQNDLNKISLWCKNWQLTLNNEKCEVVHMSTKRNPLNFVYKINQSKSRPHEYEKKSVKLCLQDKSIKVKAVNSTKYLGITITSDLNWKEHVDNVVGKANQRLRFIGRTLKRCNRTTKETAYTTLVRPFLEYCCPVWDPYQVGLTEDIERVQRRAARFVLSRYRGDSVTEMIQDLGWESLQQRRLSLRRGLLTKLQSPTFSSECENILLTPTYIGRNDHQNKIREIRARTERFRCSFFPRAIREWNGR

SEQ ID NO: 3190 - protein, 983 aa, synthetic construct
  source 1..983: note = Description of Artificial Sequence: Synthetic polypeptide
MMTGFVTKQSGGKIVPNSDLRQGTVSKCVIKDDRRQVRIGTWNIRSLSICGKLENVKKEMEEHDIDILGISEIRWPQKGDFWSGNFRIIYSGKEGSYAGVGIILRKHVGTRVKSYVQYSDRIIMLRIENDPIDTVIIQVYMPTSSHADEEVEQVYEQLEEIMEMVKDKDNLVILGDWNASVGEGEDGNTVGKYGLGRRNDRGQQLVDFCKEKELIIANTWFQQPKRRRYTWIAPGDRARYQIDYIMVRRRYRNQAKQCKSYPGADVATDHNLVMLKSNLRLRRKGQNTKGYCKYDVKKLRQDSVKERYQKQAQQKVKEIPNGTVNEKWIGLKHSILQAADREIGNIKKQATQPWISDHTLELMEERKKFKNSKSEEGIKSYKRLRNMVNREAKKDKEEYIMRRCKEVEEKLEKGNIETAYELIKKQFKKVNGRSNNILDENGKRLFENKEVGERWKRYIEKLYEDPDEISNLENEETVTKDQLGPSLTKEEYLKAVRELKNNKAPGCDALTGEMIQGLDNETHNYIFKLIQDMYETGEIAEDFKKTIIIPIPKKPGTIKCEEHRTLSLISHMSKILTKIIYNRIISKIEQNLDEDQFGFRRNRGTREAILMLRQIMDKMLDLKRPLFIAFVDLEKAFDNVNWNLLMEIVTNVGLDFRDRRIVHELYKNQRGVINIHGEIQEAHIKKGVRQGCNLSPVLFNLYIEEGIKECKESMEGIKINGVQIKMIRFADDIAIIEESEENLQKALSRMNEILPAKYNMKINTKKTEIMVCSHEQITTDIKINDVPLKQVNVFTYLGSKITPDGKSSADIKSRIAQAKLAFNNKRMLLTSRNIKEETKKAFIKCYVWSVALYGSETWTLGVCDKRRLEAFELWCWRRMQKIPWTAKMTNEEVLRRIGEKRALVKTIMKRRDKLIGHLYRHNEFIINVMEGMVEGKRGRGRPRLQYLKQIQRDIGVESYQEMKRLSENREVWRRRIAANQSSD

SEQ ID NO: 3191 - protein, 1308 aa, synthetic construct
  source 1..1308: note = Description of Artificial Sequence: Synthetic polypeptide
  VARIANT 269: note = Any amino acid
  VARIANT 310: note = Any amino acid
  VARIANT 342: note = Any amino acid
MIEEQERLICALQVQLKNAEEELGRLRRGRGAGEWELAVGKKVARRRYSDSFTLQVANRFDQLSELSGDEPPVAVGVGSTQQTSAFGKPKSVERSLRKKKVLLLGSSHGRGVGQQLQEVLGSEYQVTSIVKPSAGLDQVTCNIGDLCRNFSKEDQVVIVGGAGNSLDRDGEYDIGGDLERIATQTGGTNVHFVQLFQRHDRPCLNTAVSRVNMGLEKALMTEGMDHIAVVPVETIQRSDFTRHGLHLNRYGKGRLAKLIGDSVVGGGGXTHGKIPVVVGVRAAPFLDGCTFFRLKTADRYSCLKEVPLRXEPPLTKSKNISNKGITVFHQNIQGIRDKVNEXLIDTDSDIIGISEHFLSGVTIQRLPLPGYRLAAFYSRSSLQCGGVAMYVKKRFFIGVNRFFKNDFSSESIDFSKHCTEQIFECCAGVVNVNGTKLVIVVIYRSPDSDFKMFLPKLELVLGSLYRKYKNLIVCGDFNINCVGDSSRKSQLLDLFNSYNMMQTVFFPTRVQGNSSSTIDNIFVHSSLLEGHSVSRIVNGLSDHDAQLLILKSICSQTNVKHKYQLLRKGKVFVLKQMLNININYSEKVNPVAIETFLSLIKEQEWQDVYSADNADDKYNAFLNTFIMLFESCFPLERSKQGTSSNRQPGWLTKGIRVSCRTKRELYQNVRSSQNEDAVAHYKQYCKVLKNVIKNAKSMWYAKRIANSRDKIKTIWSVVKEVSGQQQQVEDITSVRSRNVSVTDKLDICAIFNNHFLNIVGELNKTLVSTGNHITFLENAFPRLLPEMVLHDTSIGEIESIIKSLKTKDSCGYDGVSSRILKYCSPYVSPVLSHICNFSFQNGQFPDRLKYSVVKPLYKKGERDNVDNYRPISMPSVFSKVIEKAVYSRLIDHFSSHNLLSNVQFGFRSGLTTENAIFSFLCEALDGLNKRLRTLGVFFDLTKAFDCVDHKILLQKLEHYGIRGVAHNWFTSYFNNRQQKVILRSVENGYDVQSQWGTIKCGVPQGSVLGPLLFLIYINDMPSSITGDCKIFLFADDTSLVVKDVARNIDTVSNNAVQEISSWLVENKLMLNHSKTQFLQFLTHNLTKADILITHNGHMISETEQFKFLGVHIDSKLSWKAHVQDLVPKLNSAIFTIRTISEISDFSTRKVVYYAYFHSLMTYGIVFWGNSPDAKRIFLAQKRAVRAISGVSSRTSCRPLFSSLGILTLASQYVFSLMSFVVNNISLFPRVSSFHSVNTRQKSNLHLHHTTLTLVQKGVQYSAASIFNKLPQELKNLSTNPHAFKSKLKSYLMAHSFYSVEELLEKLNN

SEQ ID NO: 3192 - protein, 990 aa, synthetic construct
  source 1..990: note = Description of Artificial Sequence: Synthetic polypeptide
PPSVVPIMAGSPHRILYHNIRSLPANKPLFMHTLSQHCVDAFLLNETFLQPRHSVSTTPYTLHRTDGPPPLARGGVAIGHLRHHPVRPQPPVNNPAEHLILTLFLPSLTVTLATIYIRARVPIPYDFISHIDNSFTTYVIAADLNLHSRSAAELQRWHQFLPTLRGDLVPLPSPTRPESNTTPDAVLVSPNLWDACRRKSLTSLAVTTPPYSSPSTPAAVPAAPPVLCPLLGPLGRLQAEVLDLIGSDHAPVLLTFNPRGRPGRATRPVPPPRLVHDYSRADWDAYRRSINTSVASHPLSLHTPDDIVHASSFLHQTVADAVATHIPTKAIHPHRPPLPPQAVLLLRESRRLYRSFLRTRDRDTLLRHRQLQRHIRNLLNAKKRRDWRQTCTRLNATLPINSSKYWKAFHRLTGSHSVPAYPLLHNNLPLPDNASKAQLFADHLSNIFDLPDNPRFDYSRFPDVHERTDTSVPPLAPGFQYLDHIPPSDLNTPITAQDIVHTLRTKRNTAPGHDRITYRHLRACPPSFHSALASLYNVILFTGFYPDLWKTSRILMFLKPDKPPSEASSYRPICLTSVFSKVLESILSRRIHEHLRLHQLLPLSQCGFRPSFSVDDQLLRLVHLLSVQVNSRRAAILVSLDIEKAYDRVWHSGLLFKLQTYALPINYVRLIASFLSKRPSYVTVNNQNSRLFYPSAGVPQGSVLSPLLYLLYSADMPRPQPPVHLLQYADDTAFLALAPSLARSQHLLQSHLSEFSSWCNQWLLTVNPTKSQAIIIGRTTPSFRHRDLYLTLHGRPIPQTKTLRYLGLTLDRDLSWNPHLKTVRQKALSRLNLLKCLSGRTWGLNPSTILYTYRSLMRPVLCCFHPAWISAPPSYYESLKILERHALRLAYRIRLPSPTRILYDLIPFPHLVQFLQHIRLKYIHRKIESHNPLVSPLLLDPGPLPRLYRHIPPSLHLHTLYVLSEGGFRHLPLPDDVLHNRPDIYPSFQL

SEQ ID NO: 3193 - protein, 561 aa, synthetic construct
  source 1..561: note = Description of Artificial Sequence: Synthetic polypeptide
MIGERKALKELNADNDIVVLPADKGNATIVLNKDDYESKILDLLTSGQYRKLKKDPTASVLKKTNTLIKSSTSIPKEDKKALLKSEAMCPRLYGLPKVHKINIPLRPIVSAINSPTYEIARYLATCLQPYIGKTDSYIKDSSHFIGKLEGLTLRPEDMLVSFDVVSLFTMIPVNEVMTFITDIFPEDLTTLFKHCLTSSQFQWGGDFYEQVDGVAMGNPLGPAIANFYMEKFEQSALGIAKKKPVLWYRYVDDTFVVWPHGKEALDEFFSHLNNINKKIQFTMEMEKDSAISFLDVLVMREVDGKLKHKVFRKATHTDRYLHKNSNHHPQQKRGVIKSLVDRAKKICTPEHLDAELKHLKQAFKKNGYSDKEINRVLRPNNNSLRTRDQTKRWKNTVSLPFIGKVTDQIGKILRKHNIRPVFRPTKKICQVLRSVKDKRPTLSACGVYKIPCTCGKVYIGTTKRSIETRLKEHKSLCRLGKTEKSAVAEHALQSGSHIVRFSETSVLSTMTNYYPRQYREAIEIYKHKENFNRKEEAMKLSDIWTVALKDRQVLSLTDCNR

SEQ ID NO: 3194 - protein, 965 aa, synthetic construct
  source 1..965: note = Description of Artificial Sequence: Synthetic polypeptide
  VARIANT 476: note = Any amino acid
  VARIANT 524: note = Ile or Leu
MPRKNWNCGRRTGDEKRKMMFGCWNVQGISTKIDLLPAELDMFNIDVVVLSETKRKGKGEEELDNYVHIWSGVSKAVRAKAGVSIMIQKKWKKRITNWTFINERIITVEMTLFAREVVIIGVYAPTNDTKDKEKDAFWDTLRETIEKIPRRKELIIMGDMNGRVGIRESCKIVGKHGEAEYNDNGERLIDICAQFDLKITNTFFKHKDIHKYTWQQNTKELRSIIDYIIIRQTSSFKAADVRSYRGAQCGSDHYLVKMKSFWPWKNATNDTSNINKMNCSEKVQNVHFNIDSLQDESIRTFFKARMERTLDESFEGSTEEIYEYIKTKVKNVASEVLGIKENNPKRAAEWWSEEIETSVKEKRNAFVQWLNDKSEGTRSKYKEKKNEVEKKIRLAKNEAWERTCANVNSKLGFGRAKEAWSVLKALRQDTKGKSNLQLVTQKEWEEYFKKLLNEDRDEYLEEGTVEENEHHDDEIXISESEVLQVLRTGKNGKSPGPGNINMEFLKYGGDKIVKLILQLFNKMXHGDSVPKEMKLGYISTIFKKGDRKICSNYRGICVTNTLMRIFGKIIKNKLEKNFRTQQEQCGFTAGRSCVDHIFTLRQILEKHREKSKNVGLIFIDLEKAYDTVPRKLLWRALHRANINTSLIKIIEQMYKDNICQVKIGNTLSQKFRTSKGLLQGCPMSPTLFKIYIDICLRTWSQKCNSMGLEIRDGVYLHHLLFADDQVVIAQDGEDANYMCNQLAIAYKNWGLKINYQKTEYLTNDPHELRIEGKKIKKVNTFCYLGSILETEGKSDSEINKRISSGRKVIGMLNSVLWSRNVMNRTKKIIYKSIFESAVLYGAETWTINQKHTKKLQALEMDFWRRSARISRKEKRRNTEVIKRMEIIERIDEVMDRKKLRWYGHVRRMEDTRIPKLVLEWQPEGRRRRGRPVTTWIKNVQLTMNRLGAEEEDTQDRHTWRNIVNN

SEQ ID NO: 3195 - protein, 558 aa, synthetic construct
  source 1..558: note = Description of Artificial Sequence: Synthetic polypeptide
  VARIANT 165: note = Any amino acid
RRHLVLINKQDYIQKVFEFFDKNGIIKIPCDPTNKYIAQTRKIIKSCSSILSDKDKRKYIPMNPKTPQLRGHPKTHKELSPIRPVVDSINCPTYLISKKLNTLLQKYYTYKKKYTIKNSRTLAANINKIDIPINGKFVSFDIINLFTNIPVKETINIIELNLLSXNKLPINSTYEIINLLHLVLEQNYFKFEDNFYTQPDGVAMGCNLASTIADIFLNTLEERFFLHQETNKIIYYYRYVDDIIVLIDGNETDINNIHGLINKLHPKIKFTMELETNKTINHLDLTIQNVQNKHRFEIYRKPTTTTNIIHAHSCHPSSHKLAFFHSMINRLINVPLDDAAKQKEMTILQYIAQQNEYDPNIILKLYNNKTSPRPPTTRTEITLQRETSKLNKPIYISTPYLGKISNKVQQIFRKTNTTFAFQNRHTLKHKFVTHTTKPSKFLNSGIYKISCNSCNKYYIGQTGRNFTIRYKEHTRESEKNPSTFYQHLQSENHTVDTIDNALEILHTVQKGYEMNILEEMEVCLHAIKNTNNLLNDQTDFKHKNYFDNFIHILVHDNG

SEQ ID NO: 3196 - protein, 990 aa, synthetic construct
  source 1..990: note = Description of Artificial Sequence: Synthetic polypeptide
MNRSRMDKKDLTFSMKSDTRIGMWNVQTMWQAGRLAEISREMKRYNIQGDEKILGLSETRWTGFGEIKTQEGDTLLYSGREEEHRGGVGLLITQKTKKSLIEWYPVSERIVVARFASRVRPITVVQCYAPTEAGSEEEKEQFYGQLHRTLLKAKKKDIMVVMGDLNAKVGNDNQGVESIMGKHGIGNRNDNGERLIEFCSNHRLVIGGTIFPHKNCHKVTWVSPDHRTENQIDHFTISKTWRTSLLDVRNRRGADVGSDHHLVIATLRLKIASTRNTQQKRRIKYNWDKLKNKEVQQCFSLELSNRFQQLREDEEQDIERNWKSIESTYIDTCEKVLGKRERGREEWITSETWEAVNQRKECKKRLNTARTQEEKVQARTEFNELNKMAKRRFRRDKRAFINNLAAQAEMAAQKNDSKTLYDITKRLTGKCFRSEKPVKAKDGKLLTSQKEQLERWREHFLEILNRQTVEEEVTEAATEEEQEDVDISIEPPSRIEIQRAIQQLKNGKAAGMDNITPEALKVDVSTSVEILFPLFKKIWEEEKIPTDWKKGLLIKLPKKGDLSECDNWRGITLLSVPSKVLSRVILERIKKRVNSRLRKVQAGFREGYSCTDQINTLRIILEQSTELQSSLYLLFVDFEKAFDSVMRKKMWKAMQEFGIPKKIIKITQEMYENYTCQVLHQGMLSEPIPVDTGVKQGCLLSPILFLMVLDLVMQKAMNRRRGIQWGLTGRLEDLDFADDLCLLASSYKDMEAMLNDLKTEASEVGLKINGKKTKEMRCNNRNEALFFFKPRDRASQAVLLPGKFSHPGGRTIEDIGNRINKAKGAFAMLRPIWKSRELNSYTKLRIFNTNVKSVLLYGCESWKTNKQLISRLQIFVNRSLRNILRIWWPQVISNEELWRRTHQTPIDIEIRRRKWKWIGHILRRGKDNVARQALEWNPQGSRRRGRPRNTWRRSVVAEGTEKGGKAWTEIKTLAQNRVRWRKFVDALCST

SEQ ID NO: 3197 - protein, 938 aa, synthetic construct
  source 1..938: note = Description of Artificial Sequence: Synthetic polypeptide
  VARIANT 115: note = Any amino acid
  VARIANT 503: note = Any amino acid
  VARIANT 508: note = Any amino acid
MRLSIQIIEKPAVDVIALQETHTADDQQIKSRGKIPGYKLIASNNHSKCGLAIYVKHTINSLKQPFKMWSSNLRQAYIKNYQVVSVSSENNIFTISAKIDSATIVNVYKPPRVNXPTPPLPSQQHPTLFLGDFNSHHNLWGYCENDSNGEALCEWMETENLKVIFDAKDPPTFHSGCWNRGYTPDLCFTTQLHSSHTQIRRSALRISLTVSTDLSFSRDWNMCTPCAVTPETKVEFQESRKSNVDKATDLLQSLDENRKKIWHETVESFDHTHSSRKAWSIIRKLDATNQTPVRPKTAIKLNDFAKHLISNSKSPKDKQTRREIKTQLNTKKRAAPNSSKFSNPFTEEEVRDAIRNMKVGKALDSMGSILNFSHTVDQQLSNGFLTSSQTFSPLEIFHHYSRKPSRGSKRCHQKHESWKGAGFDGIYPEFLTHCGPATIKWLSNFFSDILSTGNLPPLFKKTKLIAILKPNKDPTKVESYRPIALLSVTYKLLERLIYNRIHXTINKXIPIEQAGFRPGRSCNDQVFALTTHIESGYEKKFVSIAAFLDLSAAYDTVWREGLLLKFVSIIQCRKLTNLLSNMLSNRLFQIYSDNDRSKVFKLNDGLPQGSVLAPLLFNLYIYDLPATSSRKFIYADDICLVTQSPSFTTAESTLTADMEILDTYFRKWCLRLNLQKTVTSAFHLRNRHSNYKPEVKLRGQTLQYCSTPKYLGVTLDRSLTFRQHLSNVAAKVKTRNNIIQKLAGTSWGCSAQTLRSTALALSYSVAEYCCPTWMNSVHSRKIDVQLNQTMRLITGCIHSTQTAGYQFHPTSSSTRSDALLKIWRNIQKNPQLPIHSDTSTAEHQRLKSRKPSWKTAHHLDVTNFDINEAWKSHWEESSVSTVIWLKTLQCEFQVSHSPDASGESSTASEQDKGTADIYSTNGAGQHLPSVTVELPYKQ

SEQ ID NO: 3198 - protein, 1570 aa, synthetic construct
  source 1..1570: note = Description of Artificial Sequence: Synthetic polypeptide
  VARIANT 1230: note = Any amino acid
GQVWRSGIFFENASGAVLIQTASPAQSRALLACDKLGDVPVSITPHKSLNMVQGLIYHRDLLSQTDEELRANLERRGVHFVRRVYRGPKDQRVATGAFILAFEGDTLPEKVKVMIYRCDVKPYVPPPMRCFRCWKFGHMSSRCTSSPNCRECGRPSHPDAPCTPPPVCVNCGQHHPPCSPNCGVLHRERKIMEIKTLDRLTIQRHVKSMSGSIRAAPSGKDDNIFCRSHSGTSFTAINGQCSLLCGPYGPTTSTAPSMGGGTSSSVAPTTPPVGAITPSPSGTSVPAPSRRRNSLLRLLSLGRGPWDTPFRGFSQCTGDPSQRLKGPRPAGRRASRSSSNPDATTEKPSQASKPKGQREGRQKKSKKKETLVATKPQAPSSSASEDEVEILASPEDLAIPGSPESRIADTGDSEQLAADVMDEPVLLYGFSARRPVLLQWNCGGFFNRLAELQQLLCRFPVLCLALQETWFPAQRTPALRGYRGYYKNRAAYDRASGGVCIYVLATVPSAAVPLHTTLEAVAVRIRAMQEFTICSIYLPPDEAVSIADIAALIAQLPPPFLLLGDFNAHHPLWGGTQTTGRGRDVEALLSQRDVCLLNTGAPTHFCVARGTYSAIDLSVCSPSLLPHFRWKVHDDLCGSDHFPILVSLLHFQPAGHQPRWSLRRADWQRYASAAVVPVPLPADVDMAVHQVTSSIVSAAEATVPTTSGSPRRKSVPWWTPEIAEAIRDRRRALQRHRRHPTMENLIAFKRLRARARQLIRQSKRDCWEQYVANIGSRASSSQVWSQVRRLFGHRPPAAIPSINIQGTVCTDPTAIAEHMADHYACNSATAAYSAAFRALKVRVERRHLSFHTRRDETYNAPFSQWEFQTALAACPDTSPGPDRIHSQFLRHLSAESQHQLLALFNHLWAEGAFPSQWRESIVIPRNVQCAIQSVGIPNCPCCMPRYLPGTRPDPQPVPSPPFSRVPTPASRPVQPSMGRGGFPITMAGKHRYPVMKPGADPQVADSYRPISLTNVLCKLLERMVSRRLMWILEHRGLLSPRQGAFRQGRSTVDNLVALESAIRTAFSRREHLVAVFFDLRKAYDTTWRHHILATLHGWGLRGPLPLFIQNFLSLRSFRVRVGTSLSSPRIQENGVPQGSVLSVPLFLIAIDGLAAAVGSSVSSSLYADDFCLYFSSTGMGVAERRLQGAITKAQSWAMTHGFQFSASKTRVMHFCRRRAVHPDPELYLGXDLLRVEQTHRFLGMQFDARLTWVPHLQQLRKKCWRHLNVLRCLSHTAWGAARTSLLQLYKALIQSRLDYGSLVYDSAAPSALRVLDPITIVASVSWGSPPSESAGSSYWLLVARIHASPDHPNHRLLFPAAVLPSPRRRPRSGLPIAVRVRSLLSSLASLPIPPTFHYLSRTPPWFVPRLQLRLDLSSDSKASVSPMVLCRQFQALIDSFHGAEVVYTDGSLVDGRAGYAYVHGDHVEQHSLPCGTSVFTAELVAISRALTHFRDCPGESIVICSDSLSGLLALDQFMPKHHLVRSIQDAVFTLGESGRSVVFVWTPGHMAFRETNESITWPSRPPHHGP

SEQ ID NO: 3199 - protein, 1134 aa, synthetic construct
  source 1..1134: note = Description of Artificial Sequence: Synthetic polypeptide
MLIKLLQKDDHTTRQPIAIQSVSTKDTQKCQNNPKRRKLCQLSLKIRLHHGWKKNLHQYQPQQIPLKKTRPNRRNERRQGPTEETSSEVSDKIMTPFLKILKKKKRFKAVLFSVPSKHPVHKNKVQQLEVELQTLNSSLVCITEHWCKGHELTHVALKSYVLASHYSRTTLQCGGSCIYVKEGIVFKVRDDIIALSEDKHIEISAIEISKLNVLKRLTVLCIYHAPSGDMDTFIAKLNTSIGHGLMYSKDSLYYVFTMLPVVTWILLLQSLTQALDMVSKPKGRILICGDLNINTLNADGTCITFLNTLHSYNISPLINTATRITKNSASCIDHMLTDIEKDMCNVVVDHLGISDHSSQFLKVNINVETNTKLLKYIRVFSESKRSVFASQLASESWAEVYRESTVNGKFSKFLSIFKFKSEEVFPKVLRVIKAQNKNNWVTNGIRQSSKTLRHLSTIKNYNNTIQNFYNTYKKVYRKVLLAAKRYQNDKLIEKANNKIKAAWDVTNRVTNRKKAGQINIQFQLNGTSVNDPKKLANFANKYFSNVATKLQQKFVNNTQHPHTLNNVPHTMFLQPSTAEEVSKVVQNLKSKSSAGIDEIPVCLLKDCTQSISHPLAHIINESFTKGCFPETLKHAKVLPIHKKGDPESIESIENYRPISLLSSFSKVMETIMKNRLMAYLTKYNLLCKEQSGFRSGKSTSSAIAQFTNAVLEALDKGDHVTGIFLDLTKAFDTVDHTILLNKLEALGVRGVANMWFHSYLQNRVQQVEITKTNSNHTIKHLSEPEYINIGVPQGSVLGPILFLIYINDFPQSVKHGKSVLFADDSNILITDNSQIKLNQKAEDTLVHVSRWVENNKLTLNVKKTTASTSTQINPQCKKNNSINFHIKRKPVTNFLKIKDENIECVSTTKFLGMHIDSQLKWTEHITVLGKKIASACYALRIINSVCSSSCTRTAYFANIHSLISYGIIFWGTNEQNRQAIFKLQKRAVRIMTNSSSRAHCTELFKYMGILTVPCEYILQQSSTLEGPLYRIIQIYGNTNCSMRIHFTAVIYIKENINQYPPNSSIHEHETRSSRHLHLNRKNTTKTQNSILYNGIKLYNRLPQDIKNKDKIQDFRNSLKKFLEKCYYTVQDYLN

SEQ ID NO: 3200 - protein, 1834 aa, synthetic construct
  source 1..1834: note = Description of Artificial Sequence: Synthetic polypeptide
  VARIANT 328: note = Any amino acid
  VARIANT 342: note = Any amino acid
  VARIANT 382: note = Any amino acid
  VARIANT 771: note = Any amino acid
  VARIANT 848: note = Any amino acid
MGVPLGGTNTHSKKRARLGSPPDTGLCNMSMLKSNRAHSAVQNVFLVIKRKEGSFEKISPFYIQKGLEGIAGDLKSVKRLRNGTLLVETSSSQQAVNLRNAKCLGEYEIETEMHSTLNYSKGVVSCRDLVDIPNEELKEEWASEGIVDVQNITKRVDGGLVKSESFILTFNSPKLPEYVKAGFLRLKVRPYVPNPMRCFKCQRFGHTTLACKGEATCGKCGKAAHEGAECTPPAKCVNCSGEHPVWSRDCTVYLEEKKVQEIKTTKRISYGEAKKIFKAMQPPSFVTSFAAVVQKPVPKVDVSTQTDVASVGTNTCTCECTCKAAVVXEPELPHAHQKKLLXSTLQSFCHPPRQRPLARPWHLQSQRLFRRSSLTFPLLLSXTTATRTSEKATGVNITELLSPSPAEAIGQALAPSKPEAIPKVITDLSTPAVTNIKVAKPKKAPGKSQEQAKAGNKPSDYIEVIIPDLPSDSAPELMELDVPQGQTSRPKTEPPARSVSPTKRKERVKIQPPRWLPYCSGTAGFRTHVEELRLLTRDRPMCVCLQETCFKETDSPELRGYFLYRKDDLTGVRAKGGVAIFVNATYHSSPVSLTTGLQAVAVSVYLRHRLTICSLYLPPHDALDEDALRDLLTQLPQPFILCGDFNAHNVLWGSANTCPRGRAIERILLSSSAHLLNTGQSTHFCAATGSFSAIDLSLSSPALAHSAQWEVAMTYMAVTTSPSGFICQTQWYPPEPHHDGCFVRQTGPCSANWLNLNNVIASRNGWTILHXSLALFSSPCPLCSMGSGDDLHGSDHFPLWIHLPDTVVPARTPPRWVLRQADWTLFSQLAEFEQRDSVQEWVDHITQXIHRAAEASIPQSTGQLQRHPVPWWTEECRSAIRARRAALRKFKCRPTAENLAAFRLARAKCRKVIRESKKRSWQHFLNSVNRSTPSTKVWETIRRISGRGGRCPVAAVMANGTLHTDPRDIAQTMAEYFATVTSTAQQDPAFQRHRMGAEKGSLDFRSTTAEEYNCPFSMWELDSACLQLVIRALDMTGYITVCYSTLQNGTEKSSSHFLMSFGRQVIFPTHGVKQFEGQFGLQVHYCRRIQLPFLHVGARFCLSAARDTCPGHDRIHYSMLQHLTERNREILLSLFNVVWASGHFPDSWREAVLVPILKPGKDRTSPSSYRSIALTSCVGKTLERMVNRRLVWMLESRQLLSRFQCGFRKYRSTFDNLAFLEAAIQQAFLRRQHLLGIFFDIERAYDTTWRHLILRQLHEWGFRGAFPFLLCPFFLHAILGIESVTCSRIVLSKRTVFLRVAFMGFSWSLPLFIVSFLSPRYFRYRVGDVLSDRFEQENGVPQGSVLSVTLFAIAINSLTSVVKSPVQCSLFVDDFSIFCSSSSLATTTRQLQLTLRRLDDWAKKSGFKFSTEKSVCVLFNRSRSILNLPELRMRDTVLHFKETVRFLGLIFDSKLTWLPHLKDLKKRCLKALSILKCLSHNSWGADRTCLLRFYRAFVRSRLDYGCTVYGSARPSYLKMLDVVHHEGIRLATGAFRTSPIPSLCAEAAEPPLSIRQLLLGRQGYKMLSTPHAPAYHSVARPPMAGCFILGRGQHDPLGFARIVSHRWVYLILMFTSGLEQISSLAPSEAQHYFRLGSFKKGCTPDFTYRLNFSKFIGITILRWSTPMVQAGDSLGCSIVFPTMLPGFASHSLFCLHSRASRDLSIRNAACSEHTVSYLLRFTRTAITDSLYPDEKIHSSYRTNCTPSSGGVSRCHSAGSWHVGIRGNEVADGLQRRPAATTTYTICHSPAGCPLCGSAEVLSAVGRHVAAVTGNKLRSVKPTVRRGNLLPVTDA

SEQ ID NO: 3201 - protein, 975 aa, synthetic construct
  source 1..975: note = Description of Artificial Sequence: Synthetic polypeptide
  VARIANT 445: note = Any amino acid
  VARIANT 478: note = Any amino acid
  VARIANT 479: note = Any amino acid
MLTIISVNIEGLSSSKENLLHEMCQSNKCDVLCLQETHRDNNHRRPNIPGMKLVAERPHAQYGSAVFTKPDLQVKSTCHTEENNIETITVELKDYTVTSVYKPPSEIFAFTPPANFVKEKISFVIGDFNSHSHVWGYASEDKSGEAVLAWAESSQLSLIHDNKLPPSFYSRRWHRGYNPDLLFVSENIAIQSCKSVCPPIPNTQHRPIMCQLFPAIRPQNVPFRRRYNFKKANWDRFSGLLDEKIQTINPAPEEYDLFVDTIRTCSKASIPRGYRSNYVKGLDSEAATNLDRYYTLFERDPFGEETLAQANLVTSSISEAKKKEWVKQMEELDMGRSSNKAWRLLKRLATDQLNLKHANVKSNQIAHQLLKNGKPVRRNRNVQNSRQIERDISQETSEISKPFSMTELDKAISKSRNGKAAGLDDICVEQIKNFGPAAKKWLLAXMNNCMSACKIPKIWRKTRVIAIPSETWEEPDDXXSYRPISLLCHLYKTLERMILNRLTEVVEPLLIPEQAGFRTSKSCTAQILKLVQHIEDGFEERKITGAVFIDLTAAYDTVNHRLLLQKFYTSCKDYGMTQMIGNLLQNRRFFVDFQGQRSRWRTQKNGLPQGSVLAPLLFNIYTNDQPLPEGTQSFIYADDRAITAQGNTFETVESKLSEALEQLAIYYKENQLTPNPRKTQTCAFHLRNRQATKKLNVSWDGIPLVHCATPKYLGVTLDRTLTYRDHCMNTKQKVAARNNIVRKLAGTTWGAEPSTLRTTTLALCYSAAEYACPVWYNSSHAKQVDIPLNESCRIITGCLKPTPTDKLHCLAGIAPPSIRRKVAASKEKLKSVTSAAHPLFGQQPARRRLISRRSFLHTTECLTDTPQNTRTEMWRNKNVHLHDWLVPTEELPPGHGEKRNVWRSLNRLRSGVARTKSNMHRWGLSDESVLCDCGQEQTTSHLMQCELCPSTCTVEELMKATPNALDVASFWSKIS

SEQ ID NO: 3202 - protein, 919 aa, synthetic construct
  source 1..919: note = Description of Artificial Sequence: Synthetic polypeptide
  VARIANT 389: note = Any amino acid
MRLVNEIAHEKHGSAIFVRQGLQVSGSRTIQHNNIELIGVELDNTEIISIYKPPAQTFNLNIPLLSHTRDNMHTVVLGDFNCHSTQWGYSETNEDGHLLEQWAENNQMCLIHDPKQPPSFNSGRWRKGYNPDLIFVSKDLSALSYKQVLNAIPRSQHRPIKLEIRPVVQPVEIPFRRRFNFKRAKWEDFGNKLDESLKLIEPKPEHYDKFVQAIKDASFKTIPRGCRTEYIPGFTDKNKDAYERYCDLYDKSPLAEETIECGEELLEALSDQRRQTWMKTVVGMDMTHSSRKAWRLIKKLSNDPTIRTPHVNITPNQIASQLLLNGKVNGKNNAARSSLKVKKSKESNVSDVDFSVEELEEAISSLKVGKAAGLDDIRNEIIKNLSENXKKWLLKFFNCIWRTAKIPRIWRHAKVIAVLKPGKDPNDPKSYRPISLLCSLLKLFERLIMNRIGDYIDSCLIDEQAGFRPGKSCTAQALNLTQFIEDGFERGLPTGVVFIDLTAAYDTVNLRTLISKVHRMTNSDRLAEVLRALLFNRRFFVDFQQKRSRWRNQKNGLPQGSVLSPLLFNIYTNDQPIGKKTKSFIYADDRAIACQAKTSNEIEAILTEDLTTLTEYYRRNHLKPNPSKTQVCLFHLNNREAGKVLDIIWNDVRLNNCSHPTYLGITLDRTLTYKKHIEKTKAKVQTRNGILNKLTSAKWGANAKVLRSTALATCFSVAEYGCPVWERSHHTKKLDVVLNNTCRKITGCLKPTRVDYLYSLSGIAPPNIRRSFLSSIERNKQTNDHRHLLYKNQPVPKRLQSRRSFMYSVEPTVASIKSLWQEQYPEALITEEALPQGSHLDWQHWKTLNRLRVGVGRSKQLMKRWGYTDSDECECGAIQTMEHLLKCPLVDASRECTQEDLLKYTGTAAAYTDFWTSKI

SEQ ID NO: 3203 - protein, 1191 aa, synthetic construct
  source 1..1191: note = Description of Artificial Sequence: Synthetic polypeptide
MEPLREMAAKEGKKANVHSVCIPGGVIPDVERVLPDAMKGTGCSQLQVVAHVGTNDVCRFGSEEILSGFERLSEVVKTASLACKMKAELTICSIVDRTDCGPLVQSRVEGLNQRLRRFCDRVGCRFLDLRHRVVGFQVPLNRSGVHYTQEAATRVAGAVWRGLGGFFFFRELCGVDWAVFFFFRLEGLGNTQKGFQSQRVQVKDRTNTDLKTIGLTVVNCRSCVGKVPELQALIESTESQIIIGTESWLKPEISSAEIFTKGQMVFRKDRLNKIGGGVFIAVTGGLSCSEIEVDCSCELVWVEVIPDNQNKLIIGSFYRPPDSDDSIAEMFKESLDQISKTYPKHTILIGGDFNLPSICWQKYMFKTGGKHKTSSEIVLNAFSENYLEQLVHEPTRIVNGCENILDLLATNNPELIKSIKTDTGISEHRVVVARLNIGLSKSTKIKRKYIYSKKQIKIRLTLSKKIYLFKKADKNSINAFLSENLQSFETNNVSVDQMWLTFKEIISTTIDRFIPNKLTKRGLTRRGTQNRLDHCYKSKEKSMPNLNAQKIPKTGNLLQKLEIQIHTKQINKEGADPPWYTKQVRSLLQKQRKKHAKFKRTKNPQDWQSFTETRNLARTSMREAYNSYHNETLSRNLVENPKKFWSYVKYTSGKTQSIPSLHDRNGDATDDSSAKAELLNTAFRNSFTREDEANTPEFVSRTAASMRNLEVDTPGVLKQLKSLNKSKSPSPDCIPIRFLSEYADAIAPYLTIIYNRSLSERSVPKDWKVAQVTPIFKKGNRSDPQNYRPISLTSVCSRILEHILSSNIMNYLEENDLLSHSQHGFRKYRSCETQLALYSHDVMSAIDKGCQIDSVFLDFRKAFDTVPHKRLLIKLRAYGISPQLCDWIRDFLSERTQYVVIDGKSSSRTEVISGVPQGSVIGPLLFLIFINDLGDNLSSSLRLFADDAVIYRLVKSPEDQKQLQNDLDKISAWCKNWQLTLNNDKCEVIHMTTKRNPLNFSYTINQSNLQAVNSTKYLGVTITNNLNWKEHIENIVGKANQRLRFIGRTLRRCNSSTKETAYTTLVRPILEYCCALWDPHQVGLTDDLEKIQRRAARFVLSRYRGESVTEMMHELGWKSLKERRYLLRRDLFAKFLSPTFSSECEHILLAPTYIGRHDHHNKIREIRSKTERFRCSFFPRAIREWNYREIS

SEQ ID NO: 3204 - protein, 478 aa, synthetic construct
  source 1..478: note = Description of Artificial Sequence: Synthetic polypeptide
NKCSDSTNCESDKQPSNLIEKKLNKIICENYTYSRQYTVKSSTDLIAKIQDIKIPDNSRFLSLDVTNLYTNVPIDETIAIIKENLLKYRKIPKQSLNNSTITIILSHNYFSFNGHVYTQNDGLAMGSCLSGTLANIFLDHLENKFFEEQNQWKTKVVYYFRYIDDTIILFNGCIEEIEDFHQRFNNMHKKITFTIEHEINNSINFLDLTISKTNSVHTFNIFRKPTTTDIIIHNSSCHPQSHKEAYFRSAIDRITKYPLCNKNINSELNTLKDIAISNGYNPELVNNLYKSKLNSKQKSIKDEITLTKTETRKKDKFVILPYWGQISDRIKYALKKTNLKIGFYTNNTLGTNIIHKIEKIDRYSQSGVYKIECSKCDKAYIGQTGRPFKIRFREHINTSENNVSAFGTHLRESKHSTGSIEENLKILHIVCKGQLMDVLEELQIYTHMTKYPEQMLNEQTEMRNKKFIENFHNTLASI

SEQ ID NO: 3205 - protein, 751 aa, synthetic construct
  source 1..751: note = Description of Artificial Sequence: Synthetic polypeptide
GKQNCKLLSVHITISNGVCSSDWDRIDRLLHDTINKRVLTTSSRQRKKFDSLRPQPTISQLDSSRTVINLSGHLLSDDERSVLARGGNFAVSPRVVPTEEIIANIEAGIRNLDKVTAEEIRIEAVRVLARAKPPKSNLTTGEKNAIKSLNEDDSIIILPADKGNCTVVLNVTDYHCKIKELLDPQTYRKLSKDPTDKVLRTVTQLIKKSSIEQCVQKSLFNSVALPPRLYGLPKVHKEKENVPPLRPIVSAIASPTYLIAKFLTTLLRPHVGRSDSYIKNSRHFISKLNDILVNPEDILVSFDVVSLFTMVPVNEVLQQLNLLFPPDIADLFKYCLTTTYFKWNDDFYEQTDGVAMGSPLSPVIANFYMEKFEEQALKTANKKPAIWFRYVDDTFVVWRHGREELDRFLQHLNGINSRIQFTMEKEADGKLNFLDVSVFKKGNGRLGHTVYRKPTHTDRYLHRDSNHHPQQKRGIIKTLADRARNICEPELLDAELKHLSNALLKNGYSSTEIRRALRPTRRVENDERVPVKSKVFLPFIKDVTDRIGKILTKRNVAVIYKPTRKIQDHLKSAKDARKPLEKAGIYRIPCSCGDVYVGTTKRTVKKRLDEHKGNCRRGEIDRSAVAEHVFQPGDHLIQFDKTQVLAATNGYHERLYREAIEIVKHPNNFNRMEEGVKLNEIWIPVLKKKCNSLPPWDDINGRRQSATTNCARMSKTSDVTPLRASPRKRSLASVSSEPGCASDIQKCHDPP

SEQ ID NO: 3206 - protein, 1007 aa, synthetic construct
  source 1..1007: note = Description of Artificial Sequence: Synthetic polypeptide
  VARIANT 65: note = Any amino acid
  VARIANT 911: note = Any amino acid
  VARIANT 991: note = Ile or Leu
MSATTTIPNGSCQGQQNCQQNDLNRAIGPVLNVCHLNIEGISRSKCDFLSKNLLSNNTDVLALQXTHAEDLKNCARGNIHGYRLVGEIGHRTYGVATYARQDLDDVSIIHESCDDDIFVLAVKVSGTTIVNVYKPPNIQWQDTVLPVFEHPSLYVGDFNSHSSHWGYSSDNENGIALAEWAENNNLSLVFDAKDSSTFFSARWKRGYSPDLCFCSCDQTLRSLSVTRKVLGTFPRSQHRPVLISVGIKIPLIRSFPRPRWNFNKADWEAFTSKLEDNIRFIPPTTENYDRFAGLLKATAKACIPRGYRKTYIPGWSQECEDLYNEFISTEDSNTADLLLNSLDNARREKWVKKVQSLDFTHSSRKAWSLLRKLSTSVSEKKLPPTHPDPSDIAKRIVALSKSKRQQSDRLISYKLNEVKKCQQAPLEVSKPFCLDELHVAISDVKTGKAAGIDDIFPEFIKHAGLKTRLWLLNLFNNILKDSSLPKAFKRSKVIAVLKPGKPADRADSYRPIALLSVCYKLLERLIYNRIVPILTASIPVEQAGFKQGRNCCDQVLALTSFIETGFEKKCTTSVAFLDLSAAYDTVWKKGLLVKLYNLIPCPILLRLLNSMLSGRLIKIYLGNTESGFRQLHDGLPQGSVLAPILFNVYTADIPATQSRKFIYADDIAIASQHRDIHVTETTLTSDLTLLRNYFAMWKLKPNPNKTEVACFHLNNRMADYKLNISFDGVQLEHSEHPKYLGVILDRSLTFKYHLHKTADKVKTRNNILQHLAGSSWGASAKVLRTTALSLVYSAAEYCSPVWLNSAHVRDIDVQLNRAMRLISGTLMATPLQWLPILCNIVPPDLRRKEALMREYYKILSTPELPILQDLPPQVSRLKSRKPPLKTAVQLHESGFSPKSNWARTWDSFNGXNSIWIDDPSKELQGMDLPRREWSLTNRFRTGVGRCNYWKFKWGQADDQSCDCGADIQTMTHILTNCPLRSFSGGMTELHXVSQEAVQWLKELDLAL

SEQ ID NO: 3207 - protein, 1030 aa, synthetic construct
  source 1..1030: note = Description of Artificial Sequence: Synthetic polypeptide
  VARIANT 176: note = Any amino acid
  VARIANT 857: note = Any amino acid
KEQKISKGAQWCPSAINRPIQDQDRSSGTRSKKSNATPHPARPQQKGERKTSKPQILEPSADLVVFHQNVQSLTNKIDEFQIMLENELKKVSVLCLTEHWLQDDTLNMVHFPNFILGSHFCRKKRYASPQHRKQSFVVADLHKSIHLHPSFPEAFQRKIPWKYQDLSYCMKTYLNXECVLHKLSKKNRHIIICGDFNIDFSVGLETKPKTDILNLLLTFNMTPTIQTPTCVTKTSATTIDQIFASVPMEYKARTLCTGFGDHTAQEITIKMDLPLHCKTSLLTITRSFNLQNTNTFTQYLTNESWEEVYSCRDTNEKFEKFLSIFQHYFELCFPLKKRKIKKSNIKSSWITPGILTSLREKRVLHTISKQTKTTPEFDTYFKRYKQILNKVIKKSKKLTNFSYIEKPQIKCNVDYCERNRQNTGHTHSNINLLENGEEITDPHRVADLFNVYFTEIASNLIDKQQKPASENKNQQKLFIRKNNFPIPNRRKGSTEYYKRIKTKIFIRHKCATVVTKPLTHLCNSSLSNGVFPEKLKLAKVKPLFKKGDKRNEKNYRPISLLPGFSKILEKVFYRRLISFIEENNFLSNTQHGFRKQKSTETAIFDFVNEALSTIDQKEHVSALFLDLTKAFDMIDHNLLLKKLEYVGIRGLAHKWVTSYLKNRAQIVEIAHQEGSNIYTYQSERKDIKYGVPQGSILGPVLFLIFINDLETSSSSQKYIKFADDTNILIKGKTAAELQHEIQNCTSHIEEWFTTNNLVINIEKTVTMHLHTIQNKHPLTPTIKLFNKKLETVNSTKFLGISIQDDMKWDTHIKYISKKLNTICYGVRILARCTTKETLKNVYYAQAESLLRYGLIFXGNSPESRYCFVAQKRIIRSIENATPRKSCKPLFKALQILPLPCLYILEIVTYIKKISVAQNNLVYTNKSVHTHDTRQTLDLHSEHLRTTLRQNGPLQMGEKIVQQTSSPYQNNQRTPEVQIGCKKLFTRKIIYKINVITLSVNICQLNLMSCFLTYNYCNYCHLLYDVDCIII

SEQ ID NO: 3208 - protein, 1726 aa, synthetic construct
  source 1..1726: note = Description of Artificial Sequence: Synthetic polypeptide
MGDNFAMTSSSSSSTLPFTQKRKLDESKSKKVLPNLPKFLVVSRTDGHDFSSVNPFVIQRGVDAIAGPVKTCSRQRNGTLLLETEGAFQVQKLLRTTLLHTFPVKVEPHRTLNSSRGVVFSRSLDGLSDEELQEYLSDQGVTAVHRVMKRVNNNLTPTQTNCVLDLHRPKQTVFLTFDKVDLPSKIKAGYEIISVRPYVPNPTRCYQCQRFNHTRQSCPNAAKCVTCGRDAHEGDCPPPSPRCINCMGDHAANSRECPVYKDERAIQEIRVKEKVSTSAARKLLASRKPAVLPAGTYSNVLSSPRPTKETGTQTCDFTFSDTVVRSASPKIARSTSPMPSAHSKSQSTSVSQKSRATKSEARTSKKDPVREDFLKTSSSQPSAAHSSNRTASKKAHKKRSSSPSPPRRDSSVTPSSSRRPRPSSVSPGRSTACRSAGISPAEEAAPSDQSRKEAEQMSEPMEHDCPSVDCSSSAASQPGPQRPSRSPLAFSLFFFSAFFMALLQWNIRGIRSNRDELRLLLRLHCPLIVGLQETKLRPTDHINFPQYTAVRFDLPPVEGIPAHGGAMLLIREDVYYHPIPLQTPLQAVAVRVTISTFTFSLCNIYTPSSSAVLRADLLHLVAQLPTPFLLIGDFNAHHPLWGSPASCQRGSLLADLFNHLNLVCLNTGEPTFLSDTTHTYSHLDLAICTTPLAHRFEWYVLSDRYSSDHFPCIISLLHHTTSPCSTSWNISKADWGLYSSMAVFHDQNFPSCDSQVNYLTDVILTAAEHSIPRTSTSPHRVPVPWWNAACSDAIRARRRALRLFQRRPTLENCINYKRLRAKCRRVIKESKKACWTAFTSSFNRSTPSSVVWGNLRRLSGTKVHSPIPGLNIANQVLVEPVDICNALGRSFAEVSSSANYDPAFLPRKQAEEARTPSFTSPNRESYNATFTMQELERALALSRSSAPGPDAIHIQMLKNLSPAGKCFLLRTYNRVWTEGEVPTRWREAIVVPIPKPGKDKHLPSSYRPISLTSCVCKVMERMVNARLVWILESRHLLTNVQCGFRRHRSSIDHLVTLSTFVMNNFLRKRQTVAVFFDLEKAYDTCWRAGILRTMHTWGLRGRLPLFICAFLKDRMFRVRVGSVLSDTFRQENGVPQGSVLSVALFAIAINPIMDCLPADVSGSLFVDDFTIYCSAQRTCLLERRLQHCLDSLYSWSVANGFRFSHEKTVCINFWRYREFLPPSLHLGPVALPFVETTTFLGLTLDRKLSWSPHVSSLAARCTRSLNVLRVLSGTSWGADRTVLLHLYWSTVRSKLDYGSFVYSSARPSILRRLNSIHHRGLRLAIGAFYTSPVDSLYAEAAELPLTYRRDILLCRYACRLLSMPHHPSYPSFFNDSLDSHYGLSAIALLPPGVRFRRLLRQLDFTLPSTFQIGESPVPPWLQAQVRVHLELTSLPKESTSDAVYRSRFLELRAWLENSVFIYTDGSKTNEGVGCAFVIGDDGFQYRLNDHCSNFTAELFALYQAVLYIRRHRSPSYVICSDSLSAIQSLRDPFSAHPVVHRINRSLQLLAADGPRVHLLWVPGHAGVPGNEAADAAAKAATLLPRTATYCVPSNDIRGALSRRLISSWHNVWSSLTNNKLRTIKPLPVAWRTTSRRSRREEVILARLRIGHCRFSHRHLLTGDPAPLCSCGHPLTVRHVLLSCPNFTPVRIALNLPDTLEEILADDARAAARVLNFINLTNLSKDI

SEQ ID NO: 3209 - protein, 1052 aa, synthetic construct
  source 1..1052: note = Description of Artificial Sequence: Synthetic polypeptide
KTTYIVTTAEHRRAKDQEDLLCVRIFYGFSTRRKAVTNQPGDSSNTQVGAKSSVTVQESQCSFRIIHQNFGSLGNKHNDLDVLAFVNKPDVLVITEHWYPKDKISVMHPLMMNLCSSYSRMNKSGGGVAIFAKSGSNFIVSFYCVIDVSSLSVEGVIELSAINYRWERQHIIIVGVYRPPSANIDIFLTNLNQLLVEIDNKYSGKNGCINIIITGDINIDTLSNNSTTKRLQLLLQEFNLNLLIKEPTREVGGTRTCLDNIITNMDKFTYKTAVLKLAISDHHAVEFQCVPNINLHLVKHKPPPGKMKRYETKRTINDKNIRNLTHVLQSATWAETNCYSYENFASDFFYYFDMTCPTKSVIVNNNEKCRKVPGRKMQKSTWIDAEVTQARNMLTLFQCKMLENRENTKLKEAFNKYHEYYKNLIGDKRSKHVAHILNNGNNTAACIWNVINSFRAGKDNVINDLVISYNGSVIECQQDIANIFNEYFSSVGKSINDRLHNNKYAFKGKASSYSIYFTPTNSNEIRNIVKTLRNSKSAGYDGLNINIVKSCIDSISGPLSTAINNILTSGSFPDSLKIAQVTPIFKKGDRLKIENYRPISILPVLSKIIEKVIYNRIVTFLNKHNIIFENQNGFIKNKSTVTAAAQYIQLLHSIFDEVITAIENKEYVTGIFLDLEKAFDCVNIPILLDKLWNIGVRGIAHDLIKSYLTNRKQFVVIRTSSGTYRSTVTDMKYGVPQGSVMGPLLFLIYVNDIKYCTQNSKVILYADDTSIVCKHKELDQLEILSNCLTNEIVQYFNESHLSVSTAKTAVMDFNPSRQTDFEIQLCIGKDIASKENCVKFLGITIQDTLKWDVHVDTLASKLAKNIFAINMLSKHCNDTQVLRTAYHALMSSNISYGIEVWGATTQANLNKILKLQKKAVRIICGAKPKDSCRSLFPKAGILTVVNMYIYKSIMLIRKLNLNLNSDTHNYNTRNKDKFHLLSHRTALYERNPLYAGQRLANTIPSCITSLPTEKFKVTLKRILITNPHYSLDEYFCFAQNKENFIPDSLTSV

SEQ ID NO: 3210 - protein, 1085 aa, synthetic construct
  source 1..1085: note = Description of Artificial Sequence: Synthetic polypeptide
  VARIANT 615: note = Any amino acid
  VARIANT 649: note = Ile or Leu
  VARIANT 698: note = Any amino acid
  VARIANT 717: note = Any amino acid
  VARIANT 731: note = Any amino acid
  VARIANT 760: note = Any amino acid
  VARIANT 780: note = Any amino acid
MPPLRQMQRLTRDQNQQMRNPRNHTARRQRNGGENSTTQPLTRSERTQEQRDRTHQAREEDVATAALSSSSTVPATPRENAPRFEDMVTLLQKLRDLIKEIPRQITAAVTAAIQAISTGPVMARSQQGLTIAAWNANGIRTQEGEFRQFLREEAVDVCLVNETFLKPGVHVRAANYVCYRTDRTTHGGGTAVYVRASLAHHRVQLPPLQAIQESHSGSGRHIHRQDHIRRSLQTTKDCGTTCRRRNFTVTPGKVFAAGDFNAKHHIWNSRVINNHGWHILREAQHNDAMAIGPNDPTHFPENGGQPDVIMLRSDPFPREWGTAGCYYVALIKGVPYVISASTRNVLSSDHVPVVLDVDVDAGPAKRRGLPTNSTNWDRYREHLGNSLQDAPMVEDAGVEDNVRTFTKNAIQAVKRATPRLQRDPPDRSRQLPPDILAMITAKNRMFREWQLTRNPATKRAVNRMQREIKAAVKAHRHQEWSNKLATLRVDDGTGWKATQMFLRRRLKIPPLQVGPTIVSAPEDKANAIADVFEANFTPVQDPIDPEHVRLVQERLPTFLNAQKSVQKRCPGFYAASINEKLEAPTSSLTKCFDRCRQKPQRTLQQRHCIMRTGHXPQAWKHAEVVPVPKPGKDHRLPSNYRPISLLPAXSKVFERVYLKRLMDHIRRENILPDEQCGFRPGHATTHQLLRLVEEALDXTERREYFGAVFLDVSRAFXSVWHDGLLFKLLDXRPAPAARPINSVVSPRQDVPGAHWKRPSXRPNVGNTSGQYSLTFRERSXPSGMTVYSSSCWTSGLPLPHVRLIRSYLQDRTFQVRTEELSTRRPIRAGVPQGSVLGPILYILYTADMPRIDRVHLALYADDTALFSRSMNARTLGTRLQRASDELSRWATKWRLSFNGAKTQALIIARKRVPVDLPRLSVRGTAVPWGRTAKYLGVTLDRRLTWQQHVDDVIGRARGRLRDLYPFLNPTSTLPPQLGVAIYTTLIRPIFEYAAVVWGNAAQTHIKRLQGLQNRILRLALHLPRDFPTEDLLRVTEIPPIQARFRQAAKLFYQKAARSPNALIRALGHRVQRLNATRWPHLLRSD

SEQ ID NO: 3211 - protein, 1025 aa, synthetic construct
  source 1..1025: note = Description of Artificial Sequence: Synthetic polypeptide
  VARIANT 5: note = Any amino acid
  VARIANT 941: note = Any amino acid
GLHQXNVDILALQETHIEEPLNNARGNIPGYRLVAAIGHRAYGVSTYVRQGLDDVTVKHNSSNDDTFILAVKVSEITIVNVYKPPNTQWTDTVLPVFEHPALYVGDFNSHHSQWGYPADDENGRRLTSWAENNNFSLIFDAKDNSTFYSARWRRGYSPDLCFCSCERSSKPMTARRRVLGAFPHSQHRPVIISVGTQIPIIRSFPRPRWNFSKADWETFTSKVEQSIRFIPPIITTTVSRIFSWLLLNSVSPGASGKNTCQDGVENATIFTRSFKTPKALTQPTICCSLLTLPGKRSGQSRLGDLYFKGRAEHQVYPSHNNYDRFANLLLAIAKQCIPRGFRKEYVPGWSRECDDLYKEFQDTESPDTADHLLQSLDTARKEKWIKTVENLNFTHSSQRAWSLLKKLSSGKPADNCTVTHPNPCDIAKRIVSSSKSARLPSDKRVAYKLNKILRSQFTPLEVSRPFTEEELEAAITTLQTGKAAGLDKIFPEFLKHIGPKTKFWLLTVYNAILATGNLPKAFKRSKIVAILKPGKSPEQAESYRPIALLSVCYKLLERLIYNRISQILDASIPVEQAGFRPGRNCCDQVLSLTSFIEKGYEMKKKTSAAFIDLSGAYDTVWRKGLLLKFYNIIPCPLLLRFLNSTLSNRLIKVYLGHKESAFRQLNDGLPQGSVLAPLLFNVYIADIPATQSKKFIYADDIALATQHTDLPTTEATLTNDLATLQEYFRTWKLKPNPNKTEVSCFHLNNKLANQKLNIYLDGVKLTHNNHPKYLGVILDRSLTFKSHLQKTAAKVKTRTNILQQIAGSSWGANAQVLRTTALSLVYSSAEYCAPVWLNSAHVREVDVQLNRAMRIISGTLLATPLPWLPVLCHIPPPEIRRQEALIREYKKILSTPQLPITQYLPQNLSRLKSRKPPLRLASQLIAEDFSPNTTWAASWDXFEGRNKHLIPSPSTKVGGMNLPRREWTLLNRFRTGVGRCNYWKCKWGMTLDQSCDCGADTQTMDHIAIDCPCVLSLRGWLVFTI

SEQ ID NO: 3212 - protein, 841 aa, synthetic construct
  source 1..841: note = Description of Artificial Sequence: Synthetic polypeptide
MTTPAVKAFIYDQTPLRRGYVNIGSAVREHAKKSQQLCSLTFLLRCRDTSTVPKFLKVKRTFRSAQAHRIYSRMESAMLRERIHQTRRALAETNSKLFQLHLLISNTMQCDDWNKIDNLTFRTMEASAEIAGNRQKRKFDSLQKNVLVGTMEDNSRTVINLSDKVLTADEVLVLAKGGNFAVTPRKVPTEDIVANIEAGIRQLSQQSADVIRMETARILRTCKPPTSNLSQAQRKALRDINADENIIVLSADKGNATVVMKSEDYHEKIMDILDPSNYKQLRKDPTSKILKMTNQLVKASSFSSDDKKHLCKTEAYSPRLYGLPKVHKQLVPLRPIVSAIGSPTHEVAGHLASLLQPYVGGTDSHIKNSCHFIDIIKELSVDPDDILVSFDVVSLFTMIPVNEAITCIADIFPSDIVALFKHCLTTTYFQYKNVFYEQIDGVAMGSPLSPAVANLFMENFEQRALQTARKRPAKWYRYVDDTFVIWTHGEEELDAFLLHLNSINPRIQFTMEKETNGQLNFLDVTVIKREDGSLGHKVYRKDTHTDRYLQKDSNHHPRQKKRRDRLSNERTDHWVIRSIGKTHTLIVIFKKILTTTHDKKRGVIKTLVDRAHKICEPAHLDDEIEHLRVTFKKNGYSDREIDRALRPRRTTRTDEERQQPKGKVFLPFINKVTDRIGKILSKYDVETVFRPTTKIKEFLRSAKDKRHPLATPGVYKIPCSCGKVYIGTTKRSVNTRLGEHKRNCRLGHTDKSAVAEHVYQEGDHEIKFNETSVIAKTSHYYARLYREAIEIFKHRNNFNKKEEGLKLDKIWMSTLQQQHDNRLISIEEVGNSRDHSTADTT

SEQ ID NO: 3213 - protein, 850 aa, synthetic construct
  source 1..850: note = Description of Artificial Sequence: Synthetic polypeptide
MLVILSHSHVWGYQEEDRNGAILNEWMDMYNLQLVHNAKDPGTFRSGRWQKDYSPDLCIISKSGNNNTTQRKVIKSFPHSQHRPVIIQFGTEIPLVKSVPLPRWNFQLANWEQFRKSLDNSIQWIPPLPSNYERFLGAIKVNAKRYIPRGFRKEYIPGWSEECDELYAEYQDSHSDSTADDLLRALNKNRREKWHKTTAGLNFTHSSRKAWSLMRKLGTDPRLSNRVAHVNANSVAARLMNISKSKVEKAYTRTVKKELHIKRSQLEPHSDYSREFSIEEVETALKMVKVNKAPGFDGVYPEFLKAAGPKTKLWLTDFFNAILRTGKLPKLFKQAKIIAILKPGKDGTDASHYRPVSLLSMTYKLLERLILNRIQETIDQIIPAEQGGFRKHRSCCDQVLTLTTLVETGFQRGLKSAAVFVDLTAAYGTVWREGLMLKLIQIIPCQKLAFLVNNMLSDRRFKVFLNGQSSRWRTLNNGLPQGSVLAPILFNLYIHDMPDTNSTKIQYADDLALVFQSNDLKHCEQVLTSDLIKLSDYFHKWRLQPNPNKTEVTAFHLNNKEAQRKLHVTFDGIEVPHNYNPVYLGITLDRSLTFKEQCLKLSKKLASRVNLLRKIAGSNWGADANTLRSAALALVYSAGEYCAPVWENSAHTTKIDVQLNEAMRIITGTVRSTPIQWLPVLANIAPQDLRRKAAKVKLIKNVKAHKNSPLYDALQDPPACRLKSRKPPWCDTESTTSFDVTSKWQERWNENPPHNGHLVQDPSKKVEGFHLPRQTWSRLNRIRTGQGRCAYNMKKWGFLPSSDCDCGAEEQTVGHIVKQCPLRAFNGDLESLHQVTESALDWLSNLDISI

SEQ ID NO: 3214 - protein, 886 aa, synthetic construct
  source 1..886: note = Description of Artificial Sequence: Synthetic polypeptide
MFYSCDDNRHEFGTGFLVHKYLKHLVMNFTPINPRLSVIRIKGRFFNYSIINGHAPTEESIEDLKDDFYDALEKAYDKCPRNDIKIVLGDFNAQLGREDMFQPVIGAHSKHGSTNDNGIRLILFAASRNMIVGSTSFPHKEIHKGTWKSPDGRTINQIDHVLIDQRHKSNLLDVRTFRGPNVDSDHFLVMAKIRARISNAQKERNHRTKMAAIKRAIDISAKETLGIERESIRPTWFDEECKRVTEEKNTAYQKTLQANCTRSLLEDYREKRRIEKMTHRRKKREWTKAEIECMELSKKKMKQGILKTICSITSLIRDEEGNIISEVNRLWKDGEDTLMTCESRDEQAEDISNDCEQGLDDEQPLDGPGLEIKKAKSLRKLKNNKAPGTDSIPAELLKYGGATLEQSLFELITLIWEQERIPNEWNEGILCPIHKKGDRMECRNHRGITLLNLGYKVLSNIIFDRLLPQVDKEIGMYQSGFRRGRSTIDQIFNLRQILEKTVEYRIGTHHLFIDFKAAYDSINRNQLFHALQEMGIHGKLLRMVKMIVVQGNYSDPLEIKNGLRQGDALACLLFNVALEKVIREAGLQTRGTIFYKSVQILAYADDIDIIARTVPALKEAFTALSQASKKMGLMINEDKTKYMACGKAYQPNMPSTFSVNGYTFERVDTFKYLGSTVTCFNDTSTEIKIRLISANKAYFALSNLFQSRLLSRPTKFTIYKTLVRPVLTYASETWPLTETDARLLDGFERKVLRRIIGPVYDGEQWRKGTMQNCTLYMPMLLWRTMEERYNAELYTIYADAPVTNIIRSGRIRWAGHVARMEESEVTKKILFGNPGGQRGRGRPRARWLDGVEEDLRKLGCRNWRRVAYDRDGWRKLVGKAKVHPGL

SEQ ID NO: 3215 - protein, 986 aa, synthetic construct
  source 1..986: note = Description of Artificial Sequence: Synthetic polypeptide
MKTNKTPPKRSFPRPLVTISINIEGISRDKEVLLSDLCKEYQCDFLLIQETHRGITRPSPKIDGMKMILERPHEQYGSAIFARPGINVTSASLTDRDDVEILTVRTQQYSVTSVYKPPDSTFVFTEPANFSYQDINFILGDFNCQSTAWGYKETNSSGAELEKWAEVHDLLLIHDPKLPSSFNSGRWKKGYNPDNIFVSKKLAAQSEKLIGEPIPHTQHRPIICTVSAVVKPEQVPFKRRFNFKKANWKKFREIIDLEVTKILHNLRCMTLLSVFRMCLGRQYARMQNTVYRWTSEDAKPLLERYQSSSTGNELMSVIAENRKAKWRDLVENLDMKVNSRGLGNCRTSTVMPQSQTINLLMSLQTSRHHTLLNGKPRQKIPQPLTRVLAEKPHLKAPFTMSELTAAISSLKTNRAPGIDELRVSKLKTLAVIPYSGCTESQQIKNLGSNTLQWLLDLMNACVERLHIPKMWRKARVVALLKPGKDPNDPKNFRPVSLLCHCFKILERLTLSRIENVLEQQIIPQQAGFRQGKSCCGQVLNLTQHIEDGFERKEITGVAFIDLTAAYDTVNHRRLLRKVYDVTKDYHLTSLIATFLQNRRFFVCLQGKKSRWRNQRNGLPQGSVLAPALYNIYTNDQPVPNTTRQFMYADDTAVAAQGTNFLDVEEKLSSTLESLSQYYEANHLRPNPSKTQVCAFHLKNAEANRELNVTWRGERLAHCPTPKYLGVTLDRTLTYKHHCNATREKVSARNNIIRKLTNGSWGANPKVLRTSALALSVSAAEYAAPVWSSSTHARKVDIAVNEMARIVTGCLKPTPVHKMYLIMGIAPPNIRRDIAAEAEKTKQEKDMRHPLYGHQPADRRLRSRKSFLSRTRALEGSAAENRIARWEMDLRSPHKAAKEELAPGGDLPYTVWRTLNRMRVEVPKCKTNMQRWGFLKDNENTLCLCGAVQDPQHLLICPYLEKPCTMEDLWEANDKAISAANFWKLEV

SEQ ID NO: 3216 - protein, 1360 aa, synthetic construct
  source 1..1360: note = Description of Artificial Sequence: Synthetic polypeptide
  VARIANT 96: note = Any amino acid
  VARIANT 767: note = Any amino acid
MESKIDVFGDSHAKGISQELQVISKSSTVTGMVKPGAGFKEVTKNIVKYKYGKQDSVVICAGAKDIYENNAMKMYKQLLSLILVLSNTNIILVNFXLRHDLPEWSCVNKEIHRINEKLKSCCRLFSNVKLIDSSTLHRECFTKHGLHLNNNGKARLGNLIRDAIKCNSKWTVTELGWYKCPTAETPAQTATAPRSTIQKTVATPTEQPTTEPKLTATSEPTSEVTVKTSKFNQPESSAFTTTVAEQTSVAVAPKQITSQPESLAYTATTAVAVVVAAVVTPEEGSHLQQSSHQKKAATFEKPGFLLGPGSEQQQIIGKHLNDCNQKNLQQGQLVQEADSNQGRESGNINRTAVSKNSNLKIMHQNIQYASKKSEELEVLLAAEVPNIFIMTEHGLKDSELKVFNLEGYKNVAYYCRNEHKSGGVAIFVDSKVGTTPLDISQIAQISTLKQQQYKSSWGGKCLIIGIYRSPSSSIENFLLELEVLLQKVMKKYTFVILAGDLNIDMLRDNDCTRRFQDILGSYNLQLHVKSPTRCTETSSTLIDHILTNIPTERQKVQVINTVIADHSGQTIELKDYAKAEDKKMIKYRQTNIANLNSLEILVKAEEWDDVYNEHSVEKSWESFCDILRHHINVACPVICKTVSAKQNKKWITKEIKKAREELIKLYEDYQKDKEQASQEAYRSKKKLYTRMIREAKASQYKHEIKTSTNISKTVWNLINDNRKESQTSKDTNIILEMEGVKVTDPLQVANSLNQHYVAIVEKLLNQXTPVTKSIKSPKWVAESLYLLPTNELEVSKIIGALKNKNTEGLDGISAKIVKHCAKYLATPLTFLINLTMKEGVFPNCLKRSKVVPVFKGGDKEDPGNYRPITITTVLSKIVERVINDRIVNFIDKHNILNEAQHGFRKGRSTKTAVANFITYITEALEQRRKVSGIYLDLSKAFDCVCHKILLKKLNCYGIRGNAADIIKTFAENRQQCVELKHKCRNKEEKVYSEFQQVKYGVAQGSILGPLLFILYVNDMPTEINEKVIMYADDTTLLVCGDTVKDLEKRATENFQMAERYFTENNLLINRKKTKCTKFETKITKSSEVFTLKIGSADLAEVDCNRFLGIEVDKHLSWENHIDKVCSKISTNIFLMRKMCYTWTQKPCGLFENKHKYILNEKNVLYVDTETLLKMYYGLIFPHLSYGIPLWGGAADVHIQRLLKLQKKAIRCCTHTETFKTSKESHQMLAKLSPRESCKNKFKEFKILTVPSLYIYMRQDTNCTKSVYIYETIVFLMVNCTAPLNSDIHNHNTRTKEQYHFFSKRLNMTDRDPINAGCRFFNKLPLSIRCIKERSAFKRKLKEHLISGCWYKVKEYLTENL

SEQ ID NO: 3217 - protein, 950 aa, synthetic construct
  source 1..950: note = Description of Artificial Sequence: Synthetic polypeptide
  VARIANT 32: note = Any amino acid
  VARIANT 51: note = Any amino acid
MDRNKLDVLGMCEVRWGGCGELESGDSDCTTXVKIKMECMELEYLRLYYSXEDKNGMYGVGILIGKRLKDKVMKVEYINGRIMMIRLKGKKEDLVIIQVYMPTSNHSEEEVEECYEKIENLAEREKRNACIVVMGDWNAVVGEGSEGKALGKFGLGERNERGQRLLEFCNENLMVVGNTLFDNHKRRRYTWISRFDNKRHQIDYIMIQQRYRNCLKSAKSYPGADIYSDHILVVAEVLVKLKRTWKGQKREFINIEKLKDKGICEKLENAFSEIIMPGQEMECIERRWDHYKNGLKRQLRKRKWVKKAAKETLGVKERKRVKKEWITPEMISKMDDRRKWKTVNTEEGKRNYRRLNNELRRETRKARVKWLTEKCDKIENLZKEGKYDLMYKEAMDLVFREKNSNSGIKEIEAADGKMVNETQEVMRRWEEYIEWLYDGDTRPSEDELGLEEENTVAEDDKGNAILTSEVEASVKEMKNGKAEGIDEIPVELLKSLQREGKKELIGLYNQIYMTGNWPKDFCESILIPIEKKKNSKKCEEHRTVSLISHTAKVLLRTLNRRLYGKLNAVMGEEQFGFRRGVGTRDAIGLLRVIGERYMEKKRKVYAIFIDLEKAFDRVRWDKLMAILRKHGVDWRDRKLITNLYLNQTARVRIGGVISEEIELGRGVRQGCCLSPTLFNIYLEDIIKESFNGSRGVCIGGRRVECIRFADDMVVMAESAKEMEQMLDDLNTKLEEYGMKINKKKTKSMVIGGRNTKCRLKIGGEEIEQVHSFKYLGSMIMDDMYCTAEIKKRIAMAKEGFKRKQRLLCGPLKKDLRKRLAKCYIWSVVLYGAETWTLRKEDERRLEALEMWIWRRMEQVKWEDRIRNEEVLRRVGEERNMLEVIRKRKRNWIGHCLRRDCLLKEGIEGMVKGKRGRGKPRYQMLDNIQGNKYEEMKRLALDREKWKRINP

SEQ ID NO: 3218 - protein, 1075 aa, synthetic construct
  source 1..1075: note = Description of Artificial Sequence: Synthetic polypeptide
MRMSVNKRSFSEPALKMTSVNIEGLSANKELLLSDICSKCKCDVLILQETHRGPTSHRPNIKGMILTLERPHEQYGSAIFTKPGLMVRSAAMTHVDDIEILTVELKACTVTSLYKPPGADFTFREPSNFQTQPLKFITGDFNSHSTAWGYQETDSNGEKVERWAESSGLKLVHDPKLPASFNSGRWRRGYNPDNIFVTEQIAQQSFKSVEDALPRTQHRPISLTVKAVVCPVTVPFKRRFNFKKARWRLFTEELDSKIDEILPAACSYDKFIQLIRRVSRKYIPRGCRNEYIAGLDDNIEILLKKYEELYNTDPFSEDTLETGEDLLRALTTTRREKWCDLVTSLDFKQNSRQAWSLLRNLSNDPTSSKTLHTSVTPNQIAHQLLLNGKTTHRSPRPSIVRDMENEHHSLEAPFTLEELQAAIDKMKNNKAAGEDDLRVEQIKHFGPKTLRWLTHLMKQLRQHHADSQSVEKSKSGSPIKTRKGANRCQKLSPSILAVPSVQGPRENGANNCVNTMQIPRVWRKARVVALLKPGKEPTDVKNFRPVSLLCHLFKALERMVLNRISNHVDEVLSPEQAGFRPGRSCTGQILNLTQHIEDGYERKQVTGVAFVDLSAAYDTINHSRLVHKVYQATKDFGLSRFVQCILQNRRFYVTLQGKSSRWRIQKMVLLRAVYGLWTFKICAVHTTEQAFLCHTARKKQQMENPKNGLAQGSVLAPVLFNIYTNDQPMHPDVRQFIYADDTAVAAQGSTFEEVEEKLTRALELLGNYYHQNHLKPNPAKTQVCSFHLRNKEAKTKLHVSWKGQELEHCYAPKYLGVKLDRTLSFKQHCLDTKKKVSTRNSIIRKLTNTNWGADPQVLRTTAMALSLSAAEYAAPVWKNSAHVKHIDVAVNESARIISGCLRPTPTEKIYPLIGIAPPSIRRQVAAEVERKKQLTDNRHPLHGHQQQPRRLRSRRSFLWTSEPIDVTVEERRLQLWKEATPNPILALKEQLAAGGNKSFTTWKALNRLRTGVSNCKFNLSRWGYLDGEPLCDCGNVQTDDHLLTCPNLSTCCTPLDLQLANDKAICVADYWARNI

SEQ ID NO: 3219 - protein, 943 aa, synthetic construct
  source 1..943: note = Description of Artificial Sequence: Synthetic polypeptide
  VARIANT 252: note = Any amino acid
  VARIANT 322: note = Any amino acid
  VARIANT 464: note = Any amino acid
  VARIANT 810: note = Any amino acid
MYNFNCRMESPLKVSTTPGGNSNEESTIALCNASGPRVLGSPNICIKGESEHPWYPSKLKFNRKFFAGTLNVNSLLKIGKQKELEILLDKHEIQILAVQETRFLDENITETKNYRIFKGKPAIKIMKGMPILGTAFCVHKNLVDKITEFKSSSERLSLLTIKCKNKQYTFVNCHAPINDDNKKNLSKVEAFWELLEDEISKIPKSNVVILLGDFNAQIGREKTFRKIVGEYPAHKRTNKNGTRLIGLCKTYXLKLMSTFFKKLPRKAKTWISPNPMLGEFQLDHVAISKHNIKEIMNVKVTRNREFDSDHYLTKIKMKLLPXKIQKRQQRLIKYNTDRLTITKDAIKHFQEEIKISKSGKWEELSKEINRVAKNVFGATKIMKKAWWNETCEEAVAERTKKWKKWKCSGKTEHLDEFKIQRKETARIIKSTKNFYQMFKNHLKGYQAPSICFRDENGKVGLSNXHNCEILRKYFEQLLNCEEPNCKLEFPDLHENTETDPPPTAEEIKKAINALKNNKASGEDSITAELIKWSQPKIISNLQLMFEEIWETEKIPEDWKVALIHPLHKKGDKQDVNNYRGISLLPVGYKIFSTIILNKVEATLDSHLGEYQSGFRKGRSCSEQIFNLKSIIRHRLTNSKDIVVTFIDFKKAFDSVDRETLDKVIREFGIKSKLANLIRETLTDTKSKVKLQGEISKAFDIKTGVRQGDGLSPLLFNCVLEKIVREWKQKLKDHKLSPIRLGTKHKGIEIHCLAFADDFAILSENLTNAEIQINLLEEIANKAGLRISVEKTKFMTNIKNAPEILVTDIGXIKRVNKFKYLGEMIQENGLEKFAVEERVHKMERAYGITRNIYNKRSLSKNLKIQHYNTVVKPECLYASECLVLNYKLHKLEVLERKIIRKILGPLRNTEVWKLRSNAEVYRNIENITETLRKRRLLFFGHLYE

SEQ ID NO: 3220 - protein, 805 aa, synthetic construct
  source 1..805: note = Description of Artificial Sequence: Synthetic polypeptide
  VARIANT 44: note = Any amino acid
  VARIANT 192: note = Any amino acid
RNGQMLIILYLFMTQNCHHHFTVKYGNKALIRISASAVLIWRQXASRQFITHSQRHNIDQLATSWPECLRRHKTADDTSRRRFNFRKANWTDFTSTLDNCIDELEPIPGNYERFVEKVRYISRITIPRGCRQQYIPGLSGESKGLLDQYNEMYEKDPFSNETEEVGNLLLKELSRTRQEKWVETIERLDMTXSSKMAWNMMKKLSADPIAPKQASNTTADQIAHQLLISGKTGTKPRSRKIHRNLESEVSLIDTPFGIKDLDNSIQSLKTGKAAGVDDICTEQIKHFGKNKTVDPTTNKVLLNKQIPKSWRKSKVIALLKPSKDPNLASSYRPISLLCHHSKFMSGNSELCGRKTNSRTRRFPPRKIMYRAGIGADRTHRERLRGENITGVVFVDLSAAYDTINQRTLLAKVYNITKDYELTKVIESLLQNRRFYVTLEGKKSRWRTQKNGLPKAVFCPQCCSTFTQTTNLLLVIQSTSFMLMTWPLGHSSSGQKLPAVEERLQNALSQMSVYYKENSLKPNPAKTQACAFHLKSKEARRKLQIKWDGFSIEHTAQPKYLGVILDRSLTYKSHCQKTRQKTATRNQLLKKLIGSKWGASPHVIRTTAEAVCFSTAEYACPVWNRSAHAKEVNIALNETCRLMTGCLKATPLGQLYKAAGCEAPATRRLAVEHTERFRQAFDDRHPLFEAPEPLRRLKSRRSFLRSVPMEPPDKYPLTQKPPPGYHLDWRSWKSLNRLRTGVAPVKTNLVKWGIIDESDVRCNCGERQNMEHLLTCKNCPRTCSLDDLWNARDNALDVARYWADVL

SEQ ID NO: 3221 - protein, 686 aa, synthetic construct
  source 1..686: note = Description of Artificial Sequence: Synthetic polypeptide
  VARIANT 541: note = Any amino acid
MIWDTVKSELDEQLQVEFLNLKSRQDQKLKKLMRQIDCRVNNAQNVDNFQFYPRVVNETDISFNDEELRLLNKGLKFNVQPSLNDKTVKELIVATKMAVDVAKLNENEKGHVGYKLANAIKAETNKSCNSMHNNSDHKTVTSINDKLISNKAIVTKADKGNTTVIVSEEQYINKTLQFFSENGVTEIAKDPTKKVQAELKQLLKRTSFLLTEKEKFQCYVMNPTAPRLRSQLKVHKNGHPIRAIVNSMKGPLCKITKKLDKILKEFYVFGDNFSVSNNTTLINEIKDKPIADTSHLMSLDIKNLYANVPVDEAVELIKANLLKHKRLSQQEIVEFIDLLQFILKYNYFAFNGKFYIQKDGLAMGSSISGTIADIFINNLENRLFTNMQHPVDKILYYKRYVDDTLLLIDGGQTEITEIVNKFNSLHEKIEFTVEQEKDGTLQFLDLNITKQDGRHLFKVYRKPTTTDILIHNSSCHPNGQKLSALRCLVDRAFKVPMNEKDRTTEFNIIRQLAKVNGYQENVVNNLIRKKQRAKSNKNGTXNIKRVMVPYFGNLSQKVANILKPFKVEAAFKTNNTLHHKLRNNLNQETDKYDKAGVYKIQCSSCNANYIGQTGRSFKVRYKEHMDAFRLNNFDKSAVAMHIRETGHPLKRIEDDLKILHKQDKGRKLDLLEQLEITIHNAKATFH

SEQ ID NO: 3222 - protein, 1912 aa, synthetic construct
  source 1..1912: note = Description of Artificial Sequence: Synthetic polypeptide
  VARIANT 14: note = Any amino acid
  VARIANT 50: note = Any amino acid
  VARIANT 90: note = Any amino acid
  VARIANT 92: note = Any amino acid
  VARIANT 94: note = Any amino acid
  VARIANT 121: note = Any amino acid
  VARIANT 170: note = Any amino acid
  VARIANT 249: note = Any amino acid
  VARIANT 261: note = Any amino acid
  VARIANT 286: note = Any amino acid
  VARIANT 315: note = Any amino acid
  VARIANT 353: note = Any amino acid
  VARIANT 357: note = Ile or Leu
  VARIANT 387: note = Any amino acid
  VARIANT 412: note = Any amino acid
MALPGAKPASLSVXGPNLMLRHMTPRRSLPWPRHGRNAGREIEVRLMPPXTWYVPGLTANRLPPRSPCFLWKTLRISSGRWMACQDEIWXCXHXDVVPSPVTGTACLVRGGGWHVKMRSGXVLITTSSPAQSRALLACDKLGDVPVSITPHKSLNMVQGIIFHKDLLLQXDDELRKNLERRGVHFIRRVHRGPKDNRVATGAFILAFEGDSLPEKVKVMIYRCDVKPYVPPPMRCFKCWRFGHMSSRCXGNPTCRECGRAXHPDAPCAPPPVCVNCGQHHSPCSPXCTVLHKERKIMEYKTLDRLSYSEAKRKYXKLHPVSMKTSMPQLHHTASAISATALHCLVFHSGPPGXTAHXCPHGLWGHLNLHRPQGPYFGSSNHHSTCGXISPHPPPLHLWGHQSPPLSQRHNSXLWLLSRGRGPSDPFLLRLLLLKDTSRWLKEPPTAGRRASRAPQFLGTEPAEPSQHEKPKEQRETKEKDKKPPKRRIPWWPPCHHPPPPLLLRTRETTQEKDSLVATVPPPPSTSSSEDEIEILASPKDLAIAESSEAMDVEALPQKSATAEDTVNPTAPSKSACPSDQEALGSASKIGDSRRYCEPYCAVEISMSQRPGGSLILQWNCGGFFRHLPELQQLLCRFPAFCVALQETWFPAQRTPALRGYRGYYKNRTIYDRVSGGVCIYVLATVPSAAVPLHTTLEAVAVRIRAMQELTICSLYLPPDEMVSLTDLAALVAQLPPPFLLLGDFNAHHPLWGGAQTTGRGRDIETLLSQQDICLLNTGAPTHFCVARGTYSAIDLSVCTPSLLPHFQWRVHDDLCNSDHFPVLMSLLDFQPAGCPSRWSLRRADWQRYTSAATVPVPLPADVDMAVHQVTSTIVSAAEATIPTTSGSPRRKSVPWWTPEIAEAIRDRRRALQRHRRHPTVENLIAFKRLRARARQLIRQSKRDCWETYVASIGCRASRLGCGPRLGAFLGTVHQQRSPAYTSRVTYAPTRLPSLNTWQSIMLAPLQHQNTVQTSVHTGLLGDVCRQHRLSRLASRVWSQVRRLFGYRPPAAIPSLHIQGNLCTDPTSIAEHMAEHYARTSATSEYSADFRALKERVEQRRLSFHTRRAESYNSAFSEWEFETALAACPDTSPGPDRIHSQFIRHLSVEFQHQLLALFNRLWAEGAFPSQWRESIIIPVIKPGADPQVADSYRPISLTNVLCKLFERMVSRRLMWILEHRGLLSPHQGGFRQGRSTVDNLVALESAIRTAFSRREHLVAVFFDLRKAYDTTWRHHILATLHGWGLRGPLPLFIQNFLSFRSFRVRVGTSLSSPRVQENGVPQGSVLSVPLFLIAINGLAEAVGSSVSSSLFADDFCLYFSSASIGVAERRLQGAIRKAQSWASTHGFQFSPSKTRVMHFCRRRAVHLDPELYLYDELLRVEETHRFLGMLFDSRLTWVPHLRQLKQKCVRYLNILRCLSHTSWGAARTSLLQLYRALIQSRLDYGSFVYGSAAPSALQVLDPVLHSGVRLATGAFRTSPVASLLAEAGVLPLRFRRQQLLSSYAAHVHATPHHPNRRLLFPAAALPSPRQRPRSGLPIAVRVRSLLSSLESLPIPPTFHCPYRTAPWSLPRPQLRLDLSHASKASVAPLSLRRQFQAVLESFCGAEVVYTDGSVVDGRTGYAYVHGEHIEQHSLPCGSSVFTAELVAIYRALEHLRACPGESLVICSDSLSGLQALAKCFPKHPLVQSIQESVSRLVRSGRSVVFVWTPGHIGIPGNERVDQLAKQATTSSPLAIGLPESDLRLEFHRKILGLWNSEWANSAQPNKLRAVKLSTVAWKSSLRSSRRESVVLCRLRIGHTWLTHGHLLRREDAPQCDCGAPLTVVHILVDCPLLVALRQSFNLPDALSFMLGDDAAMVERVLDFIRAAGFYHVI

SEQ ID NO: 3223 - protein, 552 aa, synthetic construct
  source 1..552: note = Description of Artificial Sequence: Synthetic polypeptide
MDPDIVILPADKGNATVVLNKQDYLQKMQCLLSDSAYRRISADPTKSVERKTNNLLKKSSLSQETIKSLNSYCAVPPRLYGLPKVHKDGCPLRPIVSNIGAPTYRVAKHLAGLLSPLVGRCEHHIKNSVDFLRRLEGLHLADSDILVSFDVVSLFTRVPLSDSLQLIETKFGTDLTNLFRHVLTSTYFLFNDEYYEQTDGVAMGSPLSPIIANLFMEDFEDRALESAALKPACFFRYVDDTFVVWPHGSENLNYFLEHLNSIHPNIRFTMEVEKNGCLPFLDVLVRRKADGTLGHAVYRKPTHTDLYLQADSCHHPAQREGVLRTLVHRAHVISDPESLPTELSHLEVTFRQNGYGEGQIKRALRYRPHVQRASDDSTESAPTSVAFLPYVGSTSNKIGRILRKNNVKCVFRPPSKIKALLGSVKDDLGLRKAGVYRIPCSCGMSYVGQTIRTVEDRCIEHKRHTRLQQPNKSAVAEHCLDTGHPMEYNKTEILACTSNYWDCVIKEAIEIKLGDNLMNRDGGFCLNSAWDPALSLVKKQRDKTNPTSSVEN

SEQ ID NO: 3224 - protein, 1017 aa, synthetic construct
  source 1..1017: note = Description of Artificial Sequence: Synthetic polypeptide
  VARIANT 532: note = Ile or Leu
  VARIANT 611: note = Any amino acid
  VARIANT 612: note = Any amino acid
MLFHQNVQSLNNKLSEIKIMLSNELIDVSVLCMSEHWLRDDALQTVSILNYELAAYTCRQQILGGGICIFVKKGLKKSFFFFLFFFFFFFEISAIELPSLRDNFNMHLQIPNGDIKTFYQNLENTLTQTVKNKQTIIICGDFNIDFKGSAKEKTDLMNILVSHTLKITIHSPTREIVTLSLQVYNRSNNNKPTKEQYKAEAVKTGLGDHHGQTISFHIKGIEVNKLTSTYKTRTYNDQEIEIFKNLLKSESWEQIYDTSTENISEKFDIFIEKIKYYFDVVFPVKTRRLKDTLPKKIPSQNKWITTGIRISCANKRFLYRLTKTCDTTPAFDRYFKNYKTVLRKVIKSAKKLENDRYISNSSNKMKAVWNIVKKETGNNKTKNKNIQLKENQQTTSKPKEVANMFNTYFINIAEKLIEKNVIKNPSQLATKIKHIDKTIFLTPTNTKEVQQEIKLLKSKHSSGIDNIPDFIVKKCADFLSEPLTYLINLSFSTGSFPKCLKIAKVKPLHKKGSQEEVSNYRPVSQLSAFSKXLEKLFIKDCPISQNPNMVLEKNHSTETAVFSFLYETLQALDRREHTTSIFLDLSKAFDTINHNKLLSKIQNWGLGAAHXXIKSNPHDRKQFQKAVLIEITYESNGTVSTYHSDSLVVKHGVPQGSILGPILFLLYVNDLYINNTNGKLYQFADDTSILITGSTKEIFESNIAAITKNIRDYFDANGLIINVEKPLQWIYLRHRIDHQLTQILICKWPDNKCGKTVAMDIFTTQNRSPANPNIDINGKTIEKTECTKFLGIWIQQNIKWDSHVDYINRKLSKTCYIMRTLKNSISYNNLKSIYFAYAHSQMKYGIVFWGNSGASMKTFRIQKKIIRIMEGVDQRTSCKPLLKRNTPTSKHVHNGKPNYYKRKIKKEILPLPSMYIMENLIIIKEKLNSKSPCITRNETVHCHNTRQKNNVHVKQTNTALFQKGVLHPGIRLYNALPKAIKSKTDTTKFKTAVKDYLVMHCFYSVDEYLEFQNYSIS

SEQ ID NO: 3225 - protein, 760 aa, synthetic construct
  source 1..760: note = Description of Artificial Sequence: Synthetic polypeptide
MSDWAHRSAVDKQSSKFQRLSRPSISHNTNRRTVINFTDKELDDAMLSVLEKGLNFAPTPKNVPLTEFICSVEQAVSKLPGDQAEEIRQEVAHTLRRAPPPRSNISPLERAAIRSLREDQDLIILPADKGNATVLLSRDDYLRKMDCLLDDSAYRRLQKDPTERIKRMTLSLLKKSSLSDDVLKKLHPGAAVPPRLYGLPKIHKQEVPLRPIVSNLGAPTYNLAKHLASVLSPHVGKCEHHIPNSMDFIQRLKSLRLSPSDLLVSFDVVSLFTRVPLEESLQLIGEKVDKETAELCRHVLTSTYFLFNDKFYEQTDGVAMGSPLSPIVANLFMEDFEDMALKTAALKPTCFWRYVDDTFMVWPHGEEALNRLLDHFNCMHPNIRFTMEVEKEGKLPFLDVLVYRRDDGKLGHSVYRKPTHTDRYLHASSCHPPVQRTGVLRTLTRRAYAISDAESLTQELDHLKVVFKQNGYTDKQIRCAFQFGPSPEPLNETHKSVAFLPFAGSISSKIGRILKKHDIKSVFRPPVKTRALLGSVKDDLGLRKPGVYKIPCQCGKTYIGQTSVPFRTDVLNINATHVCSSPRSRRDSLSMWENVYWSDIRTIQDRCVEHQRHTRLLQPEKSAVAEHCLDEGHRMLYNETHMVASASRYWDCVLKESIEIRLSDNLINRDKGYLLSKSGTLCYQMLKNNGWYFRNLNNNFLIIDYRFRRILPPERCMSCAPEGSYCHFLRTRYGSSAMYKGAADCTGNSVPARLCTSTLT

SEQ ID NO: 3226 - protein, 1058 aa, synthetic construct
  source 1..1058: note = Description of Artificial Sequence: Synthetic polypeptide
  VARIANT 103: note = Any amino acid
MKRPFREKFPPSNPIGKEKATSDSVGSQLEDSNESEHLKSPNYHQARNAKIKHKHINYIATHNINSLLQTGKLKNFTDELNRQNIIIAGLQEMRNTIEDPFEXQGYRIYNGKPGQRVMKQCPQFGTGFIVNLKVIDSITDFKAISPRIATLTLKATNKIYTIINAHAPTNQKNFLTRTMVEVEKFWDLLDQTINQVNKNHVKILIGDFNAQLGKERKYRDIIGKWAPHKHTNRNGQRLVEICRTYGLISKSTYFKRKPSKLMTWKHPDWTKGEWQLDHVCMDKFFHKEIQNVKVLRGMDTGSDHYMVNIKIKFTPLSKKRQRALEIKESMIHINKKTESIGDKRKYDPHKLIKNDKYQKNTQNTVITDNLQELIPILKQHAEESAPVNQTSKKHAWWTTECDEIHDERHQAWIKFQTHRTEENAYNLKNIRKKFSQIIRKTKRLYQKDVLSSIEENYHETNSRDYFKAFDKQLRKFNPPTLLLRNKDGRIAHNNKENAEIMAEAFNKLLNLTNLKSFKAFNNRHKHPCNNQTRKYSPPTVQEIETALKEMRNYKACGENQVFAEMWKYAGTTTRTSLHTILQKIWTTEKFPEEWTTAIITPLHKKGDKSDPDNYRGISLLDCTYKIFSKILHNRIREQLDKELGEYQGGFRPWRSCAEQIITLKLIMAYYRKRNKPLSITFIDFKKAYDSIHRPSLLKILRHFGLHLKLIRLTELTLTNTNSKIKFEGNFLDHSIHMREWYKANPKNIKVGTQKDNIKLNCLGFADDLALLANNIQETKQQIRSLQEIAQCIGLKISFEKTEIMVTEPPLANKIRIGVHNIKIVEKFKYLGEIITHNLNEKPSWQSRINKLIKMHHVTKNTYNKKCLSIATKLKHYKTVTQPQITYASETIFKTTNTVAIDRLLKIERRIVRTCINKKYQKDGIWRIASNETVYKEVEPVTSTMKKKRISFLGHLMRTPENRISRKIIEKLWNSKSNIRWITEIKEDMMKLQITMEDLKDKTDTLKILQDKHVTLPIKINKQRLGRVISDEERRARSERMKKYWANKKKNKNKNNRRT

SEQ ID NO: 3227 - protein, 1264 aa, synthetic construct
  source 1..1264: note = Description of Artificial Sequence: Synthetic polypeptide
MIKKNVWFQTVKSMCVQEKKRVVPDCEIDVRPGIRTNQLNNHFKNIQQAKHNSKNVTNSENYKGVFIHVGTNSLRSCSEEDLVNETRNVIRSAKNIYPYSRIIISSILRRRSVSDKYIDKINCNIRDQCNRLGAIFVDSNKFIRDDCIGQDGLHLNRLGSATFSKMFIDLCKIIRNRGNWQSVRGVNPVQNYTKQGKLAVSEGGELKHVVDKDTTKEDVLKTVNRYNSSFLMHWNIHGLRATYLQNKIAKIDELQIILSEGRNIKVVCLNEHWITEDSITVLNKLENFNVASSFCRKNKTHGGSCILINSSLEYKERDDFNFLNEELIFESCCVELEQQNIVIISIYRIPGNDVTKLFFDKFQCLLQKLTKEMRKKIIIAADFNIDTASETSISTKFNDLIQQYGFRLNFTEFTRVSDKSATCIDNILTNYTLNENAKFTLNLGISDHYALLMELLKTNKENGRKCFLKRQFNPDNIHLFCCRLNDIDWSLQHESSCSENFDRFLNSFLHVFNETFPPMSAKERQQVSNISTHVCQRKTTSKLKWITTGIKISSKRKRELHAELKSNKSPEFIKYVKSYKKLFRKVVKAAKEMANTKFIRKHKNKSKAVWTVVKSELGIKPSNQEISKLKIQDKIIVNPAQISETLMNFSTKNTRQNNCKSCSDIRNFNEFFITVAKSDVNVPSYQDNVHLFGSSLSKNECLIKFDTVTVEDVEKTILNLKNKNSVGWDEIPSKVIKAASNIIAYPLCKIINQSLEEGYFPDSLKYAEVKPLFKKGSKEDMGNYRPISSFPCFPKYLKYQKQFGFQKGKSTIYAINEFVNKVTSTLDKSQKAAGIFCDLSKAFDSVNHSLLLYKMEKYGIMGTALQWCTSYLTERKQRVVITSSKGKYSSKWRLSHRGYHKAQFVETIPQGVPQGSILGPILFLFYINDLPININYHSVLFADDTSVLIENKKADEIPDNVLKTLENLDVWFHLNGLKLNIKKLRCLKDPRKPRCLVPSKWSKIKYKKTQVMQFKTKQSKLNDIQIKHNSQELHEADHVKFLGMKLDRIYPGPHTILGNETGQNLSWSSHIDYLKNKLNSLAFAMSILANVTSLDTRKIVYRSYFESIVRYGIIFWGNASTMIRILTLQKKIIETCGAKPRESCRPLLRDLNILSVPSLYLFEIILSIIIQNYFFIITSSTVMKQEQRQFHAPTHRLNLYAQAPQYMGMKICNKLKNTHFRKVETESMKRKLYSTLVQKCYYSIDEFLNDDLSIEQDKTYNYVL

SEQ ID NO: 3228 - protein, 1071 aa, synthetic construct
  source 1..1071: note = Description of Artificial Sequence: Synthetic polypeptide
  VARIANT 60: note = Any amino acid
  VARIANT 437: note = Any amino acid
  VARIANT 535: note = Any amino acid
  VARIANT 607: note = Any amino acid
  VARIANT 702: note = Any amino acid
MLRSALTADPFTTGLHSNGQHSDRSFSRPFVFISINVEGFSREKEVLVANLCQKYSCDIXLVQETHGGSTKNRPRIAGMELILERPHDKYGSAIFARPDVNITSASLTEDNNIELLTVQTPFFCVTSVYKPPVPILASKHQPTSTIRTRQQHRTPHSANSVFLCYISLQTTCANFSIKTPANFNDQDVNFVIGDFNCRSTSWGYPDSDTNGTSLETWAEAHDLHLIHDPSSHLHLTVAGGKEGTTQTTFCFFKGSCTMYEDCRRAHPSYATQWQVEKRVQPRQHFVSSKVAAQCTKTVGEPIPRTQHRPVICTVNPVVVPEEVPFKRRFNFKKANWQKFSEELDSKVINIPPQPEMYETFIKCVQQVSRKTIPRGCRTQYVPGMSSDDKLLLETYQTLYEEDPFAKETIQAGEILLETISATRKAKWSNLVENLDMXLNSRQAWKLLKNLSGDPVKSQDNFTSMTPDKVATQLLQNGKIKGRTPKEALQRVPETEHHFLRDPFSMAELEAAISSLKMHKAPGVDDLRVEQIKNFXCKTMEWLLSLMNKCVAKLHIPKMWRKSRVIAILKPGKEPTDPKNFRPISLLCHTFKILERLVLNRISATLEXKFIPQQAGFRAGKSCSSQILNLTQHIEDGFERGEISGVAFVDLTAAYDTVNHRKLLRKVYDLTKDYQLTSVISTFLQNRRFQVSLQGKRSRWRTXKNGLPQGSVLAPALYNIYTNDQPIPANTRLFIYADDTAVAVQGPTFKEVEKKLSLAMDELSKYYDANHLKPNPSKTQVSAFHLRNREAEHKLDITWRGEQLKHCPTPVYLGVTLDRALTYRQQCLNVKQKVSARNGILKKLVGSSWGANPHLLRTSAFALCISAAEYAAPVWDASAHAKQVDIAVNDTARIISGCLKPTPVQKLYPIVGIAPPNIRRAIAADYERTKQETDHRHPLYGHQAARHRLKSRKSFLARTAPLEGAPEANRLATWKSSLPADVSPKEEIAPGANLQYPVWRSLNRLRVGVPRCKSNLKKWGILPASADTSCDCGADEDASHLLVCPLLDNTCTAQDVHEGNDKAIAAAIFWKC

SEQ ID NO: 3229 - protein, 980 aa, synthetic construct
  source 1..980: note = Description of Artificial Sequence: Synthetic polypeptide
MTSQHRTFSGPIMTIISVNIEGLSLCKEELIKDLCKKNKCDVLCIQETHRDSILNRPKIQGMRLVAERPHRQYGSAVFVKSEIQVLSTSVSDINDVEIVTVELKNCTITSVYKPPLSNFNVNATHKHNSTKVNFVIGDFNSHSTRWGYPQDDENGMAVISWAESNKLALIHDHKLPPSFNSGRWQRGYNPDLIFATESVSQQCIKTVCPPIPKTQHRPIMCQVMTAVRPVCVPFRRRYNFRKANWLKYQEILDREVAFLPPNPDSYDKFTDAVKRSSRLSIPRGCKTEYVQGLTPETVADLHTYTELFEKDPFDESTVAAGQQLLASISEAKRNSWVNLMEELNMSINSHKAWRLLKRLSNDPTSLNNHANITADNIATQLLKNGKPENRSRRQTKNMSNTTEDETNSLSQPISIDELNEAIAKCKNGKAAGLDDILVEQIKHFGPQTKQWMLNMFNKCMADCKIPSIWRKSKVIAILKPGKDINDPKSYRPISLLCHMYKIFERILQTRLTYVIEPKLIPQQGGFRPERNCTSQILGLTQFIEDGFQKKRVTGAVFIDLTAAYDTVNTRQLIEKLYEITRDRKFTDIIRNLLQNRRFFVEFQGKRSRWRNLTNGLPQGSVLAPSLFNVYTNDQPLPVNTSSYIYADDRVIAAQGQSFEDVEKSLNEALVELDSYYCRNQLKPNPMKTQTCAFHLRNKQASRQLQVRWRGVDLEHCKNPKYLGVTLDRALTFKQHCLNTKLKVCGRNNILRRLTGSTWGARPKVVRTSALSLAYAAGEYASPVWCRSAHAKQVDVALNESARIVTGCLQPTPVNKIYHLAGIAPPAIRREQAAYKERQKSIVSKWHPLHGMEPAAQRLKSRNSFLTSTEKESDYRTTVERWKDAERHPWMEPSEALAAGHNESWTTWKSLNRLRSGIARSKVNLSKWGYQNDSTLCDCGAIQTTTHMYNCPLSPSHCTFEELMSAQPNAIDVALFWAKNV

SEQ ID NO: 3230 - protein, 1288 aa, synthetic construct
  source 1..1288: note = Description of Artificial Sequence: Synthetic polypeptide
MYIFSDSHGRGIASIMQTMQMKFKVTGITKPGAPLCIITNSKLLALPNLVPLYVLLHKTDNLKQISHVSNMWQSNHQGGFQNVMFVEATSSVRTISPNMVCTGIIMAKQFCARKYDNINSQRQEIHSPIPLSLVKEKEVTSHTQNEEKEQETSLSSPKKESPLLTLKRKDNWKRSVQKEKKNHHPVLRKRTRNITVFPQKRITIAHLEKKGQLEKKRAEREEESSSCSIEEVLSLSAPEEETFSSAEKLPAKLRRGERTKKDIPLKNQDFFIPAAGEKTTRYKLDLRKTKVVPRDQLHKFQGISCTNSIGQNVMFLHINVQSLKYKINELQFWLENLNCSILSVNEHWLNCEELKLYVPFGFDLASSYYRTNVEHGGVSMLKIMTWWSVYVKNNVNLIYEVTDVSELCIEAKFEAAAIKFPKQEIIVGSVYRPPKHNESLFVENLEKLILLLLKHKNYRIVIFGDINIDIRFKNRNVNHLLNMLRSLNFYCINTKPTRQAACLDNIICNFHLNKTDFDTISLCISDHDGLWLRQTLNYKILETSTEHRIIRPINDSKLNQLISKLNIVKWDEIITNVDANEATNRFLLLLAELFETCCPKHYRKSVKQRQCSKPQNLKKTGILHITTKSKKNWYTPHLNRIRILMLLYHDKAKHNNADKEMYMKIKKLYRSEIKAAKCKANDAYILNSTNKCKAAWEIIKTEMNYDHKVYQIPISPNTLNEHFVGPHSDSSTMQDVRKAEALLPETSSNLTNNFCWSRVTEKEVYESVAKLSNSRAEDYYGLSNFVIKSVRKQIVKPLTKIINKILEGGHYPECLKISVVKPVYKKGEVTSPENYRPISLIPIISKIIEYCMHKQMYQYFETNNILSASQYGFRSRLSTTKAVESIVSKIHSSFEKKEIVCATLLDLRKAFDMVSHNILIKKTPALWSERECYMPDGVLLGEQETVSQDKKKLQHYGVRGNAICLMESYLENRKQLVKINNESSECLPVLKGVPQGSVLGPFLFIVYINDLPTVVPCDAVLYADDTTLITCDTNLENVQHNMAVAMEKCNTWFEANVLQKNDSKTEEIVFNLTAPSQDNKTVKLLGFHIDQKLNWDTHLDKLCSRLARVLHLLYKLRSSVSKELLLYAYSAFFHSHLDYGIILWGNSVGSKTVFKWQKKAIRCIAGLSPRDSCRGYYKELNIMTVPSLYIYNCLVYVKENLNNYDLRMTIHDHSTRSGHTIDVPYARLAKTHNCYKYLGLLYFNKLPKEAYTVPVDQFKNTIVKWFKSKVFYSAQEFLECGTKDLNFL

SEQ ID NO: 3231 - protein, 1030 aa, synthetic construct
  source 1..1030: note = Description of Artificial Sequence: Synthetic polypeptide
  VARIANT 364: note = Any amino acid
  VARIANT 452: note = Any amino acid
  VARIANT 487: note = Any amino acid
  VARIANT 1027: note = Any amino acid
MGQLPIHWKKTLPVKKPIRLQQDGYNRRRRRLRKRTVLIGVWNVQGLQNKVGEVIKEMEARNQDIVVLPETKKKGHGIERIGPYTHFYSGVPKNQRAKRGISILMKNKFNRMVTNWEPIDENLIKININIQEHKITLIGVYGISEDEPIRKKDEFYNRLNGVIEDIGKTREIIIAGDFNSRTGSKIGNKIIGPFGENVVNDNGNRLIDICEQNSLKILNGFYQHKDIHKYTWHKDTLNQKSIIDYIIIKQQTRIKIHDIRAYRGVTLSDHYLVNSKFLFPFRGKNSEENQNCTTEDLQTEIKITKYNLNSFENESTVFLYQKRLDEKLIETEFDNTEDQYQYIISKLHESAKEALGETDEKHTXHSLYYWDEEIKKEVKLKKEKYLKWLNTRNVQDKIELNAQQAKIRKKVAEAKNKAWEQSCQKIESYIGGKRNTEAWKTIKNLRRNSKEXTHIKYITHDSWEKYFQNLLSENRRILGKPEGILKXQHILNILLMTLGKNIFKIYYQKTEEFLGNPEYNEITNELPDNYIHLEIETVKSAIKSLKNGRATGIGGIPAELLKFGTEKLIELLRNLFERCLNGEDVPNDLKVGYISVIHKKGRKDDCKNYRGITVTNTFSRLYGRIIKYFLEQEYKEKEAEEQAGFRAGRSTIDHIFCLQQIIEKNKKLGRAQPIHLVFVDIEKAYDSVPLPNLWKALLSIGINPTIIKAIQNLYKNSISKIKIGKFLSSGFQVTKGLRQGCSMSPTLYKIYTEVTLQNWKKKCQTMGIPINDRTIYSLQFADDQLIIAQDYEDIEYMTRKLIQEYKKAGLNVNMNKTKYMVIGGINEDLILEEGMGTITTTEEYKYLGVKITNDGKQEKEIRSRINAGKTTISLLNGILWDKHITTDNKIRIYKTIVRSIITYGSEVWTTKWQLKSKLLATEMDFWRRSARISRRERIRNEVIREKMKCKNSIIEFIEHKHLKWYGHVRRMGQERLPKCILDWTPNGRRKKGRPPTTWMQEVQSAMRKNNIPEDLWEDREEWRTIIXNLM

SEQ ID NO: 3232 - protein, 825 aa, synthetic construct
  source 1..825: note = Description of Artificial Sequence: Synthetic polypeptide
MSTQFLKPVNKLTTWKSPNSTLGEFQIDHVAISNKNTKEILNVRTRKGFFESDHHLLQIKIKFQPNRKKPQMNKTFRIDPEYLKLNKKEISQEIRQSNATNWKELAEVLKSTMHLGKPPRKRKHRWWNSSCDQAIEERTQAWKTFSSNKTTEKWQEFLRIQKNTSKAIRREKRRYDINRLKEIEQEFLKNNTRNFYTIFKENLTGYQPPNLCFRRPDGSLETNTRNNCQILANIFTHSSTASRRQSNISKTPSNPDSKPPSLKEVKEIINSLNNKSPGEDGIIAEMWKLNDSTLTQATHRIISKVWETEQIPAEWKCALIHPLHKKVQKLIQITTGEFHCSQLQGNFTAPSNIQNFFKGPVKQTRRTGGPVNRRVSGRVSRSILRRTNMEPKDILQMRRCRNTVVTFVDFKKAYDSIDRQTLFHTLEEFRIDRKTRSIIQQALTGTTSKVKFMGETSEAFHIHTGVRQGDGLSPLLFNLVLEKIVRTWEKEIKGIQLGIKKEQRIRVKCLAFADDLAILTNNREEARLALEKLHEISQKTGLQISYEKTQYMENKLQIVSPSQPSMEKWHKFLTSDIKDSVHGKQAADSLPITTQYGKVAQVSHFRYLGEMIQPSGLNSIANQERVSRLQRAYKLTWNHYNKKSISVNAKLRHYNTVVLPEALYAAETTVIHGHTKIREIEKQERKILRKIYGSVFREGIWIKRPTREIYKDMETITDTIRKRRMKFYGHISRMNETRLTRQIFEIANKSKNKTKWITETEEDIKELGITQDNINNREQFRNIIKKHKLKQEHTENRTGKKWSERKREHSERMKRIWEERKKKKS

SEQ ID NO: 3233 - protein, 1046 aa, synthetic construct
  source 1..1046: note = Description of Artificial Sequence: Synthetic polypeptide
  VARIANT 279: note = Any amino acid
MCPAFAEKDAATPQPAAVALPTSGIIARATTERTKLHVAHANVQSLQAHLVEFRHIFQDLGLHIILLSETWLKPSITTSSVNLDGYVFLRHDRLNKRGGGVGAYIRSELSPTVLHTSNNDETEQVEYMFIEIKPLKEKCLICVLYKPPKVGALDCFETALSDLESTYEHIIIAGDTNINFLFNSPSCMKFKRMLTSSNLTLLQLAPTHHTADSHTLIDIFATRFPDRVIRTSQTSAPGMSAHDVIFMTYSLECPRKKPLLTTYRDLRRVNLPELTADAXEIVFEPTSDTLPDVNEKLHKITNKLNQLYDKYAPIKTKKVRRKPAPWLTDELKQLMNLRDTAHRTYKLHPTPENHTAYKQKRNRVSQAVRNAKLRYAHSLTDNINRPAVLWKNLRGLGIGKVKTAAEPTVPIEELNQYFTTPTTTIDHQTKQTLIDHITRINNANHDKFCFKHVTGSTVKKAIMRITSASTGDDGITIQMIKLIIDPLLPIITDIFNQSLATSVFPDAWKRGLVKPLPKKDIATAPSDYRPICILPALSKALEYIVHDQLTSYLTINNLLDEHQSGFRKYRSTTSALIKVTDDLKQAMDRQEATIMCFLDFSKAFDTVDFDILLAKLSSLNLSQGVVQWFRSYLTSRLQCVMSGTEKSQWRKVLSGVPQGSVLGPLLFSLYVNDVSSVLSFCKYHMYADDLQLYLSAKPKNLKTAIENFNSDLCALSKWAQNIGLKLNPSKTQAILVGHPRLINHKYRESQPSLILNDTPIYFSPSAKSLGVIIDDKLNWAEHTAAVCRKASASLHALQRYKKFFPLDLKKKLIQTLVIPIIDYSDVILQGLSWESSRRLELIMNACVRYICNIRLFDHISPSYKQLSWLRADKRRDFHTLCFLYSLINVHCPSYLSSTLTLLSDQHNRTTRSCQSKTLSVPIHHSAGFSKSFSVAGTRLWNNLPQYIRELNNTASFKRQLMDYLLKQLRQSLIPYGPGTSHPFLLPDILLLPLLSPGTAFLTSFCQNSPCLNQSRYIQKYILYLLISMLLLLLLHQQQQKVSQWYC

SEQ ID NO: 3234 - protein, 808 aa, synthetic construct
  source 1..808: note = Description of Artificial Sequence: Synthetic polypeptide
  VARIANT 274: note = Any amino acid
MVIGCFYRPPGSAAVVAEHLKENLENISSRFPDHVIVLGGDFNLPDIDWETQTFMTGGRDKESSEIVLSALSENYLEQLNREPTRGDNILDLLVTNRPELFETVNAEQGISDHKAVTASIISAVNRNIKKCRKIFLFGKSDKKRISEYLTAQHRSFISSTDSVEEQWSKFKAIVQYALDEYVPSKIVRDGKEPPWYNNRIRKLLRKQRELHCKHKHSQSLVDKQKLNEAKCSVRRAMREAFNEFESKVLCTDLAENPKKFWSYVKAVGGSKQNXQTLCDENGIETEDDTLKAELLNVFFQSCFTEEDCTVVPSLDCRTDYKMADIEIIDRGIEKQLKSLKRGKAAGPDGIPVRFYTEYAKELAPLLAVVYRRSLEERSVPKDWKMAQVIPVFKKGRRTDVQNYRPISLTSVSCRILEHVLCSSIMTFLETRNLLCRNQHGFRKRRSCETQLALFVHETQRAIDTGSQVDAVFLDFRKAFDTVPHRRLMNKVRAYGLSDQLCDWIEEFLDNRMQHVILNGEKSSEVRVMSGVPQGSVVGPLLFTIYINDLADNIGSSLRLFADDAVVYREVVTMENCIEMQEDLHRIDAWCREWQLNLNVDKCNVLRIHRKKDPLSFSYTIAGQQLEAVNSINYLGVGIRSDLKWNDHIKSIVGKADARLRFIGRILRKCSPKTKEVGYSTLVRPQLEYCSPVWDPYQVGLIEEVEKIQRRAARFVTGSFGNRESVTEMIDKLQWKTLQERRSVARYGLLSKFREHTFTEESSSILLPPTYISRRDHEDKIREIRAHTEAYRQSFFPRTIRDWNRRENR

SEQ ID NO: 3235 - protein, 777 aa, synthetic construct
  source 1..777: note = Description of Artificial Sequence: Synthetic polypeptide
  VARIANT 541: note = Any amino acid
MVSLSNYDWSHIFNNNAHDSANTFFDRFFHTFLNIFETNCPQYKCKVNPKSNSNKHRDKNPWYTAQLANMKSRLLLYRDSYRLQKTDMAKQRYSRAQKDYKHAVNEAKKQHNLVSIESSKNKCKKAWTIINSVSKSKQKVDVVISADEFNNFCIKSVNQISENIVRPHETVADLIKCHNVNYTLKDKFLLSEVTPDVVLTIVNNFRPSDSVDIYGISCNMLKKIIGYIVYPLTKCINKCLIEGVFPDVLKLSRVVPIYKKGDRNCPSSYRPISLTPILSKFVLESIIYYQLCDYLTCNNIISAVQFGFRKGKSTVHAIDSLIKKVLNAYEEKKFAQATFCDLSKAFDCVEHISLLKKLVYYGIINSEVDNIFESFLSNRKQIVCIGKQRSQLAEVKCGVPQGSVLGPLLFILMINDLPSYINTHSFSMPMIPLFSISAQTLICFKLFTILYKYSLILYADDTTFFNISSDFDMLQTVTNDTLSQASVWFRANGFLLNESKTQKIVFSLRDLPVEDFIDSVKFLGIVIDSKLSWEPHIKYIXTRLSRVVYLLRNLKNHVPAAYVRSAYFAFFQSIISYGLLIWGNSSHVQDILVLQKKVIRIITNSDKLAHCKPLFINLKILTVINLYIYTALLHIKSNLSEYQRRGDVHSHGTRNSSHLDIPYYRLSKSLNSYEVVGMKMFNKLPQEWVEAPLDLFKHKLYCWLAANPCYSLNEFYECKISWYLLGECTIISLMESFMMQCFKLYYFKYLILWKTYSDLLIFALCKVICIYALPYVK

SEQ ID NO: 3236 - protein, 1754 aa, synthetic construct
  source 1..1754: note = Description of Artificial Sequence: Synthetic polypeptide
  VARIANT 825: note = Any amino acid
  VARIANT 1543: note = Any amino acid
MAPTVQPSSVGPKGHQTHSASLKVGGPSFIAPPVPWWGGNTSPPPSGTQVPIPQPEKQQPSPAPLAREEKSVGMLPSPVSKSRLEDPSRSLGDAHTTGRRASRSSSAPETSEKPSQWSKPKEQREDKQKKKRSKKKSLPTALPPSVSQTSDSEDGLEMLASPEDLALTDLPESMDIDATSTKAAAKGDTEAGINSMFMTLMASQYANSNILQWNCGGYFHRLAELRHLLCQFPVLCVALQETWFPVQRIPALRGYRGYYKNRAAYDRVSGGVCIYVLANVPSAPVPLHTALEAVAVRIRAGQEITICSLYLPPDKAVSSAELAALVAQLPPLYLLLGDFNAHNPLWGGTEITARGRDVEYLLAQLNICLLNNGAATHFSLAHGTYSAIDLSLAVQAYFHTLLGGSMTTFVEATISLSCRSHSHHLQAACPDGHSVGQTGRLTPRLLQQRSRHTLQLGPWHLLSHRSVPCSPSLLPHLTWRVHDDLCGSDHFPLLSLPQSPPAGCLPRWSLRRANWPAYTSAATVTSPLPDDVDLAVDDVTRAIVSAAEATVPKSSGLLHRKSVPWWTPEIAEAIRERRRALQRHRRHPSLEHLIAFKRLRAQARRLIQQSKRDSWERYAATIGSRASPTZVWKQVRRLFGHRPLAGIPSLHIRGTLSTDPAAIAQYMADIMLVARHLHLTVRTSAPSKSVLNSGSFPFTCAARKNTMRHSVSGSLRVPAPFRASSTGRNPQSSHSGYSVHRPSCYRAVHGRHYARSSASASYSADFRALKERVEQRQLSFHMRRQEKYNAPFSEWEFESALAACPDTSPGPDSVHSQFVRHLPAXFQQLLLALYNHLWVKGAFPSQWRDSIIIPVMKPGADPQVAESYRPISLTNVLCKIFEHMVSRRLMWILEDRGLLAPQQGGFRHGRSAIDNLVSLESAIRTAFTRREHLVAVFFDLRKAYDTTWRHHILATLYDWGLRGPLPTFIKNFLSLRTFRVRVGTSLSTHHIQENGVPQGSVLSVPLFLVAINGLAAAVGSSVCSSLFADDFCLYYSSASIGVTERRLQGAIRKAQSWASAHGFTFSASKTRVMHFCRRVVHPDPELYLADEQLHVAETHRFLGMLFDNRLTWGPHLRQLKQKCWRHLNILRCLGHTAWGAGRQTLMHLFKALILSRLDYGSQVYDSASPSALRILDPILHGGVRLAMGAFRTSPVPSLLAEAGIPPLRFRRQQLLASYVAHVHATRLTIQIAGFCFQTPSFPLHNIDPDQVFQSRSGYVLSFPHSSPYLYLPHSPANLISLLGPSLAYSSTCNCPAIQRRRFHHIHFINSFWTSLARSVMQKSYTLMAPRSWHPSPEVSPATVVGFICRPRSCYTPHHPNRRLLFPNTVLPSPQHRPRSGLPIAVRVRTLLSSLESLPLPPAFSCQSHIPPWSIPRLQLHLQLSCDPKASVSPHTLHQQFLDILGTFRDAEVIYTDGSQVEGRVGYAYVHGDHIEQCSLLPGCTVFTAELIAIIRALDHLRTCPRKSYVICSDSLSGLQALDQCFPKHHLVRSIQDSVFSLGXSGRSVAFIWTPGHIGIPGNERADQLAKQAIASQRLDIGTPERDIRLGLHHKISMAWNSEWSTLSTPNKLCAIKPSTAAWKTSLRPSRRDSVVLCCLRIGHTWLTHGHLLHREDPPNCRCGALLTVVHILLDCPLLAALRQSFNLPSALPSLLADDASMVDRVLGFIRAAGFYHMFNGGYLTFRRPPLNSFNLLFLLSCQSYFQLAALVCTG

SEQ ID NO: 3237 - protein, 848 aa, synthetic construct
  source 1..848: note = Description of Artificial Sequence: Synthetic polypeptide
  VARIANT 183: note = Any amino acid
  VARIANT 301: note = Any amino acid
QWNKVRQLFHFKGLYISSTGFERKNIYKGTWISPDGRTVNQIDHVAIEDKLKKWITNVKTARGQSVVPITFCSKNSKGAECGSDHFLLKIDLRVGWKPKLTKKLQKVVHFDYNKLVTDEGLQDNFRINLIVLKPWQHCYRNPGNIATDSLDAGSLWEGIRDLTETAKEVIPKRMNRKKVWFDXECELAILERQRAKQVWIQSARGRYEEGKERFDEARRRTQATLRRVKRNYFKNIMVEAQKDFHGNKSKELFRKVKAIKGEGKKHGFIKDRNGRVLTNNNDIAIRWMEYFDELLNCEEPXETLEFEEPVTVDPEYPLQHSKKGTCNCGSGIPPPTFEEIKKNIKELKNGKSAGEDGIVAEMLKSGGDSCIQNIHKLVRKIWQEEVIPEDWKVALICPIHKKNDKMLCDNYRGIALLNISYKVYSKCVLLSRIKPLAEELIGEYQGGFQPGKSTTDHIFFIKQVCEKMYEYDKEIHLLFVDFQKAYDSIHRTSLFKALIEFGVSKKLVRLVSLCLDDTRAKIKLGNRTTDSFRVTTGLRQGDSLSPILFNLVLEKIIREMDSFNHQGIQVANRNITHLAYADDIVLMTHTKENLKCNANDDHGKHSKQIWTESEPHKNQIHDSWKSPTPRNPGINCGNNTYKRVKDFKYLGSIISENSSSGMEIKARIQAGSRCLHSIHNILTSRSISRALKLRLYKTLILPVILYGCQCWSTRKQELNRLAVFERRCLRKIFGPVKDNITGEWRRRHNIELEQLYSEPNIVGLMRSRRLEWAGHVVRMSEERWPRVAMEMIPTGKRPLGRPRKRWMDGIREDLQKLEAWKNWEQTAKNRNEWRALIISSRGPLGLIA

SEQ ID NO: 3238 - protein, 1416 aa, synthetic construct
  source 1..1416: note = Description of Artificial Sequence: Synthetic polypeptide
  VARIANT 355: note = Any amino acid
  VARIANT 420: note = Any amino acid
  VARIANT 424: note = Any amino acid
MAPIEKCSGTVLSSKRQKISSSSCKECEKRVMKGIMCVKCNYWLHEKCAKINLKYISDDFPWTCHACLSVETADLVSLVESKNEIIKLLQNDIEALKTEILCLKEENARLLQEKQCTVGEIHQEKQQDCANTCAREIQQTKKETRENTYARNTDVVNENISSAVDVTVNPTCKKPADKYKWKLVTYSKRKEKTTARPTQEDENEFLIIGDSLLKNVAVPNSKIDVRPGIRTQQLGKHFKNLENAKSAEPDCEPKHNYRGVFVHVGTNSLRSSSEEEIINDTRNVIRSARSVYARSKLVISGIIKRRSVSDKYISQINCAIKEQCDSLGAIFIDPNKFLCENCLGKDGLHLNRLGXVTLSRMFTDVCKIIRNEGNGKLRWTDGGDKSDILAEKANFKHHSKVKEIQNRIPEQMPQHLSQQXENYXKVLHQNIQSIGNKKLEVEILLSELQPDILCISEHGLTENQIDNLKISDYTLASYFCRSKQKSGGVSIYIKTGKLETANNKGVKLPTVKEKDFEITGVMIEGLSVFCVYRSPSGDISIFLKKICMNMKRNIIICGDINIDMGKGSKIRQDFEELLLQYHMEATISTPTRVTSHSQSVIDNIITNISRSDYESHVIQTAITDHDGQMFYLCRRHGRACETKAKIKEIRVMSEQNINTFRTILSRETWTETLQAQTVNEKYDAFIATIKFHFEVAFPKVKRQIKVQQQQQWITREVLEQRRKLQELRQVGDVEGYKTLQKTYRKTIRKAKANSINITILNSKNKIKAAWNVINTERKENAGPNKETEIRSMKIDNRIVTDGSKIANILNDNFINVVENLKLERKSPKKKGTKVTKYSYSTMFLRPVTEDELRKTIQKLKAKKSAGDDEISNHVIQLVSEQHTHTISRYSKQLFQRWNFSREIEDKVSNTLTPLVDIANSSFRDGIFPEKLKTSKVVPVYKKGNKDDPNNYRPVSLISGFSKILEMLMYNRLVDYLDKHNILVPSQHGFRMGKSTESAIASLTEYVIQCLDEKRVVAAMFLDLSKAFDTIEHDILIKKLENYGIRGLSGEWIESYLCNRKQYVSIGNSFRSETKTIKYGVPQGSVIGPLLFNLYVNDIGGEEKEKKILYADDMTVLNHGQNMQQLERSAFISANTTAQWLTENELVINLKKTMFTVFRNKEKSVQMNLKVNDMYLEEVESTKFLGVIVDNELKWKEHINYVCKKLSSVIFIMKQLSQYADKQLLCTVYHGLFEPYLQYGVTVWGNSNIQETKKIVHFTKESNQDHTKKKELGDLQCGETQTSKKRKKLFTLQKKAIRIILRRKNSETCRNCFKSLGILTFTSLYIYKTIMYITKEISLYDTNASVHTHNTRGKNEIRNIPHRLTILEKGPRYSGIKFLRNLPKNLRDNIHGNNFSRKLKDYLMEKEFYSIEEYLLN

SEQ ID NO: 3239 - protein, 939 aa, synthetic construct
  source 1..939: note = Description of Artificial Sequence: Synthetic polypeptide
  VARIANT 90: note = Any amino acid
  VARIANT 272: note = Any amino acid
  VARIANT 662: note = Any amino acid
MDLVLERPHTKYGSAIFVKSGLSIQSTGLTSENDVEILTVGFQSCTVTSVYKPPNAEFKFVEPLNFQSQPIKVVAGDFNCHSTSWGYREXDKNGEDLEAWAEQMGLVLIHDPKLPSSFNSGRWRGQYNPDNIFVSNHIAQQAKKGVLGPLPHTQHRPVTCTVAAVVKPETVPFKRRFNFKRAQWEKFSIELDKEVIKLEPSPEMYDSFIQLVRTISRRNIPRGCRTSYIPGLDKDSKSLLQKYEHLFETDPFSEETTQAGEELLNAVSATRXQKWCDMVTQLDMKQNSRKAWKLLKRLNSDPTSAPPSLVNVTPDQIAHQLLLNGKTKRRTAAKKFQRYTDEEDYLGTPFTIEELEVVFKSMKNNKAAGLDDLRPEQIKMFGPVTKQWILNLLNNCISKLQIPKIWRKAKVVALLKPGKEPTDPKHFRPVSLLCQLYKVLERLILNRISEHVDKNLINEQSGFRPGKSCCGQVLNLTQYIEDGYERGQVTGVAFIDLSAAYDTVNHKKLMRKVYSVTKDYRLTQFIQCLLQNRRFFCNSAHSSSSVCCKIGGFFVTLHNKKSRWRTLKNGLPQGSVLAPLLYNIYTNDQPISSEVRTFIYADDTATAAQGKTFEEVEMKLTAALEDLGKYYDDNHLKPNPGKTQVCAFHLRNKEARKKLKIXWRGQQLLHYDTPKYLGVKLDRSLTFKDHCQETKMKVSARNSIIRKLTGSTWGSQPSVLRTSALALCFSAAEYAAPVWRNSTHAREVDTALNETGRIVTGCLRPTPVRKIYEIMGIAPPDIRRRTAAETEKKKQETDPRHPLFGHEPRKPRLKSRRSFMSTTTSTALRPGTRRTELWQNSSNERAGENIKEEPAEGFHLPYATWKALNRLRTGVSRCKTNLRKWGFTNEDELCECGDVQDPQHLLVCRNLPNPCTIEDLHAANDVAIKTAEFWSLRSI

SEQ ID NO: 3240 - protein, 1773 aa, synthetic construct
  source 1..1773: note = Description of Artificial Sequence: Synthetic polypeptide
MKRVKLDNGRDTAVSEGRKKNNAPSYDKRTFPSLSTPWEEGQARRLGVKPFPRYLVCTRTDGGTFTATKPLFFVEHIEDKFGEVETMSKMRTGSLLIKTVSAAQSAALCACDHLGDVPVSITPHQSLNMVQGVIFHRDLLLQTDEELRANLERRGVHFVRRVQRGPKDHRVDTGAFILAFEGDTLPEKVKVMIYHCCDVKPYVPPPMRCFRCMRFGHMSSRCTAVPVCGECGRPLHEGNPCVPPPVCVNCHEHHSSRSPECPVYKKEKKIQEYKSLDRLTYQEARRKFERLHPVQLSTSYASVTSFTPPPSSSHSHPILPPPPPAPPLPPSQRPPSSSQPEKCSPSLALAGEGAPSQGSSSRRPPDRRSSASSRQPDIQADNTKVARSSSVPDLTDSSSLSGTCPSRPAREKEKEKRKKKQKSQDKAPPVVLEAPPLSSQPNNPTELVSDPLFMDVVPPSSVTDVDPALPSFVTCISPFAFHMDPRSVLIQWNCNGYYRRLLELKHLIASYSAACVVLQESHFTDGHSPTLRGFRAFCRNRVRPLQASGGVCTLVRTDVVSSWIPLRTTLEVVAVRVHLHTPLTICNLYLPPDRPPTSAALTALLQQLPPPFLILGDFNAHHLSWGSAYTTSRGRLVDQFIADHDLCLLNDGSPTHFSAAHGTFSSIDLSLTSPPPPFSLSFAGHRMTTFATVTTFRCRSRHLFLHRPFTHFSPPPLFPFFRWSPHDDLCDSDHFPLILSLPSHWTRDRIPRWVFRHADWPLYTSQVVFTPSPSDSIDEVISDVSNAITRAASIAVPQSTGPPRRRPVPWWNATIASAIRERRRALQHLKRHPSRAALVNFKRLRAKARYIIKQSKRVCWERFLSSLGSSVPLSRVWAMLRSIQGCQRPSSIPGLALPDGVCTDPLVIAEHLAAHFAKASATASYPVAFRLKKQQAEASNLCFTTHREEPYNKPFTEWELRLALSSSHDSAPGPDSIHNQLLKHLSPPQRQYLLQVFNHIWLQGVFPSQWRDSIVVPVIKPGKDPSSLDSYRPISLTNVPCKLLERMVARRLCWVLESRGLLSPYQCGFREGRSPIDHLLRLETAIRKAFSKRQHLVAVFFDLRKAYDTAWRRHILCTLHDWAYEAPYQFLSVSFYPAACSVLGLRGSLPIFISQFLSRRMFRVRVGSSFSSPQIQENGVPQGSVLSVTLFLIAINGLVSSVGSLVTPALYVDDFCIWYSSHSVASAERQLQGAIRRASTWALSHGFQFSPSKTRVMHFCRRTTVHPDPELFLGTQRLEVVAQHRFLGLLFDKKLTWLPHIRQLKISCMRKLNALRFLAHSSWGADRTTLIHIYRALIQSRLDYGCQVYGSAAPSALKLLDPVHHCGIRLATGAFRTSPVDSLLAEAGIPPLQTRRHQLLVSYAIAIRKFPGHPTYHVLFEGDGLRTPDTRPRVGLPVGLRLASLCRDFNLPSLDCMRRAIPRTPPWLVPRPQIRLDLYHAPKASVSPIIFRRLLHTVLEEFQGATIFYTDGSKFAGHTGYAFTSPIGVECHSLPESCSVFTAELTAISRALHFIKQVALDRVLICSDSMSSLQAIDRCYSSHPLVIDIHDLLADLRRTACSVAFLWVPSHVGILGNEQADQLARVAVTPCPFPWVIPGADLRVQMRSLLIQDWNTNWQATALSNKLRSIKSTTAAWSSSLRPSRRESTVLCRLRIGHSRLTHGFLLRNEPPPHCGCGALQSVAHILVECPLLLALRAKYGIPHSLPSVLANDSRIADRVLGFIRESGFYSRL

SEQ ID NO: 3241 - protein, 969 aa, synthetic construct
  source 1..969: note = Description of Artificial Sequence: Synthetic polypeptide
MDNYRILKGRPAIKVKKTEKTKNVVLILGTAFFIHNSITESIVEFRSPSPRLPVVTLASGNKLYTIFNAHAPINEDNRKNPEKVEEFWSQLEEELFRTPDKHVKILMGDFNAQIGKERKFRNIVGKYVAHRRTNRNGERLIDVCESFGMKIMSTQFKRAPKQMKTWRSPNPMLGEFQIDHVATTSPKEIMNVRVQKGANFDSDHYLTRVKVKPIPGNRRRKTPRIQKYRIEELKISEEIVVKYQHELDTLNSNEWDKMAQKIQEAAKQTIFLAKKKKHPWWDDECEDALRKRSEAWNKWNSTKQNFEEFKTQRRTTAKVFRNAKRKFERDQLKELEENFQKNNTRSFYQTFKSKLRGYSSPNICLKMIRANRLLITQHLFKNDQGKLIMNNKHNCEHLARYFKELLNCDPPPEKLTFQKPQNKLPDSTPPDKKEIREIIRGLKNNKVSGKDSIVAELLKYAGDSFLERLERLFQKIWLTGEIPEEWRDAVIHPLHKKGDKSNVNNYRGISLLPVAYKILAIALKHRIEQHIDQQLGEYQAGFRTGRSCAEQIFTIKTLIKTKALAADKKVIMTFVDFKKAYDSVDRDTLIEVLKEFGIDDKTTRLIQQTLTNTRSQIKFLGELSEPFEIKTGLRQGDSLSPILFNCVLEKVIREWRKEMSQFNFPNGIRLGRKQSGLTFECLAFADDIVFFAENLQIATKQIEVLKETAVKAGLQISFEKTQYMNINATDPVWTMRTKYGDIKRVQRFKYLGEILTPNNNEKAAIEERARKMEIAFRLCQNTYKSKSLSYQAKFRHYSSVVKPECLYASETIARKGLSDLEKKERKFLRKILGPRKISNEFTFRLRSNQELYQRFENITTTMKKRRLSFYGHIKRMKSERLANKILLFQENRKTQVPWVKEVHRDLEKCGITAEEIVNRQIFRKKVAEVKDFFEEKTRKNRVFSAEERARVSQRMKEYWRKRKEENFRK

SEQ ID NO: 3242 - protein, 981 aa, synthetic construct
  source 1..981: note = Description of Artificial Sequence: Synthetic polypeptide
  VARIANT 355: note = Any amino acid
  VARIANT 557: note = Any amino acid
MMKGPFSEPCLTAISLNIEGLSTEKEQLISNTCKLHSCDVLCLQETHRGPSQRRPRIPGMILVKECPHDQYGSALFIRPGIKVSNIRFNTVNNTEIISVIIGSITVSSIYKPPGERFAFSQHVCHPQLVMGDFNCHSKVWGYQDTNEDGELLESWAEEQELNLIHDQKQPASFNSARWKRGYNPDLIFVSKTLSGSCNKFVLNPIPKTQHRPIMVKFRPVIVPQEVSFKRRFNFKRANWKKFADILDKEIVYLPPNAENYEKFVEAVKRSARLSIPRGCRTLYIPGISNKMKQLYNEYIEQYNHDPFSVETIKLGEQLTETISKDRQESWKHMLESLDMKHSSRRAWNLLKRLSXDPAAPKDQVSVTANQIAHQLLLNGKPTRNSKIVTSYKRPQVDEIPPVPYFTSIELETAISSLKSRKAPGPDDVVNEFIQNIGPIAKEWLLQLYNFCWANKSVPKLWLKAKVVAVPKPGKSRDDAKNYRPISLLCCPFKLYERLILNKIGPQLESQIIPQQAGFRPGKSCTGQVLCLTQYIEDGFQKGEKTGVVFVDLSAAYXTINHKILLENFSKKIFQNEGNYHLTEVVRSLISNRRYYVEFQEQRSRWRNQKNGLPQGSVLSPLLFNLYTNDQPAGPDARSFIYADDVAIACQSRSISHIERNLSDALEVLTEYYNRNQLRPNPAKTQTCLFHLNNQEAKRELQLEWNSVKLKHCPNPVYLGVTLDRTLSYKSHVEKTRAKIYTRNGIIRKLTNSHWGANPEILRSSSLALCFAPAEYACPVWRRSTHAHKLDTALNDSCRLITGCLKPTNRDLLYMCSGIAPPQIRRQTWRWLKEADSARIEDIPCSDISQWCKIKIEERFHFEHPLNESQSTTRESMWTQKLEKKKKKNSLQCWNIKEKLPAGSQLEWRVWKSLNRLRCRMGRSKDNLFKWGYAEDELCQCGEKQTMTHLLSCPSLPAPCTFQDLWLANDAAVKCAEHWREI

SEQ ID NO: 3243 - protein, 1210 aa, synthetic construct
  source 1..1210: note = Description of Artificial Sequence: Synthetic polypeptide
  VARIANT 85: note = Any amino acid
MPRKFFRPKMFTHGKPHETVLQVPPNNRFSVFEENTNTVDSFATVLNNERVSANTSRKIGKKCVKVNIHADSHGRGLAKILCEDXDVDAYSYVKPGAPLYEIGKNIKDGSPMNSNEYTVIVGGANDVYKNELSSAIQNLNIILESNNSNAMIILGIPHRHDLIYESCVNKEIAKANKQFENICNLYPNTQFLPIDFLQRDSFTRHGLHLSRKGKKLLCFKIAEMVSANTKKGSNSQKTVQTSVPQQPTQSPSAQLYNINATTKTPTDDPILPESTNSPPSVDSIEPTSVAAMPGLIVDTTVTPASHQEEDIWASRIVPEPMEEASSTPEDSSQLLKIQGFFMVSSQGRKNSVIATPPSKPNVNTKREINPINHPKTLVSVNKLTVFHQNIQGLRSKLDEISINILDKDCIDSADVICFSEHFMKLDTDSLQLDSYNLAALYCRQSLEKGGVVIYVKNKIVHRSLDLSDYCIDQHCEVCGVVISTNLSEITVLSCYKAPAGKICIFLKQIVSVNSYFLQKQRILLIFFAKTKNIIVLGDFNVDYLIDNMGKNDLSHVMSSFNLTAQVDFPTRVTANSISRMTISSPNDNIFLDKSRNPNTIVKRVLNGLSDHDGQLLSIEGVGPLSKNKSYSKTFRAINSQSINTFCDLLQETDWDQIEHLDNVDDKYNAFLNEFICLFEAAFPKRTAKPKHETYCHKNWLTRGIKTSCRRKRNLYASLKSCFSLEKEKHYKLYCSILKKVIRAKSNSIKSEIDVSSNKIKTIWGIIKRETGKIPITENSLEIKKMMSFMIMLKKNDVIHDNVEIITDIFNSHFLSSAAQTGKTCSINEAMLFLQKSIKKQSKLTCLLSQCMKLRLKTKQINMSPVTVHEIEVIIKEMKSKNSVGIDGISSRILKHCYKPVSKILCHIFNKSIQQGIVPERLKYAIVKPLFKKGDKTDVTNYRPISLLTIFSKILEKLVHKRFIDHLTQYKLLNSSQFGFQKGISTDQAIFSFTNQILESFNNKLSPVGIFCDLSKAFDSVNHEILLEKAKHYGFIGSAGKWIKSYLTGRKQKVMLNNSEGHSVSSSWGSIGCGVPQGSVLGPLLFLIFINDLPLCTSLKTHFTLFADDTSILINESSNYNLEESANIVLREALNWFVINGLALNANKTQIIHFQPSKKMEDPITIKCNGTDLLQAESTKFLGIHIDSNLKWSEHILQLHKKLSSATFAIR

SEQ ID NO: 3244 - protein, 769 aa, synthetic construct
  source 1..769: note = Description of Artificial Sequence: Synthetic polypeptide
SNRAKNICAQASKALLRERIRHIRSSLDSSNRKLIELHLALSSKLAEEDWEKVDRLTFQQAERTNDSVATRQMKKFDNLQQKTTGNGQTMDTQRTVVNLSSHELSDAATQILSKGMNFAITPRRVPKEDIIESVEASLRHLPQAEAEKIRQETVRVLAHAKPPKQNISNEERRAIIELKNNPDLVVVQSDKGNATVVMNTTDYDDRMEKLLSEPIYKKLKGDPTAKVIKQTQALLKKTRMNFDTARRLNPQVPQAPRIYGVPKIHRESFPLRPIVCSIDSPTYRLAKELVPKLQHLVGHTDSYVKDSTHFVALLEEKRISTTDLMVSFDVKSLFTNVPVSDTMNILEERVPPDVCDLVQHCLTTTYFRWKGEFYEQTDGVAMGSPLSPVAADIFMEAFEETALQSAPLRPDCWLRYVDDTFVIWPHGEEELQNFHQHLNQQHNKIQFTMEIEKNGVLPFLDVEVYRKPEGKLGHRVYRKATSTGRYLHATSHHHPTQKKSVLHTLTKRAHRISDEQHLKAELQNIRSIFEANGYGKRMIEQTMTSNDGNKREEQKEEQTIALLPYVKGVTERVGKILRREGIKPIFRSNNKIRDVLGSMKDKTDKLHTAGVYEIGCECGQVYIGETGRPINTRIAEHERYIRLGQHTKSAVAEHQEECGKQIGFQEVTVLAKQPYTLKRKIREAIEIAKRPGNMNREDGYRLPASWLPAVAALRDDTARSAVHRGPHSPETTAAARTQSKQHALAGARHQCYVTATTAPHSPVSTNGKH

SEQ ID NO: 3245 - protein, 1361 aa, synthetic construct
  source 1..1361: note = Description of Artificial Sequence: Synthetic polypeptide
MARNCDCCERMEAELVTLRSQLQAALASLATLETAVGGRRCCGPLAGVQQTPCASVVPSDRPAAVASPLTAREGVAPQSVVDWEVSSARVRRRKTSRGTEVEASPVSLANRFEALSVAEDVPDADGVACPVLAPLPSRSGHSQRVGLLVVGSSNVRRVMEPLRKMAAREGKKSNVHSVCIPGGVIPDVERVLPDAMKSTGCSQLQVVAHVGTNDVCRFGSEEILSGFERLSEVVKTASLACKMKAELTICSIVDRTDCGPLVQSRVEGLNQRLRRFCDRVGCRFLDLRQRVVGFRVPLNRSGVHYTQEAATRVAGAVWRGLGGFLGVRSPLYSGSGYTGSGGCVAWTGRFFRLEGLGNTQNGFQSQRGQVRHRKKADLGTIGVTVVNCRSCVGKVPELQALIESTEAQIVIGSESWLTPEISSAEIFSKGQMVFRKDRINKKGGGVFIAVTNGLSCSEIEADTSCELVWVEVIPDNRNKLIIGSFYRPPDSDDAVAEMFKESLNHISNRYPKHTVIIGGDFNLPSICWHNYVFKTGGKYKTSSELVLNAFSENYFEQLVHEPTRIVSGCENTLDLLATNNPEIVKSIKTDTGISEHRVVVARLNVEIPKCTKNKRKIYLFNKADKNSLHAFLSDSLQSFKTKNASVDQLWLTFKDIISVAIERFIPNKLIKEGADPPWYTKQVRSLLQKQRKTHAKFKKTQNPQDWQSFTETRNLARTSMREAYSSYHNEILSRNLAENPKKFWSYVKYTSGKTQTIPSLRDSNGNTTDDSTAKAELLNTAFRNSFTKEDEVNTPVFNPRTAASMRNLEVDVPGVVKQLKSLNKNKSSGPDCIPTRFLSEYADAIAPYLAIIYNRSLSERSVPKDWKVAQVTPIFKKGNRSDPQNYRPSHSPKLQAISLTSICSRILEHILCSNIMNYLEENDLLTNSQHGFRKYRSCETQLALYSHEVLSAIDKGSQIDSIFLDFRKAFDTVPHKRLLMKLRAYGISPQLCDWIHDFLSERTQFVVIDGKSSSKTEVISGVPREALNRSDIWRSQGSVIGPLLFLVFINDLGDNLNSSLRLFADDAVVYRLVKSTEDQKQLQSDLDKISTWCENWQLTLNKEKCEVIHMTTKRNPLNFNYAINQSNLKVVNSTKYLGVTITNNLTGENTGRKFYQIPRSYNYEQLDWREHIENIVGKANQRLRFIGRTLRRCTSSTKETAYITLVRPLLEYCCPLWDPHQVGLTEDIEKVQRRAARFVLSRYGGEASRKCCTNWGGNHEGSEKGSSFCFITLRGGSVTEMLHELGWKSLKERRYSLRRDLFAKFQSPTFTSECENILLAPTYLGRHDHPNKIREIRSKTERFRCSFFPRAIREWNGREKL

SEQ ID NO: 3246 - protein, 981 aa, synthetic construct
  source 1..981: note = Description of Artificial Sequence: Synthetic polypeptide
  VARIANT 428: note = Any amino acid
EQQCMPQGTCSDDQACPHKSWSVKSQPSFLTTGMNLCNYKPVQRLEVKDCGSMSFFHLNIQSVRNKLPELELFLLEFQCDILCLMSTGHTLSNEHWLKEHEHNMYTPLGYKFLTGFFRSNIEKGGVSILMKNDLNCKIRIVDLKHLASEGQIEIAAIHLPPSADTLKSHNFSCLNDKPTRQNACLDNVISNLSRDDVNLNVVKPMLSDHDGILLKLIVPKKDHRPTQPIVNRPVRQLKPINITNLTQRLLTFDWDATVMENTTLNNAFDYPPQLIIMLLIIRPNLFNEYCPPPPSTKVKYKEETKEKLTMVHPHLNSLRILLKIYYEKSCTDSEYRHSYNKLKNIYKKDIISAKKEANGTYISQATNKCQAAWKIIKAEAGLQVVNPPIPRADELNKNFINSGQSAIDHSNLDDNADSFLSSLETELXVDKLKFRWHAIYPKDILDVARSLSNSRTEDIYGLSNFTIKRIIEAICIPLCQLINRMFLEGTYPDCLKQTIVLPIYKKGDRTSPQNYRPIAIVPITSKIIETIMKNQLNDFFCNSLLNKAQYGFRSGLSTVKAVQEVVHSVLHGFENRQHSYATLVDLSKAFDTVSHGILTKKLETYGITEKELALLKSYLANRNQMVLVNSTNKSDPLKVQYGVPQGSVLGPFLFIVYVNDLPNLLPFKSVMYADDTTFITSHNDVNAVKQMNNSMMEKATQWFQENRLTLNNNKTEHILFSLGNINNEQNHPVKLLGIYLDSKLCWNTHTEKLCSKLARVLYLLRKLKDCVSKELMLMAYYAFFHAPYIMEYFFGETPLERKKSSSGKRKPSDAFLARTHAYGILCFFPCTLHYGILLWGNSAGAKEVFLWQKKAIRCIFGLSKLTSCKQYFVQHKILTVPSLYVLKALMHARQNVDEYESRSDVHLYGTRNRNLLDIPWARLSKVKNSFLHMAKIFFNKLPYNIRELHENKFKIVIETWLKEKALYNTNEFIWTENKSCY

SEQ ID NO: 3247 - protein, 555 aa, synthetic construct
  source 1..555: note = Description of Artificial Sequence: Synthetic polypeptide
  VARIANT 315: note = Any amino acid
KLLLNAVIQLLRKGLHYEIPRESGIVVLKADKGNSTVLLPRRLYLEKMYGLLSDTMYRKIEHDPTARVQRKTCTLLNSSSLAPETSSGPYSTCATEDVHTFEFFLVSSRDIKRLRPHGSVPPRLYGLPKVHKEGIPLRPIVSNIDAPTYDLAKHLASLLRPLVGKCTHHIRNSADFINRLGALHLSSSDLLVSFDVVSLFTKVPLADSLALIGKRFQSDITGLFRHALSSTYFMFNQEYFEQTDGVAMGSPLSPLVANFFMEDFEERALESAVCKPTVFWRYVDDTFIVWPHGEDKLMEFLHHLNSIHENIRFTXELEKDGCLPFLDVLVKRKSDGSVGHSVYRKPTHTDSYLHSSSCHHPSQTMSVLKTLVHRAHTVSDAESLPKELAHLRTVFRDNGYSTRQINRAFSPKTRNREVDKEENAPAKSLAFLPFVGNVSFKIGRILNNYQVKVIFRPPSKISTCWDQDFDLLGSVKDDLLLRKAGIYKIPCECGMAYIGQTTRTWKNVAQNINVALAFCNPASLQLRSIVFPTDIQWSMIKHQFWPQQHPSGTPL

SEQ ID NO: 3248 - protein, 487 aa, synthetic construct
  source 1..487: note = Description of Artificial Sequence: Synthetic polypeptide
VLCHIFKLFEKVLHDRLSKAIDNYLIPQQAGFRPGKSTTSQVINLTQLLEDGYENRKITGVAFIDLTAAYDTVNLRLLMKKLYAITRDFKFTSIIRSLLQNRRFSVEFQGKQSRWRAQKNGLPQGSVLAPLLFNIYTNDQPLPAGTENYIYADDRAMAVQGDSFEEVEKRLTDALDALCQYYADSQLKPNPSKTQVCAFHLRNKQANRKLRVSWKDTPLEHCANPKYLGVTLDRALTYKQHCINTKMKVSGRNNILRKITNSSWGAKPEVVRTTALTVCFSAGEYASSVWYNSAHAKQVDIALNETCRLVTGCLKPTPIDKLYHLAGIAPPAVRREAAAYSERARAELSESHLLHNIQPATRRLKSRRSFLRATDNLSDQPGSRVDRWKRSRERHWMEPKEELAPGHNEDWTVWKSLNRLRTNTARSRDNLMKWGYSTVSNLCDCGDVQTTQHMYNCPECPSHCTLEDLMLATPNAVDVARFWAKCI

SEQ ID NO: 3249 - protein, 937 aa, synthetic construct
  source 1..937: note = Description of Artificial Sequence: Synthetic polypeptide
MDRRKVKILGLSETKWKGSGKKTLRNGYILHWCGSQTETRNGVALLLHKDVAIHTDIRYVSDRIIQMKLHVDNTYITIFQVYAPQTGCTADEKEQFLENLEDLIVEDNVIIMGDLNAQVGKERQGCENIIGPHGYGKRNPEGEQLLDLCVRNKLIIKNTWYQKRESHKITRYSWDGQHKTVIDYIITDQKASQTVKVIPSECMDSDHRLLTADLKNVRVPLVKYKKMPKIKTWLLRDPEKKQEYQKKIKDRIPKTEKLGVEEEWKLFKDTLVTEAVHICGKTSAAQREKETPWWNDRVKTAIKERNVLKKKLDREKQNRVDVRNDTEIERLSQEYRNKKLAVKRLIQNEKDKCWDDFTTKLQEDCQGNKKLLYKLVNDKRYERTNIVVLETEEGKLLRTESEIRSEMRNHFNSLLNGNVDSSDDSDCPAEETPEVLQPLTWLEVESALRNMRNGKSPGFDELSSDMMKAAGTPGLQWIYRVLSVIWTNNKIPDDWTKGIIIPLFKKGDRKKCGNYRGITLLSHTLKLLEKIIETRLRKIVEPLLEEEQHGFRKGRSTIDLIFAVRILAEKYWEHGKNLVMVFLDLEKAYDSVPRNKIWKCLEDLKVPNYLIDRVKMLYQTCNSSVQIGNGRSEWFETKRGVQQGSALSPLLFIIVMDRMLKSIKETANESRSLVFADDVVIWGETEKEVQKSLTVWNNKFKEFNLKISKTKTVEMTINREGTSSNIYLEGTKIKSVSHFQYLGSIFSKDNTIRQEILNRTQKASNFYMQVRNLLWDKKVPQAAKLTLYNTYFTPILIYGMETCTLLKKDYSRIQATEMRFIRTMNQSTRRDKIRNEVHRETAGIRVPIANILGKRRLQWYGHVMRMDSTRTAKKYFRMEVGGRRPRGRPRRRWIEAVKSDIEKNGFNWDDVQDQMLYQDRMRWRALVSHTRETGDGK

SEQ ID NO: 3250 - protein, 512 aa, synthetic construct
  source 1..512: note = Description of Artificial Sequence: Synthetic polypeptide
  VARIANT 393: note = Any amino acid
MGIPLRPIVSTIGAPTYQLAKHLTSVLSPQVGKCEHHIKNSAQFVERIRQLRLSNSDLMVSFDVVSLFTRVPLKESLELIEKKFGPSFTKVFNFVLTSTYFLFDGEYYEQTDGVPMGSPLSPVIANMYMEEFEDKALNTAPLKPTIFYRYVDDTFVIWPHGEDELQVFLQHLNSIHSQIQFTMEVEQNGQLPFLDVLVRRKPDGTLGHSVYRKETHTDQYLHASSCHHPSQREGVLTTLVHRARVISDEESLKPELDHLKEVFQENGYSDRQIRRAFKHKSTPQPTPEEDPPAKIAYIPYAGNVSGKIGRILRRQNIKCVYRPPAKIKSLLGTVKDDLGLRKSGVYHIPCECGKAYIGQTIRTIEERCTEHKRHTELQQPTKSAIAEHCLETXHKMKYEDTEVLHNTSRYWDCLYKEAIEIRLRENLINKDSGFQLSHAWNPALKFLRSRRKQNTEHSEGRAQTEVRHSSPEQELPPPPQHPGVRTRGQWRGVTAGIYSTAAGPAPQSAGVT

SEQ ID NO: 3251 - protein, 628 aa, synthetic construct
  source 1..628: note = Description of Artificial Sequence: Synthetic polypeptide
MSGTKSAEEKTCRRIRNKLKNEGALITKADKGTPWSGCPHHKGRQGNTMVIMKQDDYRNKTLTFIEDNNIHKLTSDPTQRFHKNTQTLLKSITHIFPKQKIKWLKQKNPKAPTLNCLPKIHKEHIPVRPVVNFRNAPTYYLAREIHSYLQKHYVFTNNRSILNTSELIQKIKHIIIPSTATLTSFDITSMYTNIPITETINIIKQQLQQQTDTPKSHIKETTNILKLITEQNYFTFDNQFYSQEDGLPMGSPVSGLLANIFLNHIENKIFDTIVKPKQYKIIYWHRYVDDIICLLDETPSRIQELHNDINNVHPKIKFTIETENDRRLNFLDLSIHRDKNQHKFSIYRKPTTTSTAIHKHSNNPITQKQAGFQYMLHRLNKTPLSDEQYKNELQTIKQIATENGYDTNIIDKLNHKIKAKLKGTTNTQKQTDQKHNTSTQNINPLNSHTPNTHTQEQKSNKTTNKWHTLTYDNKATHRIGNILKKQGLKVAYRTDNSIQRKLKTTNTNTDKHNTSGIYQLTCQDCNSVYIGQTCRNFNTRYTEHRRALKSNSHSTFAEHLINMNHKPTDINTDLKILKHSKSLPQKLTIEENYHIQKAIIERKEIINEYTALCNGTIFSALKELTENP

SEQ ID NO: 3252 - protein, 984 aa, synthetic construct
  source 1..984: note = Description of Artificial Sequence: Synthetic polypeptide
  VARIANT 97: note = Any amino acid
  VARIANT 174: note = Any amino acid
  VARIANT 220: note = Any amino acid
  VARIANT 305: note = Any amino acid
  VARIANT 403: note = Any amino acid
MMASSLKGSTTPGGNQSTIVKDNVSEPTDSGELTPTCKRLKSKKVSYFATFNVNSLLKIGKLKHLTDTLTNQNIAITALQETRYTDEAAFESEGFRXLKGKPGKRVMKNVPQLGTGFIINRQILGAITDFSSKSSRLSTLTFRGANKMYTMVNVHAPTNETNKTDPEKVEEFWXDLEETLSKIPTKNVIILLGDFNAQLGKERKYRNIIGNYPAHNRTNXNGERLVEICKTFDLIMKSTAFKRLPRKQMTWVCQILCKTDDMGMPNPLLGEFQLDHVAIPKRAGKEIQNVKVLRGANLDSDHFLXKIKIKIIPKVHQPRNTIRTVKYDTGKLKTSTDFKTSLSQKDYQGWEQLKDAAIEKRRKAWADWCSHKTLENLNKFQEVRKNTAKTIRNLKRKYEQARXTQIEEDFQKNNTRDFYRTFKTNLNRYDPPTLSFKNKEGKIVYGEMENSQILAEYFEELLNCEAPADTFSYNDTEPNPDSEPPTTEEIKNIINTLKNNKAPGEDGIIAELFKYANENVIIELKQIISKIWEEEKLPEGWTSALVHPIHKKRRYIPFTKKGDKTDPGNYRGISLIPVAYKVFSKALLNRVEKQLNPQIDEYQGGFRKGRSCAEQILNLKMIMAYQKQRCKKFVLTFVDFKKAYDSVDRQTLFQILKEMKLDRKSSELVRQTLNNTTSKVKFRGKLSESFKINTGVRQGDGLSPMLFNCVLDKVIREWRQGMKGVGGIRLGCKKKGIRVDCLAFADDIVLLSESLEEAVNQTKELQRQAAKTGLQISIEKTKYMTNITEAPGWMAIDRGKIQKVEKFKYLGEWIDTGLTEKDAMEARINKINLAYKLTMNIYNKKNISINAKLKHYQTVIRPEALYAAETLNLIRTGVIKRLELVERKILRRILGPRRTEDGQFRNRSNQELYSKIEKISNIIKKRRCEFFGHICRMDQGRLTQQISQFLLYKKSKIRWIQEVQRDLEEMGIRDQEIHNRVIFK

SEQ ID NO: 3253 - protein, 1084 aa, synthetic construct
  source 1..1084: note = Description of Artificial Sequence: Synthetic polypeptide
  VARIANT 852: note = Any amino acid
MSQSPVASSVAVVGNKAAVTVPLREDSPVASSVAAVGNKAAVPVTVPPQZASTATASTAPPNEEAAEKKKRSSREEEVVSSVAGRRKMVPPLRLKDFLVEGSKMKNLEISDLKHPIAPHQNVHSKGNSSSELKFATNLLPEHQGIKDKEFFVNDFGLDNNFDIFCFSEHWATENELTLVLDTYNIANSYCRKLHLRGGVAIYTNQSLSYSFTKLDLDYLCEEQNFEAAGIFIVSLKLVIISLYRSPKGIISVFLEKLEMLLNVFRESKWLHYDIVIGGDLNADFDVTTNKGVSLNCNDKQRSVTELKNLLRQHNLHSINSRPTRDKACLDNIFVNFKTAEDSCMNCRRLMYVTVFPFSDHDAVSVNYISRFHPDKCDIPVPKVVITRPITDDKISRFRMALADREWFDQCYGDTHCSLSSDLSAKVVFDRFFKTFLTLFNDSIPLKNAKQHSPKKCKVIDKGFKTKVTNRQNPWYTEQLTNLKHQLMVLYNISNALKTEHARSAYVKCRNEYKKAIVEAKKAHNFRSIENSTNKCQAAWKLINSVAKDPRNKSVNVSPQKFNDYFIKSVEEVGNAIIKPDIRSSELLSKNVSRSTTNINVFTFSEVSPSLILKIVKQLKSSDSADIYDISCNMLKRVIDCIVYPLTFCINKCISEGYFPDELKVSRVVPVYKKGDTESPSSYRPISIVPAFSKVLECVIYQQLSVYFENLGLISESQYGFRKNLSTVDAIDSVVKYLHQVFEDKGFAQVTFCDLSKAFDCVEHTPLLDKLEFYGIRDISLKLLKSYLQNRRQVVCIGKEMSSTEQVKVGVPQGSVLGPFLFLIMINDLPSFIKSSTVLYADDTTFLHSSNDXSSLKTCVAKTLDQASYWFKANGFLLNETKTQQMVFTLKDKLPSDDPSYVKFLGVYLDDKLSWGQHVKYISGKLSRVIYLLRRLMDYVPEKYVRITYFSFFQSIITYGIILWGNSSCVQDILILQKKAIRVITGSPHKEHCKPLFCKLKVMTVINLYIYYVLIYTKRKLPETKLRENVHYYNTRRNKCIFTSYHRLSKSLNSYELVGINYLISCHNMYKIYPNKHLNKRCMTG

SEQ ID NO: 3254 - protein, 752 aa, synthetic construct
  source 1..752: note = Description of Artificial Sequence: Synthetic polypeptide
MQAIAEDKRSRWCNLVENLEEITVVQSCREPRMKQNSMEIIKKLEWDPTDHKQKNNGVTANQIASQLLKNGKTGGKKKGKELYPKNKKMMASSIHIHSNRTGRRHSEYETEWPPQYTFTATELEDAIQSMKLNKAAGTDDLRTEQIKHFGPKVRNWLLQMINACIKIPKLWRQARVVALLKPGKEIRILKVTDQCHFYAISTRCWSGDPKTMAAGEGGGLTKTWQGDTDPKSYRPVSLLCHLYKMLERMILNRVAQIIDGKIIKEQAGFRPGRSCCGQILNLTQHIEDGFERKLITGAAFIDLTAAYDTVNHRKLLCKLYHLTGDCRLTMVIGSLLQNRRFYVSLNGKNSRWRLQKNGLPQGSVLSPILYNVYTNDQPIPQDTRLFVYADDTAVAVQGSSFDEVSQKHPVVLKNLLNTTMPITSIPKTSSGLEELAQYYDANHLKPNPCKTQVCAFHLRNRDAGVDLDVTWQGKKLDTVQHLNTLGYTIPWGTLDRTLSFKQHCRNTKAKVCSRNNIIRRLTNYEWGAQPSVLRTSALALCVSAAEYAAPVWDASAHTKQVDVSVNETMRIVTGCLRPTPTGNMYLLAGIAPPRIRRQVAADAERTKKENDYRHPLNGHVTQARRLKSRNSFIARTKILDGSQEDNRVCKWKNEQTGLPITPKEEMAPGNKLPYTVWRTLNRMRAGVPRCKTNLRRWGLLTNDDDALCECGEVQDEAHLLTCRLLPEPCSFSDLLQANDKAVAVANYWKNKT

SEQ ID NO: 3255 - protein, 1900 aa, synthetic construct
  source 1..1900: note = Description of Artificial Sequence: Synthetic polypeptide
  VARIANT 14: note = Any amino acid
  VARIANT 50: note = Any amino acid
  VARIANT 90: note = Any amino acid
  VARIANT 92: note = Any amino acid
  VARIANT 94: note = Any amino acid
  VARIANT 121: note = Any amino acid
  VARIANT 170: note = Any amino acid
  VARIANT 249: note = Any amino acid
  VARIANT 261: note = Any amino acid
  VARIANT 286: note = Any amino acid
  VARIANT 315: note = Any amino acid
  VARIANT 353: note = Any amino acid
  VARIANT 357: note = Ile or Leu
  VARIANT 386: note = Any amino acid
  VARIANT 399: note = Any amino acid
  VARIANT 403: note = Any amino acid
  VARIANT 427: note = Any amino acid
  VARIANT 458: note = Any amino acid
  VARIANT 481: note = Any amino acid
  VARIANT 526: note = Any amino acid
  VARIANT 556: note = Any amino acid
  VARIANT 1300: note = Any amino acid
MALPGAKPASLSVXGPNLMLRHMTPRRSLPWPRHGRNAGREIEVRLMPPXTWYVPGLTANRLPPRSPCFLWKTLRISSGRWMACQDEIWXCXHXDVVPSPVTGTACLVRGGGWHVKMRSGXVLITTSSPAQSRALLACDKLGDVPVSITPHKSLNMVQGIIFHKDLLLQXDDELRKNLERRGVHFIRRVHRGPKDNRVATGAFILAFEGDSLPEKVKVMIYRCDVKPYVPPPMRCFKCWRFGHMSSRCXGNPTCRECGRAXHPDAPCAPPPVCVNCGQHHSPCSPXCTVLHKERKIMEYKTLDRLSYSEAKRKYXKLHPVSMKTSMPQLHHTASAISATALHCLVFHSGPPGXTAHXCPHGLWGHLNLHRPQGPCFGSTTISTVGXSVPTPEPESQQPXLAPXARKGSLGSLPSKASPADASGWLKXPPTAGRRASRASSVPGDGSAEPSQHEKPKEXREKKKKKNKSKTKDSLVATVPPXHSTSSSEDEIEILASPKDLAIAESSEAMDVEALPQKSATAEDTVXPTAPSKSACPSDQEALGSASKIGDSRRYCXPYCAVEISMSQRPGGSLILQWNCGGFFRHLPELQQLLCRFPAFCVALQETWFPAQRTPALRGYRGYYKNRTIYDRVSGGVCIYVLATVPSAAVPLHTTLEAVAVRIRAMQELTICSLYLPPDEMVSLTDLAALVAQLPPPFLLLGDFNAHHPLWGGAQTTGRGRDIETLLSQQDICLLNTGAPTHFCVARGTYSAIDLSVCTPSLLPHLSWGGSTMTFAGVTISPFFCHSSTWTSGSHPMVSIAADWRGYTSAAVVSVPLPPDIDTAVQQVTAAIVSAAEETVPITTGSPRRKVVPWWTPEIAEAIRDRRRRCNATGAAPQSKIGHPGPSAALQRHRRRPTIENLIAFKRLRARARRLIRQSKQDCWERYVASIGSRASPSRVWSQVRRLFGYRPPAGIPSLTVDGTLCTDPAVIAECMAEHYASCSATANYSASFRSLKQRVERNPLSFHTRRRELYNARLRSGSLTLLSLHAPIPLRDQTAYTASSSVTCQRTFITNCSPYLIGSGQGVFSHPSGGIVLLSLSTTGGAKSSIFPHSPPGTVQCSFTEWEFNTALAACPDTSPGPDRIHGQFVRHLSADFHHKLLALFNRVWTGGVFPSQWRDSIIIPVMKPGADPLAVDSYRPISLTNVLCKLLERMVSRRLMWILEDRSLLAPQQGGFRQGRSTIDNLVSLESAIRTAFSRCEHLVAVFFDLRRAYDTTWRHHILATLYDWGLRGPLPIFIKNFLSLRTFRVRVGTSLSSXRVLENGVPQGSVLSVPLFLIAINGLAAAVGSSVCCSLFADDFCLYYSSPSIGVAERRLQGAIRRAQSWATAHGFTFSASKTRVMHFCRRRAVHPDPELYLAADQLHVAETHRFLGVLFDNRLTWGPHLRQLKQKCWRHLNILRCLSHTAWGADRRTLMHLFKALIQSRLDYGSQVYDSASPSALRILDPILHGGVRLATGAFRTSPVPSLLAEAGIPPLRYRRQQLLASYIAHVHATPHHPNRRLLFPNTDLPSPQRRPRSGLPVAVRVHSLLSSLESFPLRPAFSCLSHIPPWTIPRLQLHLQLSCDPKASVSPQLLRHQFLDILGTFRDADVIYTDGSQVDGRVGYAYVHGDHTEQRSLPPGCTVFTAELIAITRALDHLRACPRKSYLICSDSLSALHALDQCFPKHHLVRSIQVTVFSLGKSGRSVAFIWTPGHIGIPGNERADQLAKQAIACQRLDIGTPEGDIRLGLHRKIFEAWNSEWATMSTPNKLRAIKPSTAAWKTSLRPSRRDSVVLCRLRIGHTWLTHGHLLRREEPPECRCGALLTVVHILLDCPLLAALRQSFNLPTALPSILADDASMADCVLGFIRAAGFYHKI

SEQ ID NO: 3256 - protein, 757 aa, synthetic construct
  source 1..757: note = Description of Artificial Sequence: Synthetic polypeptide
MGLPFKLNAGGNALKLGETVVNLSSRKLSPLEERVLDRGLTFIPTSKTLSHEPILSSVEHVNRTFKLNFFFRNRLGRGKRIPFIEKSGWTPPDSAIDSDILATCDKLHEEISHLPLVNEKHNLTKFERKALNSLKNDQNIIIRKSDKGSCCVIQNREDYIFELEKQLNNANHYRVLDQPIFMETAQKINNILKTLVNKQFISDSQYDYLSAKPEVRQRHIYTLPKIHKNPETEWSLANRIPKGRPIISDCASESYRVSEYIDHFLLPLACKHPSYLKDTTDFVEKIKSLNVPPNARFISLDVTSMYTNIDNKTGLDAVRKAFLRNPCVDRPDKEILELLELCLTRNDFAFNEKIYLQTSGTAMGKRFAPSYANIFMAEWELEISSISPFEPFFYGRFLDDIFIIWTESLTNFWQYFEILNNHHPSVKLTANISEQSMDFLDTTVFKGPSFSQTNKLDIKVFFKPTDTHQLLYKNSFHPKHTFTGIIKSQILRFFRICTQKVDFDAACRLVFSKLRERGYSKRFLRKIKNDTVLDLLKINEPPPPINNFGAIPCRGSRCRTCEHIHMSHYFQNKKNGKIFEIKERLTCTDKNIIYLISCKKCDKQYVGETQNALRTRFSGHRFDIIHSKNRPISHHFNLPDHSIEDLLIMPIESIPDSDLIKPKTKRLQRESYWMDQLQTVAPNGLNIQHDNQMIPFVATFNHTAAKTSSIVKQYYSELQNRFPNVYTKRLVIAYKRNKNLSNFLVRGRLDPIESNNT

SEQ ID NO: 3257 - protein, 725 aa, synthetic construct
  source 1..725: note = Description of Artificial Sequence: Synthetic polypeptide
MFSCRFFLIRKSDRKICLDCKVIPGESLTTQHRVMVMDVRVKRRAKRRSQNGAPRIKWWHLKGEKLRIFQHKILEGGFRQPHGSANDMWERMAHEIKKVAKETLGESRGFGPRGKESWWWNDSVQSKVRIKRDCFKDWSRCKNVETWDKYKIARKEAKKAVSEARTQAFEGLYQSLGTKEGEKSIYKLAKGRERKTRDLDQVKCIKDEEGRVLVQERDIKGRWKKYFHNLFNEGYEILPDSNRLDIGEEDRNYNYYRRIQEHEVREALKRMSSGKAVGPDNIPIEVWKSLGDRGIVWLTNLFNEIMRTKKMSDEWRRSTLIPIYKNKGDIQNCANYRGIKLMSHTMKLWERVIERRLRKETRVTDNQFGFMPGRSTMEAIYLLRRVMERYRTDKKDLHLVFIDLEKAYDRVPREILWKALEKKGVRIAYIRAIKDMYEGASTSVRTQDGTTEDFPITIGLHQGSTLSPYLFTLVLDVLTEHIQELAPRCMLFADDVVLVGESREEVNGRLETWRQALEAYGFRLSRSKTEYMECNFSGRRSRSTLEVKVGDHIIPQVTRFKYLGSFVQNDGEIEADVSHRIQAGWLKWRRASGVLCDKKVPLKLKGKFYRTAVRPALLYGTECWAVKSQHENQVSVAEMRMLRWMSGKTRHDRIRNDTIRERVGVAPIVEKLVENRLRWFGHVERRPVDAVVRRVDQMEESQVKRGRGRPRKTIRETIRKGFRGQ

SEQ ID NO: 3258 - protein, 1088 aa, synthetic construct
  source 1..1088: note = Description of Artificial Sequence: Synthetic polypeptide
  VARIANT 232: note = Any amino acid
  VARIANT 487: note = Any amino acid
  VARIANT 621: note = Any amino acid
  VARIANT 707: note = Any amino acid
MGIFCCGRLKTKRQRHTPASKGVSRLTLACWNIRTMLDTANSGRPERRSALIAHELSRLNIDIAALSEVRLHEEGSLKEHGAGYTLYWSGKSKTESHLSGVGFMIKNSIVSKLENLPIGHSDRIISLRLPLHNKQHVVLFSIYAPTLQADPAEKDKFYSDLRRLTQKVPIDDKIIILGDFNAQVGKNFEAWKGVLGKHGVGSCNDNGRLLLEFCAEQQLTITNTIFQQKDSXKTTWMHPRSKHWHLIDYVLVRQRNVRDVCHTRVMPSAECQTDHRLVRCKLNFHFKPKPKRGGIPRRRLNVNNLQIAAVRDSFQANLQTRLEDHLIDSSPEALWQHIKNSILQSSVESFGFSLKKNKDWFDDNNQEVQELLTKKRSAHQAHLAQPLCHVRKAAFRLACSKLQQKLRDIQNKWWLNLAEKTQLCADLGDHRGFYEALKAVYGPTYQVQSPLLSADGQTLLTDKISILNHWSEHFQTLFSANRVVQGXGIQHILQHLVKNELDIAPTMGETLKAIQQVKTGKAAGVDGIPPEIWKHGGQALHAKFHELVVRCWEQGKLPSDFRDAIIITLYKKKGVKSDCSSYRGITLLSIAGKILARILLNRLVPAIAEELLPESQCGFRXNRSTTDMVFVLRQLQEKCREQNKGLYVTFVDLTKAFDTVSRKGLWLILERLGCPPKFLKMIILLHEDQQGQVRYGDALSEPFPITXGVKQGCVLAPTLFTIFFSMMLQRAMVDLDEQNGIYIRYRTDGSLFNLRRLKAHTKTLNHLVRELLFADDAALVAHTEAALQRLTSCFAEAAELFGLEVSLKKTVVLYQPAPQEDYHHPHITIGESELKSVQQFSYLGSIISSDATIDKEIDNRIAKAYRAFGKLHKRVWCNKHLKKSTKISVYRAIVLSTLLYGSESWVIYRHHLRLLERFHQRCLRTILNIHWTDYVSNVTVLEQAGVTSIEAILLKLQLRWAGHVSRMKDHRLPKIVFYGELATGCRKRSAPKKRYKDSLKQYLSLGHIDYHQWSTLASNQETWRHTIHNAVVSFENTRRISLEEKRQRRKNRAPPIPPKETFRCAFCNRICLSHIGLFSHQRACSKRG

SEQ ID NO: 3259 - protein, 997 aa, synthetic construct
  source 1..997: note = Description of Artificial Sequence: Synthetic polypeptide
MNSSTNLRPSVPGGWNVPADGSKQVYRKAEGAKNHRVSCHGFYLATYNCRTLSTEGKLLEIEEELKHVKWDILGLSEVRRKGEELLELKSGNLLYYRGTNDGRCSGSGFLINKRIKDNIIEFNSSSDRVSRLVLKISKRYEFQIIQVYAPTTSHTDEEVEEFYEEIEKIRGRKQQFTVIMGDFNARVGIQLQGESAVGKFGEGIRNERGQRLVEFAESENLFIMNSFFKKNPKRKWTWRNPSGGTAEIDYILASKKYLIEDCTVLNKFNTGSDHRMVRCKVHINVKNERKKMFKGPRSGIDIGKLKANQNLFQIELKNRFAELKANQNLFQIELKNRFTELTNLTEDIDIKNLNTNITNILIQTATEVAGKQRQVKNDKLSDKTKLLLNKRREMKINGNAVSKKIEYAELCKTVRKCITDDIRKYNCNLVKKSIEENKGIKSVKKHLCCGRKRIFALKAKDGKIIKNQEDILKRVEEFYSDLYRDTNNSCLVQNSKSEIPPILKEEVHLAIKKMKKGKAPGEDGITVDILHEGGEQIEDILTDLFNRCLKQKDVPEDWKNATVILLHKKGEREDISNYRPISLLSVLYKVFTRILADRLKRSLDEAQPREQAGFRAGYSTMDHIFVLREIVERTNEYEIPLCLAFIDYEKAFDSVMTSAVLNALANTDTDSGYVDIFSKIYSQASARIRLHKYSEKIKIGKGVRQGDTISPKLFSAVLEEVIKKMDWDKTGLKIDGEYLSHLRFADDVVLLASNPNELQNMIQSLATESKKVGLRINISKTKVMYNNFADQQKIKLDNIVLEEVSGYIYLGQLLTLDGDLMPEINRRIKLAWSAFGRNNSILKGKMPLCLKRKIFDQCILPVLTYGSETWTLTKRAIQRLQTTQRSMERCMLGITRRDRKRNTWVRSQTKVIDVIQKIKKQKWTWAGHIIRINDNRWTTKVLHWIPRDKKRPRKRPHYRWRDEIVNFTSKCWIREAVDRKNWKLLGETFILQWIDNG

SEQ ID NO: 3260 - protein, 994 aa, synthetic construct
  source 1..994: note = Description of Artificial Sequence: Synthetic polypeptide
MMSGTHDSDNARAFPGVGDAQSLRRPRAVRSRLGLSHQERVRLKKLARRPLLVRIASLNVGTMTGRGREIVDMMERRKIDVMCVQETRWKGDKTRELGEGYKIFYSSASKEGRNGVGIITSRKMKENIIEVSRRNDRIMRMKLDIGETIHVVSAYAPQVGTSMEMKDTFWKTMDEELRQLEEKDRVIIGGDLNGHIGTNKRGIERIHGGHGFGDRNQEGEQIIDFAVAFDFALANSFFNKKEEHLVTFKSGGNSTQIDYFLYRRKHLKEVKNCKVIPSDHVATQHRPMLMDLHLLRPAGREKVKTRVKVRKTKWFKLKDTVLRSRFKETALQRVSMDFEDVQEWWNRNAEVIRCTGREILGETTGKCWENKESWWWNQEVQAAVQEKRKAKKKWDSTHAPADLEVFKVRNKQAKKKVAQAKAKACQELYDDLETPEGQKKIYSIAKHRSQTAKDITHIKQIKNVNGEILRNTGKIQDRWKEYFEELLNVENERKYHEDGIPNEGLTRDITKSEVKVALKQMKNGKAVGLDGIPAEAWKALGEEGLDLLWDLLGKIYREEEIPDEWRESIIVPIYKGKGDIQMCGNYRGIKLMSHTMKILERILDKRLRAEVKIGGQQFGFMPGKSTIDAIFCLRQMMEKFREKQQELHLVFIDMEKAYDRVPRQEVWRSLRLRNAPEKYVRLIQEMYRKTTTKVRTCLGETSSFEVGVGLHQGSALSPYLFNTVIDVLSEKVREEAPWNMLYADDVVLCARSRAEVEEKLENWRKALEDRGLKISRSKTEYLACNIGTQENEELKLMETTVRKTDHFRYLGSIVDELSETGREVNNRIQAGWKNWKEVSGVLCDKKIPVRLKGKVYRTVVRPAMLYGTEALPLKKSNLQRMKVAEMRMLRWMCGVTRADRIRNEHIQGTVKVTDIASKIQESRLRWFGHLMRRDEDYTGKRLMNIKVEGRRKRGRPKRRWQDIVDDDLRSKGLRREWTKDRTQWRKLIKNSDPI

SEQ ID NO: 3261 - protein, 934 aa, synthetic construct
  source 1..934: note = Description of Artificial Sequence: Synthetic polypeptide
  VARIANT 879: note = Ile or Leu
  VARIANT 887: note = Any amino acid
MKNFTFDVLGVSEVRWTGKGELSTGDFIWSGEEKHHFKGVGFLLSKKAQKCLISYNPISSRIISARFSATPFNISIIHVYAPTTDASDEDIESFYGEIKNTLRETPKKDFTIITGDWNAKIGSNNTGWESAMGKEGYGDRNERGERLLEFATEHNFYICNSRFRQKPCRKWTWTSPDGIHHNMIDLILVQSKWKTSVQNCRTFQSADIQLDHSLVLCNIKIRLKKQSTTSQGTLDFRKRNSNDLKQPPIKQAYEKSLNEQLKKITPTMSLDEHASILESAIKTAIKSSLAVTEKPRKPWITENTLKVANEKRKWKLKRHISEENNNIYKAHCIQVKKLAKEDKENWLNEQCEAAENGLKTGKTHQAYKLIKMLRKPFTPKLNILKDDAGKILQTKTAITNQWTKYCSTLYNGSNNNQSQATDAELEEITPPADEYPCPHILHSEVEAAIRTLKQRKSPGFDEITAEMIKAGGPKLTASLHELCQKIWLEEKIPTNWGKTILIPIPKKGDLARCENYRTISLISHLEKVFLIILLRRLQHQLEPYLAEEQAGFRKDRSTVQQILLVRLLAEKAKRKGKKIYNCFIDFQKAFDSINQQRIWAVLASFGVDRKVVKLLQNIYENTRLAVKTGNDMGTWFKMLIGSRQGDPLSPLLFITYLERTMDSVTKLNLGVTIQGSIISNLRFADDINLMNEDLQALQDQATALQASAEKSKLRINTSKTKTMVFGARNIEQQIEINNQPVENTEQFEYLGSIITWDNNCSVEIKNRIAKATGALASLKHIWKSSKITVPTKLRILSVCVFSVLLYAAETWTLKENDKKKLLAFEMRCYRRLLKIKWQDKIRNEEIRNTLNIHTTIIDLIRQRKLRLFGHICRMDNNRXIKHVVTSXMNGKNKQGRPPRAWMDDITDWCKCSAQEAFHRAQNRNQWKTATRTND

SEQ ID NO: 3262 - protein, 628 aa, synthetic construct
  source 1..628: note = Description of Artificial Sequence: Synthetic polypeptide
  VARIANT 6: note = Any amino acid
  VARIANT 38: note = Any amino acid
  VARIANT 45: note = Any amino acid
  VARIANT 48: note = Any amino acid
  VARIANT 77: note = Any amino acid
  VARIANT 291: note = Any amino acid
  VARIANT 613: note = Any amino acid
MRLTVXLANSNCTIKDVSVLNQFNTGSDHRLVHAKVKXDIQCERXRLXQHGGQKVKKEEYSLKLQTDSKCSQKTKVXYGIHTMRQCRRNRGNSTKKSRQENIHQNTGADRKEKEDEDQIHYQPDRIEDEVRKSPRRRQFNIKLLKEGGVPLYKQLAGIFSDCMRTGQIPDSWKNAVIVPIHKKGDKTDLRNYRPISLLSTIYKVFTIILTRRLEQVLDSNQPREQAGFRKGYSTMDHIHTINQLKEKCKEYHISFCMAFIDYEKAFDSVSTEAILTALSNQGIETTSTQNXCCKDSGIAPRPPSVRRNLLRIIYEEATAIIRLHKDSRKIKIQRGVRQGDSISPKLFTACLEEIFRQINGWEHKGININGEYLNHLRFADDIVLFAQTPNELQEMLSDLKTESEKIGLQINYEKTKVMFNAEVIPQPVTIEGRTIERVEEYKYLGQVITTQGDQMREIQHRTQLGWHACGRYSNFLRDNRIPICLKRKLFNMCILPVMTYGCETWTLTKKMEQKLATTQRSMERYMLGFTRRDRKTNIWIREQTKVEDILVTVRSSKWHWAGHIARYTDNRRTKRITEWQPRQGKRYPGRQYKRWRDDIRKVIGSQWMQIAQXRYIWKQKEAYISSSG

SEQ ID NO: 3263 - protein, 975 aa, synthetic construct
  source 1..975: note = Description of Artificial Sequence: Synthetic polypeptide
MIRSSQAENDARGANPPGGPIADVATGKKDHLSCKDLFTIGTWNVRGLNIGKLEIIKREMTRTGLDLLGISELHWTGSGDLKSDDYTVHFSGNDHNRRRGVAFVANKRLAKYIENARCISDRIMTIRLRGKPLGVTIIQVYAPTADADKQDIVDFYTAIQNALDQTPKKDIIYIMGDFNAKVGDGEDGQVVGRHGLGDRNDAGDRLVQFCQENKLRITNTFFKQHKRRLYTWTSPNGQHRNQIDYILCQQRWRGSITAAKTLPGADCGSDHQLLIARIKIRLCKVKKTVVAKKFDVSRIPTQYTIEVRNRFEALSLDGGQTEELWAMIKGTIIETALEYVPYKMPTKGAVWLTEKTLQIAEKRREAKAKGEIDKARRLHADFQREARIDKNNALNARCISLEEAFRKGRTRELFATVKQVKTPFSARQSTIKDRDGNELTDQQDIKERWREYTEDLYTSIDDQQNEDQTDQGLQEPDLLESEVEWAMRQLPSNKAPGIDGIPAELLRPIPRAALTALCQQIWKSCTWPADWRRSVFVPIPKKGDTRDCANYRTIALIPHASKILLKVIQKRLGNVIDRELPDVQAGFRRGRGTRDHIANLRWIMEKAREYQKKLYMCFIDYTKAFDCVEHSKLWVALRELGVPEHLIRLIRSLYQNQEATVRTRYGDTDWFKIKKGTRQGCTLSPFLFNLYAEVIMRKLDLEESEVGVKIGGRTISNLRFADDTTLLAESEKDLKRMIMKLKNESEKMGLQLNIKKTKIMTTAAKEVHIKINNEEIEVVDSFIFLGSKVDCNGDWRPEITRRIALGRTAMVNMDPIWRCKDVSITTKRRLVTAIVFPIATYGCETWILTKADRRKIDAFELWCWRRLLRIPWTARVTNKSVLERINPDFSLEGKITRQKLTFFGHVMRANSLEKDVMLGRMSGTRPRGRPKTRWLDTIKKDTGKNIEELRELVRDRKTWRDMTHRIAKNRTRLNG

SEQ ID NO: 3264 - protein, 649 aa, synthetic construct
  source 1..649: note = Description of Artificial Sequence: Synthetic polypeptide
  VARIANT 95: note = Any amino acid
  VARIANT 280: note = Any amino acid
YDLALIQEPWHYKGQIRGLNCKEGKLFTFTSDSGPRTCVFVRNNINVSPVWDFCSRDITTVRVKLDEGGVSRELIVSSAYFPYDKDELPPTPEFXLLVEFCQKNHFDLLVGVDANSHHVVWGSKDINRRGEYLLEFLMGTNLFVLNKGNEPTFVVVNRREVIDLTLGTQNISDLIENWHVSGEPSSSDHRYICFNLQGMVPSQVTYRDPRRTNWASFREDLKFNLGGIQSRFCSVVDLEMTVDQIQQAILLSYHQNCPVRTARSSRQVPWWNEQLGGLRXNVRRLFNKAKRTGDWDTYRSALTCYNKAIRKAKRSSWKRYCQGIEDIPDVSRLVKIMSSGNFCKVGSIRLPDGSMTSTCKDSLKELFRVHFPGSTLIEGSSCLQVQSDLDGHVYHAKREDWGLVRGVINQSNIRWAVSVFKPFKSAGPDGILPVFLQQGIDILASPLCRVFRACLAFGYIPWSWRQVRVSFIPKPGHSSYTEAKSYRPISLTSFLLKTMERLVDRFVRDGALLKTPLCRSQFAYQSGKSTENALHEVVSLIERAIGYKEIALGAFLDIQGAFDSTSFEQISLAASRHGVCSTIIRWIGSMLKHRVVYSTLYDEEVKILTDRGCPQGGVLSPLLWCLVVNELLTLHSMGKVSSLLGMLMT

SEQ ID NO: 3265 - protein, 480 aa, synthetic construct
  source 1..480: note = Description of Artificial Sequence: Synthetic polypeptide
  VARIANT 314: note = Any amino acid
  VARIANT 317: note = Any amino acid
  VARIANT 480: note = Any amino acid
MRAAFDKVNRREMWEMMEKLGLGVRIRNRVKELYRGTRSEIRIGEDKIGGFELHKGVRQGCPLSPTLFNVAMADTEKELSKVQEGGIVLGKKKFWSISYADDVVMVANNATGLKQMLKKFKKIIERKGLELNTEKSKIMVFKNGGRRKKEDSFFWEKKEIEVVKNFEYLGYMLKENGKEEAQIKKLKEKASTVMSSMWGLGEELFRDNWELRMRLFDTMVKSVMEYGAEVWGWKGKEELEKIQRKYMKWVMKLDRTTPEHVLHLETKRYKLETRTRRRAIKYEVKLSKAKEGTLWRECWRTLEKEEEKERRRGXRRXNREEELNKRGWALSEYHRRLRAGEQVWSELERIEKDIQWQKWESEMRDSRQARDVKELIKPQGETPEYLRRTGNTGKKGLAMTARFRMGNEARGYKYWMKEEERICRLCREEEETFEYIFSRCNRTGSRENNWKNILNGERKNLAKLYRVIWVRKEKEKEEEX

SEQ ID NO: 3266 - protein, 1207 aa, synthetic construct
  source 1..1207: note = Description of Artificial Sequence: Synthetic polypeptide
  VARIANT 282: note = Any amino acid
  VARIANT 511: note = Any amino acid
  VARIANT 512: note = Any amino acid
  VARIANT 513: note = Any amino acid
  VARIANT 514: note = Any amino acid
  VARIANT 1098: note = Any amino acid
MEALKTQNIVSERISKIEQRLGPLEKRLKALDELPALKTRIHNAESTITELQAQIQDLSSRSPTMQQDNGSTVPNTAEICSLRSELAEVKRRQEQTSNCVVVVTGLHYTRETSLHLLAFSVVNALDPTVLRRDVASVRTMGRLDATNSSARGDGRLPPLAVTLSSSALARSIVIAKARKRKLHTSELDATLLEEAKALSPDHQGLININELLPSDVHKLRTRARLEAKKRQGCRTFVREGRLYTCAATMTASVLRSSTPTPSWRLFPGFRPLPTSSNTEATXQYTHQTLSSSAQERSKVKSEYLFCEVSAKGVSPIFVGVVYRPPHAPFFQGSNFIDQLTTHMHNYSTKVIMGDFNSDQLSSSEDAKFIKAFIDENSLSSVPYGATHHKQGSDTWLDLCLIDEQDRLLSYWKTNSPFINGHDLITATLDVQIPRYVPNTYSYRNFKGISAEKLRDFLSACDWSSLTSSSLDECISTLNANLTNAINHLAPLRTVTPRRQRHPWFTTVSHVXXXXRILVALRDLVSERDRLYRRFRDSRLDSDLRIYRLARDNAHKQVEEARLNYYYSRLSTLTDVAEIWRELEKLGISATKAPSPSRFTTDELNKHFSSISNDPLAPAVEDYLLTLESLDLPEHFEFSTITESDVLAAVSHFDTQARGSDGIPQVVISKALPVLAPLLSHIFNLSLSEPCFPSAWKLSLVRALNKVSSPTALTDYRPISLLCFLSKALEWLVHRQVSEYLESRLLLDNFQTGFRTGHSTHVRVGINKKKVTLLLLFDFSKAFDTVCHVRLLRKLSTFGFSKQVIRWFASYLTGREQAVVGDNSERFSPRRPAGSVWSLLLHCTSTTSVSALIPMFPILSMRMTCKFTVNATLRSSILYQTRRAFLSSASRRVRLVLAVALYINDIGFCLDSDVSHLIYADDLQIYSQCHLEELDSLSNKMSANAERIMGWAAQNRLKLNVNKTKAIVLGSPYYINALPKVTLINMGVPGQLHLLIWGCQVSFESSVRNLGLVLDSKLTWKEHVTQVCKRAHSLMYRLYFFRKSTNLRLRKHLVQALLFPIIDYCSLVYCDLTQELDLKLQRLVNTGIRYIYGVRRDEXISPYRRELQWLTTAGRRKYFTACFLRKMFNSVVPSYVLAFFDFRVTLRPVRGEVTPLEIPAFATETLRNSFHISASYLWNNLPSHIRNTSSTVTFRKLAKDHFFQLENT

SEQ ID NO: 3267 - protein, 1178 aa, synthetic construct
  source 1..1178: note = Description of Artificial Sequence: Synthetic polypeptide
MPNTRTLASRGEIRGLGGAGRIFRDPTCSVPRACILVKGFDALLLPARCSRDLTAIKIRLPVGEGSEREVVVASGYFPYDSQEEPPPREVQDLVEYCRQRSIPLILGCDANAHHIVWGSSDTNGRGDALLQYLVTTSLCIMNRGREPTFYNSVRSEVIDLTLCTVGMEGWVGSWRVSNEPSLSDHRYIQFEWKERCSETRAFRNPRKTDWAFFRENLRNELQSFKPSFGTTDELDHWAFELGEIVNISFQRSCPWTIPRGTWGTPWWNRELEDLRRETRRTLNRAKNTRNSIDWRIHREAQRLYKNRINAVRIKGWRDYCEDIERYPDAARLLRILAKNPEVWLEAIRLPTGEYATSEEECLKLLLEANFPGFRLSHEMGDESSGRNRQQRAAWDLAAKVVTPEKVKWAIRNFQPFKAPGIDGIYPAFLQEGLEELVGPLVKLFRASVALAHVPEIWKTAKVVFIPKTGKPSHTTVKDYRPISLNSFVFKTLERLVDRFIQDDILTVFPLHPNQHAYRAGFSTETALHSAVWRIEEQLERGEVMVGVFLDIEGAFNCTSIEAVVKEAGLHGMPGPLIKWLQGMLTRRTVISSLGTVTVSGEVSKGCAQGGVVSPTIWCLVANGPLEALNGWGCYAQAYADDFLILIKGSEIGAAMDAMQLALRKVERWCCSTGLSVNPDKVEMVIFSRKYKLDAYRAPKLSGVALQVKDSAKYLGIVLDKKSTWEKHLTAQCDKFLVALWTCRRAFGSTWGLSPRIILWLYRAVLVPRLAYAALVWWPRAELAGARAAPEKLRGQVLRGATGAYRTTPTKALGILVKVEPLHLTIIGMAAKAAHRLNAYGQWTQGTRHTRLPGGVGLLPEFSIKTDMMIPRYFFGRRYGVVIPTREEWKARRDSLPGTGDVWYTDGSRAETGTGSGYYCRRDGRGTFFSLGRYATVFQTEIYAILTCAQRNIELGARDRIITICSDSQAALRALMAHRTTSRLVWECKVVVNQLTAHNNKVRLLWVPGHTGIRGNEIADRLAALGAKHPPIGPEPYTGAARCLLAGEIRDWVEREHTKEWQGTQGCRQAKAVMGQDTNVGWTKCIAGGSRNNSRLLTQIVTGHIRLRYHGLKMGKEATGVCRWCEGAEETPTHVLTVCPKFAQLRHQCLGELFPTYEEIRALDAGAILTFWRRAGLPA

SEQ ID NO: 3268 - protein, 1309 aa, synthetic construct
  source 1..1309: note = Description of Artificial Sequence: Synthetic polypeptide
GILPHSPVLPVRMNTPPARPRPRRRELNQQQRQQQQIHLPRARLERMCPKRINRHPHRLLAPEPNRLREHRLRLSRRPLRTSSRRWMTFGRSRMRPFRHKTPCLKGSLELRKGLALLQSRLKALDDLPALKTRLNNVESSISELQAQYQELSSRSPAEQQNISIAPASEEINNLRSELAEVKRRQERSANNVVVISDLAYTQETSLQLLAFTVLAALDSTVLRRDVATVRTMGRLDATTTNAQGDSRFPPLAVTLSSSALARSIIVAKARKRKLHTSELDAALLEEARALCPDHQGLININELLPPDIHKLRIKARLEAKRRRGCRSFVRDGRIYIRSGEDSERATIISTDAELEAFLAHTPPIANTDITHGFFSPYAANSQHGHHTLRHTPIIPPKPPSKSSNSSTSASKASLSEGLRVCHFNANSLTGHIEMVRLFLSTRSPFHVIAVTETWLSDKITSIPSLDDYILYRRDRNRNGGGVALYIHHSLTASVISSSDGEWSGKPGKPEYLFCEISAKGVSPIFVGVVYRPPHSPFIQGSNFIEQLTTHMHNYSTKVIMGDFNSDQLSSSEDANFIRAFIDENSLTSVPYGATHHRQDSDTWLDLCLIDEQDCLLSHWKTDTPFINGHDLITATLDVQIPRHVPATYSYRNYKGICAEKLRDFLSACDWSSFTTSSLDECITILNANLTNAINHLAPLKTVTPGRKRHPWFTAALRDLLTERNRLYRRFRKSRLPWDLYFYRIARDDAHKQVEEARLNYYYSRLSTLTDVAEIWRELENLGITTSKSPSPARFSSDALNKHFSSISNDPQAPSVEEYLRTLESLDLPEHFIFRAITESDVSAAVSHFNTQARGSDGIPQVVISKALPILAPLLCQIFNLSLSEARFPSAWKSSLVRALNKVNSPTALTDYRPISLLCFLSKALEWLVHKQISEYLETRLYLDNFQTGFRTGHSTQSGLIKLTDDVRLGIDRKKVTLLLLFDFSKAFDTVCHVRLLGKLSSFGFSKQVIRWLASYLSGREQAVIGDNNELSTSLPLNTGVPQGSVLGPLLFALYINDIGFCLDSDVSHLIYADDLQIYSCHLEELDSCSVRMSANAERIMGWAALNRLKLNVLKTKAIVLGSPYYINALPSIANTFINIGGARVDYESSVRNLGLVLDSKLTWKEHVTQICKRAHSLMYRLYFFRKSTNFRLRQHLVQALLFPIIDYCSLAYCDLTQELDTKLQRLVNTGIRYIYGVRRDEHISPYRRELQWLTTAGRRKYFMACFLRKIFNTSVPTYILAFFDFHVALRPVRGEVTPLDIPSFKTETL

SEQ ID NO: 3269 - protein, 1394 aa, synthetic construct
  source 1..1394: note = Description of Artificial Sequence: Synthetic polypeptide
  VARIANT 123: note = Any amino acid
MKIISWNVRGLGSSRKRSVIREVLRKEKPTIFLIQESKLTEVDRRWVRSVWSARGLSWAFTQSWGASGGIITIWKNEEMDCTEELIGNFTVTIKLRRKEDGFEWALTNVYGPNSYRERDDFWXELAAIRGLWNGPWCLGGDFNVIRFLNETTNPNHRVTSSMRKFNLFVDSYELRELPMLQANFTWSNFQEEPLCCKLDRFLFSSDFESAWRGLAVRALPRPTSDHCPVRLSQENLGGGPCPFRFENMWLLHPDFIKKVQLWWEEDQVEFRWKGYKFYKKLQALKARIKAWNKEEFGRVEERKEWIANRIQEIDGGEAERRLTVGEREERWKLKQELQEIIRKEEISWRQKSRCKWLKEGDGNTKFFHTLANGRKRKNFVGRLEWNGEVITSEEEIARAFVEHFKSIYDSPRREREEIPDLDWLPGNRVLMDQLEKNFEVQEVKDAIFSMERSKAPGPDGFTMAFYQDCWDIIGGDLMEVFLEFFERGKINSGANATFIALIPKKVNANHPKDFRPISLIGSMYKVISKVLAERIKKVLPSLISPNQGAFVSGRQIIDQILIANECVDYRKRQGEKGLICKLDLEKAYDLVDWGFLLEVLRIRGFGERWCMWVKGCISSCHYSILVNGVAKDFFPAKRGLRQGDPLSPFLFTLIVDVLSVQITRADARNLLRGWRVGREEIVVTHLQFADDLILFCEGDPEELENLKVLVENFEKVSNLRVNWNKSCVAGINRQEVEVASLARSLGCEVSDWPLKYLGLPLGGNPRSVSFWYPVLERFSKRLAGWKRNYISLGGRITLIKSTLANLPVYFLSTFKLPVKIANQVEKIMRDFLWEPGDTKKDHRVKWEVVSRKKDKGGLGIGNIRIRNAALLGKWLWRFPKEQESLWHKVIRSIHGMAANGWDAGLDPRASRFSPWKDIVGILPVFSPFIRYDACVGNKILFWEDLWIGESPLKDRFPNLYSLSLKKSQFISSFRASGDSWDLGLRRGLRDSEVDSANDIFSLLSSVFLDHSSPDSRIWAETSTGSFSCSSFFNALVLPSNPVSSFPVKEVWSAPVPPKVRAFCWEVVLQKINTLEVLQRKRPNWCLSPHVCSLCLRNGETVNHLLISCPFSALIWDWFSSLFDCRWTPPTSVADLFDPSFFRQPKKKGRVMWRTTRAAILWAVWEERNNRIFQGKEKSAPEVIEGITIKAVHWLKTLDLFKDVSIDDLIRGWSILARSSTSSPTIQAVWSPPLQCNVKLNFDGSSIGNPGPSGIGGVFRDAEGKILALYSGPIGLGDSLRAEVLALLQGLRWAKQLGFQQLEVEGDSKLVVGWLQSNSLGTWSLRQHVRELLSLTRELGAQVYWSRRSANALADNLAKQGVNREVFVLCSVVSYLLFRGHLLLWKVTVVSSGFI

SEQ ID NO: 3270 - protein, 1279 aa, synthetic construct
  source 1..1279: note = Description of Artificial Sequence: Synthetic polypeptide
  VARIANT 338: note = Any amino acid
  VARIANT 720: note = Any amino acid
  VARIANT 1233: note = Any amino acid
MDMCGCLQMSMGQMTTEREELWEELADVRGLWDGPWCVGGDFNVIRYPEETNKTNQRVTTSMRKFNRFVDAFELKEIPLAQKTFTWSNLQARPICSKLDRFLFSVDWEEHWGNLTSRALPRVTSDHWPIVLCKEERRSGGPAPFRFENMWLLHPGFTNRVREWWNECNPLVEWEGMRFHKKLQFLKAKIKEWNILEFGRLEERKRDLMDQLESLDSKEERGEFGEEDNELRRGLRRQLEDCLHKEEISWRQKSRCKWLQEGDRNTRYFHSLADGRRRRNFISKLVVDGIELTQQEEIAGACVEHFKSILRRPVSGRVWVEGLDWPDVGGDNRRSLERXFDLEEIKEAVFSMDRTKAPGPDGFTMAFYQDCWDILKEDLLMVFEEFHRRGIVNPGVNSTFIALIPKKKEASHPRDFRPISLVNSLYKIIAKVLSLRLKKVLPDIIEQNQGAFVSGRQITDQILIANESVESFKKDKKKGVVCKLDLEKAYDMVDWEFLRKVMTKMGFGARWCKWIMGCVRNCHYSVLVNGTVVDFFPATRGIRQGDPLSPFLFLLVADVLGKLIHRADSRGLIRGWRVGREDIPLTHLQFADDTILFCEGGNVSFIRNLKLVIQLFEQMSNLKVNFGKSCVVGVNLEEGEIRESAEVLGCEVSGWPLSYLGLPLGDNPKRESFWNPVVERFEKRLVSWKKNYLSLGGRTTLIKATLANLPIYFLSVFKIPXKVSSRLERLMRDFLWEPGEEKRDHRVSWKVVTRSKNYGGLGLGNIGKRNSALLGKWLWRFPLEQEKLWARIVASIHGMEQNGWDAGIRARTTSTSPWKAIHDLLPVFSPLVRYDLNSGNSIKFWEQIWVGNVPLKDQFPSLYALSDFKNEPISSFITPSSSSSGFGWNLGLRRAVRDSDLDSISSLLELLDNVFLDPSKVDSRIWTPTPTGSFSCASFFKVLCQSTSPATSPFPVNEVWCRPIPPRVGSFCWEAYLERFNTGDLLQKKRPNTCLSPHWCVLCKADGETGFHLLVSCQFAKSIWEWAFSLFGRRWNPPSDLQSLFSPSFFRWHMKRGRTMWRGLRAAVCWSLWEERNSRIFSEDERGAEELRAVIHIRAVQWLKSLELFTDYTVEDMLRKWGEIANCTQTKPVIRVSWTPPPAGFLKLNFDGSCRGNPGQSGIGGVFRDENGVISALFSGPIGVGDSLRAEILAVMEGVQKAKEMNVRKLIIEGDSEVVIGWLIKDNCGLWNYXNERRKFRWLVREMEIRMSWVKRSANSLADGLAKQGIEREAMFWAKL

SEQ ID NO: 3271 - protein, 1402 aa, synthetic construct
  source 1..1402: note = Description of Artificial Sequence: Synthetic polypeptide
  VARIANT 4: note = Any amino acid
  VARIANT 24: note = Any amino acid
  VARIANT 171: note = Any amino acid
  VARIANT 235: note = Any amino acid
  VARIANT 440: note = Any amino acid
  VARIANT 591: note = Any amino acid
  VARIANT 612: note = Any amino acid
  VARIANT 1018: note = Any amino acid
  VARIANT 1135: note = Any amino acid
  VARIANT 1170: note = Any amino acid
  VARIANT 1216: note = Any amino acid
  VARIANT 1254: note = Any amino acid
  VARIANT 1381: note = Any amino acid
MRIXSWNVRGLGSARKRATIKEVXKKFNPDVVLLQESKRMDFDCRRARSVWRAKGIKWAAAPSWGSSGGIVTLWKEDVLIGLEELIGDHSVSLKFRQVEDGFEWVLTNVYGPNDYRQRKKLWEELSDIRGLWEGPWCLGGDFNVVRLTEETNNPRQRVTTSMRSFNQFVDXFELKELPMLNNTFTWSNLQSSPICSKLDRFLFSTDWEAHWGNLTSRVLPRLTSDHWPIVMCKEXLRGDGPAPFRFENMWLTHPGFIEKIKEWWQHYNPPVQWEGMRFHKKLQFLKSQIKEWNRLEFGRVEERKQVLVEQIEELDMKEGRGLFGEEDRERRWSLRKQLEDLLIKEEISWRQKSRCKWLKEGDRNTGFFHSVANGRRRKNFISKLEVEGTVISHPVEIAEAFVGHFKSIFRRPLNERIWLEGLDWPTLSPENREWLERRFXLEEIKEAIFSMDRTKAPGPDGFTMAFYQDCWGIVEEDIGSVFEEFHRRGIINPGLNSTFIALVPKKKEASQPRDFRPISLVNSLYKIIAKVLSLRLKKVLPSIIAPNQGAFVMGRQITDQILIANESLESFRKSKKKGVVCKLDLEKAYDXVDWSFLLEVLKSFGFGDSWCXWIWGCIRSCHYSILVNGTVVDFFPASRGIRQGDPLSPFLFTLIADVLGRLIQRADSRNLIKGWRVGREEIPLTHLQFADDTILFCEGGDIEWIRNLKLAIQLFERVSNLKVNLDKSSLAGVNLEERELREYADVLGCATSDWPMAYLGLPLGDNPKKVSFWNPVVERFGKRLASWRKNYLSLGGRITLIRSTLANLPVYFLSVFKIPTKVSNTLEKLMRDFLWEPGEEKRDHRVSWEVVTRGKKLGGLGIGNLRKRNMALLGKWLWRFPLERDKLWTKIVASIHGLEDNGWEPGILARTTAASPWSAIHKLLPVFSPCIRYGLNSGNKIKFWEQLWVGDSPLMDQFPSLYALSDLKNEPISSFLSPSDSPSGFGWNLGLRRAIRDTDLDHILSLLAILENVFLDPXKEDTRFWVPSSSGVFSCASFFETLTQPSDPIGLSFPVKEIWSRPIPPRVGSFCWETFLERINTNDLLQKKRPNSCLLPNRCTLCKADGETGYHLMVTCSVAKSVWEWVFSLFGCVWXPPGSVQSLFSPSFFRWPKKRGKTMWRSIRAAVCWXLWEERNSRIFSDKERTIGNLLDLILLRVAHWLKTMELFSDYSVADXVRNWKEIASSALCKRTCSPSWSPPPSGFIKLNFDGSCXRNPGPSGIGGVFRNEAGAIIAMFSGPIGEGDSLRAEILAALEGIQRARELNIRCLVLEGDSEVVIRWLKGGGSGLWSYNNEKNKFKWLSRDIVVHYNWVKRTANSFADGLAKQGVNRDSTFWANFLXFLVFFGGELSLFTSPLYLSFT

SEQ ID NO: 3272 - protein, 1064 aa, synthetic construct
  source 1..1064: note = Description of Artificial Sequence: Synthetic polypeptide
  VARIANT 368: note = Any amino acid
MWKKEVLEGKEELIGQFSVSLKFRQVEDGFEWVLTNVYGPNDYRERRQLWEELADIRGLWEGPWCLGGDFNVIRFLEETNSTRQRSTMSMRKFNQFVDAYGLKEIPLSHSCFTWSNLQVNPICSKLDRFLFSNDWEEHWGSLNSRTLPRVTSDHWPIVICKEEVRNAGPTPFRFENMWLGHPGFIKKVKDWWLESNPTVKWSGMRFHKKLQHLKGRIKEWNLLEFGRLEERKQMVTAQIEALDSKEGRGCFTEEDKEQRWNLRKQLEDCLLQEEISWRQKSRCKWLKEGDRNTKFFHAMANGRRRRNYISSLEIEGATISNQSEIAGAFANHFRSIFRRPLNNRVWIEGLEWPTLKLEEREWLERKFXLEEIKEAVFSMDRSKAPGPDGFTMAFYQDCWEILKEDLRIVFDEFHSRGVINPGLNSTFIALVPKKRNANHPRDYRPISLVNSLYKIITKVLSIRIRKVLPTIIADNQGAFVKGRQITDQILIANESLEEFKRSKKKGVVCKLDLEKAYDMVDWSFLLEVMVNFGFGDRWCKWVMGCIRKCHYSILINGTVVDFFPALRGIRQGDPLSPFLFTMVAEVLGRLISRADSRDLIRGWRVGRESVPLTHLQFADDTILFCEGGDLNRIRNLKLTIQLFEQMSNLKVNFEKSCLVGVNMGEGETSECADILECAVSNWPLNYLGLPLGDNPQKDEFWIPVVERFEKRLATWKKNYLSLGGRITLIRSTLANLPVYFLSVFKIPAKVASRLEKQMRDFLWEPGEEKKDHRVRWEMVCRSKREGGLGIGNIRSRNLALLGKWLWRFSLEKDKLWVKIVGSIHGVADNGWDSGIVARTTRAAPWKAIQAILPLFSPWIRYDLHSGNLINFWEHIWIGDSPLKDQFPSLFTLSTLKNEPVSSFLVPSNSTSGFSWNLGFRREIRDTEFDCILSLLSILEGVFLEPTKTDSRIWSLTPSGSFTCASFFKALTQPPSLGLSFPVKEVWCLPIPPKVGSFCWEAFLERVNTCDLLQRKRPNSCLCPHWCALCKADGESEYHLLISCRFTKSIWEWCTSLFGCRWPPL

SEQ ID NO: 3273 - protein, 1015 aa, synthetic construct
  source 1..1015: note = Description of Artificial Sequence: Synthetic polypeptide
MTRRGQSHPDAPGLTKPLVHPKHAMRIGNWNVRTLYSSGNVAQAAREMGKRDIDIMGISETHWTGQGKMQLRDGETMVYSGREDNIHREGVGILMSKNAAACLIEWTPWNERMIQARFYSRHIQLTIIHIYAPTEDADEHLKDEFYTRLQEVLDSRNQHDMLIITGDMNAKVGDQNWDYERVMGKHGLGVRNDNGERLCELCDLNELVITGTLFPHRTIHKATWISPDGKTKNQIDHVLVNKRFRNSVKDTRVFRSADVGSDHYLVCATVKLRLRKDPKRKGNIRVKYDTSKLTEKEVRNTFNIKLRNRFQALEQEDEEERGEEVVDAKEEVERDFTIMKKALLEVAETVLGKPRKKNKPWISGESWSLIDERQQMNEKILSTRSERVKGQLRKKYREKDREVKRSLKADKKKWLEEIASEAEKAARSQHMKTLYGLTKKLCNERPRHSTAVLDKDGNLLSKKEEIQRRWTEHFREVLNREQPDNPIEPEDEVEFEFGELIEEISVNEPTFGEVKDTITTLKNGKSPGIDNITAELLKADPEFSAERVHKLLVKVWRHETIPNDWKKGLIIKLPKKGNLKECKNSRGITLLSIVGKILGRIVIDRIRNGVDKKLRKEQAGYRRGRGTTEQVFILRNIIEQVNEWQATLYVNFIDFEKAFDSVHRESLWVIMEKYGVPEKIIRIVRLFYEDFQCAVEDQGETGEWFNIKTGVKQGCNMSGFMFLLVMDWILRRSVGKGENGIRWKFTSKLDDLDFADDIALLSSTKHHIQEKTAKLDGEARRAGLKINLEKTKMLRINAKQHGNIVINGKEIEDVSEFTYLGAKVCREGGGMKDLRNRLSKARSVYTRLKRIWNSKKIMRRTKIKIYKSLVLSVLLYGCETWKMNKKDDKLLDVFQQKCLRRILKISWEDHVTNEEVQRRAGVHQLSSEVKRRRWKMIGHVLRQGRENDCSVALTWTPEGRRKQGRPKTTWRRTVERERGEAGWRNWDEVRSKAADREKWKSTVKALCATRHEEDR

SEQ ID NO: 3274 - protein, 1149 aa, synthetic construct
  source 1..1149: note = Description of Artificial Sequence: Synthetic polypeptide
MAANFLTPVFIAFLAILFNQKLHYSPNLTSGINGFGLNCILANSESILTGLEAFYSHNIRANKMNVGRSSSEHKHLLLCLLLLGGDIQLNPGPKWKFPCGSCNKPVKSNQKGIQCDNCNLWYHTRCCSINDDLYYTLAASSCTWLCVSCGFPSFSSSLFESSSIELQNSFSSLDSLHQDTQNISSSTIRSPETSPLDSSSRNSSNTRKQSKEKLTGMILNCNGLKGTDHITKFQALINLHDPDFILGTESKLCPDISTYSIFSQNYSVFRRDRNKFGGGVFQAIKSDLVCTEEPDFEVDNCEIIWTSLKLANRKSIYMSSYYRPPNQPSDSIDNLNESIRRVFNKVKNFPNIIIGGDFNLGDIEWNSSVPTPTNPATASLHQKFLQTIDDFSLSQHVKTTTRPSSGKTLDLLLTTYPNVIVNTSTASGLSDHLAVIFEVNLKPSRSLKPPHKVYQYKKANFPDLCKFMSDSSTTFFSTNPEKRTVEENWVLFKTSLSTGISQFIPQKSSRPKYKLPWINTNIKREMRKKDRMHKKAIKSKNQQHWEAFKRQRNLVSKLIKDSHNDYLNNIIGNSLKDNPKKFWSYVRSSKSESIGIPPLKNNDSSVSVTDAHKAETLNTFFHSVFTQEQLPTPVLGNSPYSSIPDLHISAEGVCKQLSELNPKKACGPDEIPANVLKEVSQSISHWLAFIFQQSFDCNKIPSDWSNALITAIHKKGLKSEPANYRPISLTSICCKIMEHIILSHMAKHLSSHNILINQQHGFREKFSCETQLISAIHDWAKTINFRGQTDVLLLDFSKAFDSVPHQRLLIKLDFYGIRGNMLNWIKAFVSNRKQSVSVNGTVSSSKSVVSGVPQGSVLGPVLFLLFINDISTSIQSNLRLFADDCVLYREVASLQDCQALQQDLDRLSVWSKTWQLKFNVSKCYHLGITRKKIPVKFTYSMDGKCITQASSTPYLGVTIADNLSWNEHCDNICKKANSTLGLLKRILSGCSPEVKDSAYRTLVRPKLEYATSAWNPYTQCNINKIEMIQRRAARFVFNDYSRYSSVSPMINSLGWESLEQRRQLNQAHMFYKIYNGLVGISFPPEVTPITRVSRQPNCAPFHQLVTLNDTYKYSFYPRTIRTWNSINLSTIPDSLAKFKDSLLLKVQTN

SEQ ID NO: 3275 - protein, 1024 aa, synthetic construct
  source 1..1024: note = Description of Artificial Sequence: Synthetic polypeptide
MINNPSNVVPVYFCLPILAFWSFLPCYFHLKAVDRGSHVATLTSEPVASTGWSYSNQELKTIRKSQPKQRLEPKLWQKLGDLGIRKPFRSRRKPRQSRHVCTGLPVVTTVDSTGHPQLSSGCSTNSSSSQTARFPVIPDTIIANMQSLLPKLDELYAAIMQFPAGIICLTETWLNESHPDPLIHLPGYLCFRNDRTTSRGGGVCTYINSQYPCRRLPEFEDLSIESLWISVRPYRLPRSVSTLLIGVIYHPPSNGEMNRQLVDHIDKNCESFLSKHPDGLVVVTGDFNPSSTGIKAQYVTHKTGLTQIINVLTRDTGILDWCLTNKPKYFQQPLQLSKMGSCDHYPILIKPNLSVTNPKAHKSSVWRRNLRRSNLDAFGRWITQFCWNTILSLQTAREKFERFYTVITDAVNTYLPLQRVQVCATNKPWIGTSLCSLIARRQKALTTLGKDSRLYKELRNQVQRECKVCRERYYPNKVAALKESNISRWWQEVKCLSGSVVSNEWWHQLMDDSTPSVQILAERFNEFLLGLTSNFAPISQQVTCSGPVPPELLITPGKAFKALSRIKVKKSSGPDPVPSVIWKEFAPELSDVVCNLYNSSLMEGFVPQELKESIVHPVPKCSPPKTLSEDLRPITLTSQLAKVMEGFALDSLFACVKDKLDPKQFSVSGKSTVLALVYFLHCILESLERGENYVRIFFADFSKGFDLVDHNVLMSELDLLGVNEYLQNWIAAFLTARPQRVKISGHTSSPVFPNGGIPQGTKLAPLLFAILVNRLASTWPYRIKYVDDTTIFEVIPRCSPSYLPFIANDICNFATERGMRLNPKKCRELVINFLQYQPSPVNALQLMGSVIKRVESYKILGVHISSDLSWNKHVDYVVKKANKRLYALRLLKKSGVPVQDLIAIYCVLIRSVVEYAGPVWANITGFLVDIVEGIQKRALRIVLPHLRYKEALETSGLQSLADRRRELCISLMTSAKELEPLRSVITGGVINNVHGYSLRSGSMNTYKHISVTKRFGDFVTYRFL

SEQ ID NO: 3276 - protein, 2244 aa, synthetic construct
  source 1..2244: note = Description of Artificial Sequence: Synthetic polypeptide
  VARIANT 2: note = Ile or Leu
  VARIANT 140: note = Any amino acid
  VARIANT 143: note = Any amino acid
  VARIANT 145: note = Any amino acid
  VARIANT 197: note = Any amino acid
  VARIANT 218: note = Any amino acid
  VARIANT 232: note = Any amino acid
  VARIANT 248: note = Any amino acid
  VARIANT 255: note = Ile or Leu
  VARIANT 265: note = Any amino acid
  VARIANT 283: note = Any amino acid
  VARIANT 316: note = Any amino acid
  VARIANT 350: note = Any amino acid
  VARIANT 358: note = Any amino acid
  VARIANT 392: note = Any amino acid
  VARIANT 405: note = Any amino acid
  VARIANT 411: note = Any amino acid
  VARIANT 418: note = Any amino acid
  VARIANT 423: note = Any amino acid
  VARIANT 465: note = Any amino acid
  VARIANT 516: note = Any amino acid
  VARIANT 909: note = Any amino acid
  VARIANT 958: note = Any amino acid
  VARIANT 1134: note = Any amino acid
  VARIANT 1141: note = Any amino acid
  VARIANT 1145: note = Any amino acid
  VARIANT 1174: note = Any amino acid
  VARIANT 1176: note = Any amino acid
  VARIANT 2015: note = Any amino acid
  VARIANT 2069: note = Any amino acid
MXKALHGGPWFILSHFLTVRGWEPKFKASSTQLTYSALWVRLPELPTEFYDLEILSRIGSKLGRLLKIDTCTSSTTRGRYARICIEVPLEKPLKTHLYIGNHRQSLLYEGLNLLCTYCGRFGHPTTSCPEVVRAPNEQNXRNXQXESNSTPDTIPSKENEWKTVTFTKKSIHPPKHLNFDKGKAATMAATPAAQPLXGQSSNPTSAVLGRVTSTRQVXLQGPVIEFNNKFQXLSNAGPSDLQTDHFYXGPIPKNXGTEPLLTQQXAKAHFHTPDKLPTSLPNXLPNDPKPRLSEPNPHLTKSPPLVGYNTFSQDYXTPHZPLPCNHLLTSSTQSSSNNSEGPLHILDTLXPTQNKAIXTMHATVTSLTSDSRLPQNPCKQHDEFPCEHHHEXPTTLFPSLPNIYXHSIQTXKPNTTLXAEPQXLPNPILNAETNLHRHEPESVSEGKYTNQQPVFSSPSSHNGGXSTASEFITSNLHISAHDHGPPSPILVGNGTAGICSNIHSATQQPRGGVANXKSDSFSRNSDRRNEAGNGSLQSKSMVHDPDSSSNGTPGFQFHSSAMAISNGPDESDLGPNSQSPTLLPTSSYGSGLCTLVPATGLIQSTLPLLEPTESSRESHPTKQSSTITSSISTRTRQRYKRGTDSNSCGDEGDKNRILVVKRDPILQPQRTVRKKFILKCPPEMVTCSLNFRQTTNPEVGKYAMVIIPTLLQLPLSLDPMTSSVVHPVTQAPMSQPRNPNSYMNFLVWNCRGSHNPEFRRHFRSLLDNHRPTLAILLETHMQDHASLREDFNFGNMAQAPANGLIGGLVVLWNADLINVTEMRISDQEIHCMVQVSPTKPPWILSAIYASRHYQLRDILWNSLINLHDNTAMPWLIGGDFNEILESKEKFGGLPMNNNRADKFANFMHXCSLIDLGYQGSRFTWTNKQRNGVPYTKKWRTILERLDRFLANYDWLNLXPNTTVIHLPRTHSDHCPLLINLEPPQPIQNRIFRFETMWASHPQFQQLVHATWSNDVPLLATTDNFKRVVTRWNQNTFGNIFQQKRKLLARLAGLQSSVHYPTSVFLQNLETQLTLEYSHILRIEEEFWQLKSRINWLNEGDANTRFYHLSTLHRRRRNRINALQDNVGNWVATTXEIHDLIXNYFXDLFQTDQLISENMTGNTYNCEISSDDILXLXSPLHQDEILTALNSFKAYKAPGPDGLHPIFLPKILDGCRIVLRHTKPQDQMGYIQFFYQKYWTDVGDKVSSFCQDVFCSKIIPPELNKTLICLIPKVKHPTRIQQFRPISLCNTVYKLITKIIVNRLKPIISKIIGPTQTSFQQGKRACDNAIIVQESLNYLAKMKGKYPSMLLKLDLEKAFDRLEWSFIRRALFYFNIPPSMISLIMSCVTTTSISILINGSKTQYFTPTRGIRQGDPLSPYLFIMCMELFSRSISLSVDYLKWQPIRLSNKGPLLSHLFFADDIILFSKITTKSCHAIIDVLNNFSKYSGQKINFEKSKLFFSKNCSSLIKILLLLPLTLKKEPLLVNTWDFLCSKQDPKMQISSSSLIISKINLLDKDFVITSFNIKEGTSFGKYLGFPMFQARPKNADFQFLLDNFKNKLAGWKSRFLTLAGRATLIKSTLNQLPNHIMQYIHIPAHILNKMDQYQRNFLWGTTLEKKKLHLVRWNEITRPKEAGGLGIQKLRQKNHALLASLAWRLFKTPQAMWANILLTKYLNTSPNNIHSQIWSNVINGWHQCQLGIKWNIGKGTHIKFWEDPWIGPGTTIRSKIHGPLPLDQQNITISSLINNKGWDWNKLPFELPITLLKVAHNITQIIQATYISKYSNKVDNIFWGLTPTGHFTTRSMYSILEAQHDVSTNSSTKYNWIWKLPVQPKIKGFVWLLHKKRLPTKDYLRHINLIQDATCQFCHQEDETIRHLFLDCTNAKTFWQDLGILDFINQKLHYTNSFNWVHDLITCKDFHFPYQMNPATYLPLSLWNIWLARNNNCYKHTMSTASAKLTTQQAAKFTYLVAKKHTXVKKRQQNLKWKPPKEHFYKLNTDGAHTTSKAGIGGLIRNSKAEWILGFAAAVPXDSSTSAELRALLQGLQLAYSHNLVPLEVEVDSQDIITLLYSNNVSFDNLTTDCRYFLDRLGKPVVLHAYREQNRVADKLAKAGCNFDIHSVVRILEDNPDFAWSVFEQERSAVQGHVLEHFRPHSDNYDTVNRYCNSDAVGSSINIGLYNTLAPTTGASACNRMQYRHPPSVRNT

SEQ ID NO: 3277 - protein, 343 aa, synthetic construct
  source 1..343: note = Description of Artificial Sequence: Synthetic polypeptide
  VARIANT 32: note = Any amino acid
  VARIANT 34: note = Any amino acid
  VARIANT 42: note = Any amino acid
  VARIANT 50: note = Any amino acid
  VARIANT 56: note = Any amino acid
  VARIANT 104: note = Any amino acid
  VARIANT 138: note = Any amino acid
  VARIANT 156: note = Any amino acid
  VARIANT 223: note = Any amino acid
  VARIANT 330: note = Any amino acid
ERKLYNFPNEYRCKNFKYQKDYNNISQEYIMXKXDLYQECRXGSILGKLXALIISXTKLTKIILSQMQKKAFDKIHPFLLKTLKSIRINGSFLKIISSIYLKPXASIICNGINMPFQDGNKDVHYHHYYSILYKCLQXKKKKLKELEAKKKQNYHXLQMIYTRILENQLKNYLKLSTKKLLEIINNFSKVAGYKINPHKSSAFLYITNKTQQQEIEREIPFKXTVDNIKYLGVYLPRQTQELYEHNYKTLFTQIKSDLNNWKNINCSWVGVNIIKMTILPKLIYLFSAIPIKLPKLFYRARKKYQNSSGRTKGQEYQGNKEMLGKVAPPXILNYIIKQQSSKP

SEQ ID NO: 3278 - protein, 935 aa, synthetic construct
  source 1..935: note = Description of Artificial Sequence: Synthetic polypeptide
  VARIANT 204: note = Any amino acid
  VARIANT 212: note = Any amino acid
  VARIANT 894: note = Any amino acid
MIPLTISTWNVLTLIDNTKSSRPERGTALVARELNRYHIQIAALSETRLANEGQLTEVGAGYTFFWSGHSEGECREAGMGFAIKTNLISKLVCLPKGVNDRLMTMLPLAGKHHATIISAYASTMTNPDEVKEKFCEDLETLIINVPKEDKLIILGDFNARVGSNYQTWQGVLGRNGVGNSNSNGHLLLKTCASHDLLITNTVFXLPKCNKTXWIYPRSKHWHLIDYVIVRRRDRQDVRVTKAMCDAECWTDHRLILSKLNIHIHQKYCPQGKMTTRRINVNKLELFSESEQFVADLEGKLSQHIVGNSGAEKEWAAFRDLVYSTAFAHLGQNTHKHQDWFDENDGEIQKLLNEKRELHRIYQQDSSSTSKKAAFNSIKSKVQAKLREMQDSWLSKKADEIQFYADSNNPKCFYDSLKAIYGPKTYGASQLLSADGATLISDKDMILERWAEHFHSVLNRPSSINAEAIDHLPQVEVNPSLAELPTEEEVLRAIRLLSCGKAPGADSIPAEIYKVGGPLLIQKLTEIFQVIWQEEVIPQEFKDASIVHLYKGKGNRLSCDNHRGISLLVIAGKILARVLLNRLILHLEDGHIPESQCGFRKGRGTVNMVFAARQLQEKCQEQNRGLYTTFVDLTKAFDTVSHEGLWKIMSKFGCLEKFINIVHQFHDGMFAWVLDNGQCSRAFPVTSGVKQGCVLAPMLFSMMFSAMLTNAFNEDEHSIKVNYHTDGKFFNLKRLQAKTKVEGVLVHDFLFADDCALNAASEAEMQQSMDQFSAACANFGLIINTKKTQVLHQPPPHHPYVEPSVTTNGEVLNAVDKFTYLGSVLSRDVHIDNEVDTHIARASSVFGRLRRKVWERRGIRLTTKLKVYRAIVLTSLLYACETWTVYQRHARKLNXFHLNCLRKILRITWQDKVPDTEVLAQAELPSIQTMLQRVQL

SEQ ID NO: 3279 - protein, 867 aa, synthetic construct
  source 1..867: note = Description of Artificial Sequence: Synthetic polypeptide
CLPPSLLVSLSSFELELFELGCSPPVLCAVVYRPPKYNKDFLNEFSGLLAEILLKYDRVLIVGDFNIHVCCPDHTMSKDFLSLIDSFNLVQHVSEPTQERGHTLDLVLTYGLSVSNLVICDAVFSDHMPVLFDITLPCSPCRPRAPARWVRIINPSTAALFSASFNQTSVIPQSTCSSTDELSSWLHSTCLTVLDAVAPLKSRQPKVKTEPWLNNVTRAARRECRKAERKFKKDKLQVSLQMLKDSWRHYQATVKEAKREHLSNVILLNRHKPRVLFSTIDAALNAPKSVCVQPTLETCETFLKFFVDKVNNVRALISPPGFDPSVVVSCPVTFDQFEPVTLSVLYETVKHLKPSGSPSDAVPPRLFKEVITTLGPAVLAVVNGSLSSGVFPRNCKHATVQPLIKKPNLDPSVLSNFRPISKLPFLSKILEKIVYVQLKDFLDENGNLEVFQSGFKSLHSTESALLRVFNDILLATDAGDHVVLVLLDLTAAFDTLDHNILISRLQQLVGIRGTALQWFRSYLEDRTFCVNLNNVQSSSAPLLYGVPQGSVLGPLLFSLYLLPLGSILRKHNCAFHCYADDTQIYVPITKKDAHSISPLIKCLEELKIWMALNFLHLNEEKTEVIVFGPSGNSESHPSHTLVTPESHPIALGSLTQSVKSTVTNLGVKMDNGFNLDKQISSVVRSSFFQLRQLAKVKSFLSRKHFETVIHAFVTTRLDYCNSLYFGAPHSSLSRLQLVQNAAARLLTGTWKREHITPVLASLHWLPVHFRVRFKILLFVFKSLNGLAPPYLSELLHLHSPSRSLRSADQLLLDVPRTRRKLRGDRAFAVAGPSLWNALPMQVRQARSLNDFKSKLKTHLFSLAFNSV

SEQ ID NO: 3280 - protein, 588 aa, synthetic construct
  source 1..588: note = Description of Artificial Sequence: Synthetic polypeptide
  VARIANT 308: note = Any amino acid
  VARIANT 585: note = Any amino acid
MRGSAGRKANTNWLRPLKEAPKPEEAASTTTPPPSFNMALFNVRSLSNKTFIINDFIHDYNIDGLFLTETWLSTDASTVLTEASPPNFSFVFSTREGKKGGGTASIMSNSFAVKQITLDEYPSFEHHAFVFNSPPVLCITVYRPPKPSSVFIEEFSEFLASVHTSFNMILITGDFNLHIDGKSDYCTTQFLDLLSSLDFKQHVMQPTHNRGHTLDLVISHGLPTSVSAVVDLAVSDHYCVLFNITGFIKQETSVRTVKKRYLTPEVVEKFITSVRSYSPPVLPAPCDLLVESFNSKLKSSLDSVAPLXSKKIRIKATPPWRTEEIKQLKRRCRSAERLWRKHKLEINYQLYQNQLKLYNQTVKQTRNSYFANIISVNKNNPRVLFTTIESLINSNVNKNTMPASASLCEDFADHFRSKIDSVRSNIIKGQKSLFIGNDGLILPEEALDSFDLVEAATLGRVFSQVNPTTCFLDPIPTSLFKSFYGSFESEILNIMNSSLQTGIFPAAFKTAVVKPLLKKTNLDPSVFNNYRPVSNLPFLSKVLEKLVFIQLNEFLLQNNIFEINQSGFRTNHSTETALLKIVNDXRCA

SEQ ID NO: 3281 - protein, 304 aa, synthetic construct
  source 1..304: note = Description of Artificial Sequence: Synthetic polypeptide
TYVRSAAGDSDRFGVSVGLHQGSALSPYLFLLVMDALTLNIQEEAPWCMLYADDIVLVGEDECEVQSRLEEWRVKLEGAGLKISRTKTEHLFCDFGGPTSFSPIALNGVPLPTCSDFKYLGSLVQSDGGVDRDVKSRINAGWMKWRQVTGVTCDPRMPLRLKGQIYKSIIRPVVLYGSECWATKVADERRLHVAEMRMLRWMCGVTRLDKVKNVYIRGSLKVAPVVEKLRSKRLAWYGHIMRRNDGDINQKVLRLNVDGYKGRGRPKKVWMDCVKEDMLKKGVDSDMTADRDVWKSSTYCADPP

SEQ ID NO: 3282 - protein, 1011 aa, synthetic construct
  source 1..1011: note = Description of Artificial Sequence: Synthetic polypeptide
  VARIANT 715: note = Any amino acid
  VARIANT 846: note = Any amino acid
MMATRKVRPPVPGGPAVPGYGSGQGNGGAGGAKNPRLGYGYHTRRPLALATLNTRTLRTDERIAELEEELSRLRWDIIGLSEVRREGEETIILKSGNLFFFREGDQQSQGGVGFIVHKSLVNNVVKIESVSTRVAYLILRISKRYSLKVIQVYAPTSTHSDDEVETMYEDISRAMHSSKTFYTVVMGDFNAKLGIRDGDELRMGKFGYGRRNHRGHLLAGFMEKEGLYMMNSFFKKQGHRKWTWMSPDGATKNEIDFIMSTKKQIFNDVSVINAVKTGSDHRIVRGTLNIDVKLERCRLMGSTLRPAPVHIHNAETFQLELRNQFECLGSSVDDLNDGFVHALQSVGSKFYKTHRKSSPKKLSDHTLELMKERRDMKLHSSDDAERYRRLNRQISTSIKRDIRRFNTNRVKLAIERNQGSKVFSRDLSIGQSQLLKLKTGEGRVVSSRPELLSEVERFYGQLYATQEPVTDLVEDPRARLTRHYTEDIPDVSLDEISMALKQLKNNKAPGNDGITAELLRAAGEPALKVLQKLFNSVILEGHTPKAWSRSVVVLFFKKGDKALLKNYRPISLLSHVYKLFSRVITNRLARRFDDFQPPEQAGFRKGFSTVDHIHTLRQVIQKTEEYNLPLCLAFVDYEKAFDSVETWAVLQSLQRCRIDYRYIEALRCLYENATMSVRVQSEDTKPIHLQRGVRQGDVISPKLFTAALEDVFKVXKYCHLPETLHRGVGRRFQGPEILVVTYTFLHVTFRVQVIGSLLLLRILIKIGTMLEDLNRASERVGLRMNMDKTKVMSNVHVSPTPITIGGHTLEVVDEYVYLGQTIQLGRSNFEREVNRRIRLGWAIAKXNNRRSGSCGISSRPKTYRSVSRQKSLTSVCCQHTGQRRGHSLRATSGGSKSLKGQWSGQCSESLCEIASGTMRSAAESVTDIARRIANLKWRWAGHIARRTDGRWGRRVLEWRPRIGRRSVGRPPARWTDDLVKVAGVHWMRAAQDRALWQSMGEAYVQQWTTYG

SEQ ID NO: 3283 - protein, 310 aa, synthetic construct
  source 1..310: note = Description of Artificial Sequence: Synthetic polypeptide
  VARIANT 28: note = Any amino acid
KSEHSRQVRSRRNRQVQCGCGPAPGIGXSPYLFLLVIDALTVEIQEEAPWCMLFADDIVLVGEDALEVQSRLERWRDKLETAGLKISRAKTEQLFCDFGGLSSFIPIALDGAHLPVCSDFRYLGSLIQSDGYIDRDVTNRIKAGWMKWRQVTGVICDPQIPLKLKGKIYKAVVRPVMMYGSECWAVKGTDERRLHVTEMRMLRWMCGVTRMDKIRNEYIRGSLRVAPIVEKVRSKRLAWYGHVMRRDESHVTRRTLVMSVEGYIGRGRPRKRWMDCVKGDMIKKGVMTEMTYDRVMWRTKTCCADPTGVG

SEQ ID NO: 3284 - protein, 1024 aa, synthetic construct
  source 1..1024: note = Description of Artificial Sequence: Synthetic polypeptide
MMRPRSSSLSLTKPNQIKQLNTSNQKRNNPNPAGHRGVARPLPPKSMSSGSKLKSKLYLATLNVRTLMEDHRLIELEHAISQIKWDIIGLCEVRRSGDEIREYNKYIFYYKGEKKGRRGIGFLINKYLKDKIISFEGISDRIAVLNILNGFKHPMSIIQAYAPTEQDTNAEKDKFYEKLTEVIQKSNKNIIVMGDFNAKTGVKSNKDEFVLGKNSCGERNENGQRLIDLCFASNLKIANSFYKKEKSSGRGCLQTEGTEMKLISFQFLQKRKVKWTWMSPNGRNRNEIDFILTRETRILSDVSVINKLNFSTDHRMLRGTLICEDKNSRKHIISNKNGKTITVPHNILEDIEKTLQDIKKQQTIQDKYDFLEKTLKEVNIFGTKRGKRNKLNEETKKILEERNELLDNRRENRHSIANISKKIQSSIRKHRKEERLKTLKEQIEKTGGMTKGLKQLKEYSQWIPNIKLQKKKETYRITSRRSSIAKTATEFYKQLYTESGESIVASKNIIEEGDSNEEEIPTILETEVAGAIRSQKNDKAPGDDKIPNELLKSTLSSITKALTILFNEIINSEQIPVQWTKSTITLLHKKGDKQDINNYRPISLMSNIYKVFSKVILGRVTQTLDANQPREQAGFRADYSTMDHINVVKQIIEKCNEYGQNYYLAFVDYSKAFDSLSHNYIWKTLASQGIERKYINIIKEIYKNSTAKIQLEQVGEEFKIERGVRQRDPLSPKIFTAVLENIFRNIDWDKFGININGTKLNHLRFADGIVLFAETPETLRTMLQQLDQESRRAGLSMNPMKTKLMTNAEKDIIELRHEIIEYVDEYIYLGQIISVNQHSKEIDRRISNAWKRYWSLKEVVKKKSIPMSIKTKLYNTCILPCLTYGCQTWPSTTKHNLKLANCQRHMERSMLDIKLRNRWRNVTIREKNKSKEKKTKVNDVFKKIKKLKWNWTGHIIRTNKGKWTKDIMDWYPREGKRQRGRQIKRWEDDLPKGWRRLARDRETWKKLGEAYVEGQPDTQLDAGK

SEQ ID NO: 3285 - protein, 1446 aa, synthetic construct
  source 1..1446: note = Description of Artificial Sequence: Synthetic polypeptide
  VARIANT 860: note = Any amino acid
MGGNKKGRNKTQFKPVILNSTDDLDQELEPQETRGVNECTLCLTSKQSKMIQCVLCEENNFHASCLALNQSGRYHAPVCPSGHGCSVNERSTEKQHWVCTGCRGPTTNATPKVACTKCEFLFCAPCAKLRPGMIDMFNRFPKSFMWNCERCLQVSTQNRKCVASDTKESVGESPKTAGEEPLQKYAETGDHDVKEISYEIAQSTVQKRSSSGGDWISKNEKKPRICKYYAKNQCKYGISGRGCKFFHPKRCPRFMKYGRQGCNSKRECNFFHPWLCQESFRNGTCFDTTCPEIHLKGTIRAAPTAHHRHTHAERGENSGRPWQNSNRIQTNKYGENNHQYNVERDITANDRDMSVYNQDVRRDLQNMQNFLQTLYEKISSMETYMEKVQHGGPRAPWNPPRVENPTQLWGDPGTTHQLKTQTAIHHAKQNEHQELKSNKDEILSKVHVINIRGLLTKNCRKQMVLQDIINDAGSKLLAVTETHLDDAVNDAEVKIENYVLHRSDRKDRKCGGVALYVRDHLGSHTKQKFSNGVCDCIIVNIEKLRLMCVVCYRPPKCTTEKFAEMLQVINTHCKEVQSKYQLYITGDFNFPFLKWLTTDLPDETGSFVLSRTSSATRDEKDQALSLVRIMEEFSLTQMISSPTRNENVLDLLFVDNAQLIKNIEIQDTTLSDHRLVEITTQLGERDSHRPQKNSQINSISSLRDLNVHDKGINWDGLNAELQSVNWDVLLNNSIESESINETFENILLEKCMKYLSPAKRKFNKSRHHKFRKGLLKKRAKLIKCQQSTKLLQRKSECKKKLDEIERQLARSHDEEKQEKEKKAIEKIKSNSKYFFAYASHHSSVKSKIGPLVNDTGSIVXDDQEMSEILSRQYQKVFSDKIPNPEIPRIDLTTNYLTDFEFTKLSIELAIDELSGNSAAGPDDVPAKILKMCKLSISYPLYLMWRKSMDDGVVPLTYKHAIISPIPKAGNSMDPANYRPVSLTSHVVKTFERVFRKHLVHHLESNNLLTSNQHGFRHKRSTTSQLLEHYDSILDLLCQGKSVDVIYLDFAKAFDKVDHGILLLKLFNMGIRGKCLRWIEAFLTNRTQSVIINNKVSKRQPVLSGVPQGTVLGPILFLIMINDMGHQCKFAVPSSFADDTRILAAVQSTADVRNVQLDLTNIFHWTSVNNMTFNESKFELLRYGKNFSLTESTSYTTRDGSEIERKQILRDLGVRIQDNATFEDHVARVVTVGKKWSGWVLRTFSSREADTMLTLWKQLILPRIEYCSPLWMPSKRKDLERLEAIQRSFTAKIRGMKDLNYHERLAQLQMYSIQRRFERFTIIYVWKILEGITVNVNGRIQARHSNRIGRTCEVRIPIKTGGDAIATKYSNSFVVRGARLFNKMPRHIRNVTGTETAKFKHLLDACLLKVPDKPAVSGYVNCGDNSLLATPLVTDCSITSAQDGWRA

SEQ ID NO: 3286 - protein, 931 aa, synthetic construct
  source 1..931: note = Description of Artificial Sequence: Synthetic polypeptide
MVYVYLLFFACLITRYPDVEENPGPRGFGSRSCRILCTNVRGLYGNLAELAVASSNYDLVLCSETLVSSHRHVSELMIPNFEKPVLRLRDSCPGFRGLAAYVRKGVVVSRQSEYECPCCEMMVLRVCGSFRNFYLFSVYRSPSADDRVFDCLLDAMARIQSSDRRSAFAFMGDFNCHHVEWLGSGRTDCHGHAAFDFASASGCEQLVEGPTHLMGGVLDLLMTDVSDLVGVSVVSPIGSSDHGALSATLQVRQRVPRVTVRREIFLKSRVNWDAVSGAILALPWGVVRESTDPGSTLDRLLSDMVRAYVPSRFITVRTGDEPWFDDACRRAHQLKREAYARWRTSRSAVDFQLFREQRRRAGATYEEAEREHNLRSRELLASSVSAHKWWSTLKSAVLGVSSSVPPLIGTGGDLVADPAAKADLLLRYFDGKQSRDRVRIPLACDPEPRFSGFAFRSSEVHRLLLDLDPYGGTDPSGMFPFFLRRVAGVLAAPLASVFRRMLRLGSFPECWRVAHVTPVPKGSVSSRTSDYRPISITPVLSKVYERLVASRLGCFLEKQGVLPPTQYGFRKGLGTCDALLHISHVLQLALDGGHEARLVQLDFSAAFDRVNHLGLLHKLRLMGIGGSVLAVISQFLSDRRQCVVVDGKRSEFLDLVSGVPQGSVLGPLLFIVYTADLFHLVNNLLVGYADDVTLLAVCDKPSDRLEVSESIQHDLEMIDSWCSRWGMRLNAGKTKTMLVSRSRTVGPPFPALMLDGVSLPVVDDLVILGVNFDPKLTFEPHIRSVASRASQKIGLMRRAWRVFGSVELTRRCFNCFVLPLLEYCSVVWGSAADCHLCLLDKVVRRCAFMLGGVVPCDLAHRRRVGGVCFLYKIYNCPSHPLSEFLPDPFVRVRYTRRTGALHEFALEPLRCRTGQYSRSFFSIVCGCLEWS

SEQ ID NO: 3287 - protein, 1669 aa, synthetic construct
  source 1..1669: note = Description of Artificial Sequence: Synthetic polypeptide
  VARIANT 285: note = Any amino acid
  VARIANT 578: note = Any amino acid
  VARIANT 1033: note = Any amino acid
MKQCDECHSVFPLEFFYYEEVELESCKYCCKIQALQAEIEKLESDREAMQRGDGGEKEKAPREAHLRLSSPSPWKTVMRNKRQRRSTGAILEQTNHIKVNNRFAAFNDGDDNVATSVRPKIKLKTVNGEQHRGPPQSRDQKKSETSVQPPSHERERNPAPIPGQRAIKTFLIGDQIIKGQYYAFKRGCNDRKVICRPQASTSDATAILKDLRCKKMDHVIIHVGTNDLRTYSETQLQLVKDLIAAAKKKSDHVTLTSILPRLRAGNRLYSRIRYINGQIKREAEXNGLEFIDLFPSFDDDWRLFLPDGVNLNGAGHHVLGEMLLAAAASETAALEEGLRTRPKTIIEQPRHPAPFHALPADLPAMEQTATNVPAAVPCNPQISSPSGMKVGDPKGNEGTIITNSLDTDEEEITPTPDASVQMSRLGPPPLLPSIVSNLVSTNSNMSEGTDVPQPTNARQTDLDSSNTERGSPVSVSKEKSQSQTPVAKKRGQFPRTSSIPAHEGNRSTRKSGARNIPPKTNSCQPPQTRITRSKANSAGNDLLSARLGGKRPIVRQIAADVKQSDNCQAEIQNISLAXLQTGALAATDNAFADLTPPIFSQQSDAPSVSVTRRSNANTSVKFLFGNVQSITNKMNELQAIAATLAYDVIALNETWINLSNKNLEAEVALKGYKLFNIDRPTETGRGGGSIIYIKEHLNPLCKGFAATKEYEFITTHARLGIRQSLNIMLAYRSPRSTAETDAALYNKIENALNTPNETILMGDFNLPQIDWSTLCSPAPGSKLLELLSHHHLTQHVNEPTRYGNILDLVFSTPDCEIVDLAILDRLGDHNMIEFTLKTGNEFTTNASRLKLPDYRRANFQGMATEIETTDFETPMRDASVEQCSHILKTSILRAAERYIPNKRVRISNDPLWMNRTVKRCIAGDKCVTKPGSVIQQRRTGPVTSPLDESDSQTLHCRRQVRYKAWKRNPTEENRSSHIRACRDVKKIVRTTKREKEVSVAAMAKRNPKAFYKYVNERRLKKETIGPLKRPDGXITNDLRDKATILNDYFTSVFTVENVTNIPEPAPMQVAPINTCVFTEIEILQELTHLNVYKSTGPDNLTPRVLREMAPVIVKPLLEIFNRSLRTGEVPQDWKLANVIPIHKKGDKKSPSNYRPISLTSVVSKTIERLLKKRITDHLRMHQLISDTQHGFRNGRSCLTNLLDFFSKVTDIKDEEKGVDLVYLDFQKAFDKVPHQRLMKKLEAHGIQGDYLRWIRAWLTGRQQRVKLEGETSDWTQVSSGVPQGSVLGPLLFSIYINDLDLNIRSKISKFADDTKLCHPATKRAELQQDLDHLMEWSTTWQMSFNVDKCSVMHVGLVNPSTPLKMNGTELAAVTQQRDLGITITNKLQHSQQVDKSVKMASRVLGFITRNFEYKSKDIIVPLYKALVRPHLEFAVQFWSPHLCKDIDNMERVQRRATKLIPQLRNKPYECRLKELGLISLEQRRLRGQLIETFKYLNGFNDVPTTGLFERDLNDRLRNNGQKLKHKARRTTLSQQFFPYFIVSIWNRLPSDVVSAESVNAFKNRLDIHWERHPPQLRTPPPGVASSELLLQESQALNGQSFRGHLNPSSSLSRSNYTSLSSAYQRLLIVLACIHDRLFGWDSSPPSFSFFFLFLPFFSSLSPVLYILLT

SEQ ID NO: 3288 - protein, 1092 aa, synthetic construct
  source 1..1092: note = Description of Artificial Sequence: Synthetic polypeptide
  VARIANT 894: note = Any amino acid
MPCSGLFSAASYHPDWRCPSCAPQPPRPPSPPPASPLSPHPTNAPPLIVMQFNCNGLLHCRSELSAFLHSSNIAIAALQETKLTPSSSLPVFPGYTPVRKDRPAANGGGGLLFLIRQDIPYQQATTNHLFPNDHTVEHSGVTVTLCSSSLTLINIYVPPATSCPPGYRLDSSALFADSSADTLIMGDFNAHNTDWYSVTQDARAAARGEEISASINNGPYCLLNGDSPTRVPRDGPGSSPDLTVISAHLALDYSWSTTTTLSSDHLPILITAESSDSAPSGPRRTFVNFRKANWEEFTRECEELITSLPLPSSCSGGLRALNRALLSAAKHHIPAGHRKEYIPRLTPDARDAISRRDHLRSTSPHDPSLPQLQQEVDRLICGAAQEAWKQTIQDCDPKSNPSKFWSLLRSLSGKQSSVPRNQPISFGTHTFTHNGDIARGFCKQFTATSPPALATPPRLARRLLRKRHPIAHGFSPFTPAQVREAIVASGSSTAVGPDQLSILHLRHLGPQGIIYLTRLYNLSLAHADIPALWKLAVIIAILKPSKPADKGSSYRPISLLCPAAKVLERLLLPFINEAYQPAPHQHGFRPMHSTTSALLPLAFQATRGMNKPKPHDRTVALLIDFSKAFDTVPTEGLLSSVSGTTLHHNVVRWLAAYLRGRAACCLYNGSRSQFRAVKAGVPQGSVVSPSLFNLYVSDFPIPRDQLCYPSVTSYADDFTVVASHRDPLTAAAALSDHSASVSNWAANKGLTISTSKSNSTLWTTDTHQSTLDPGITMNDSALPLERRPKILGVTFDTHFTFTPHITSTAARASSRLRLLKALAGTRWGQCKETLLLTYRAFVRPLITYAAPVWYPGARQSAVRKLQTVQNAALRTATGCLRMASVDHLHAESKXLRIDQSLDLQCRQYLVSALRPEHPAHSVVTAQAGPRLIRHNLATKFQPDINHLLTDNIMPSPEYRSAISSLHRSAVQASLDRLPVNRVLGFAPPEISPDEAVLSRAARSTLSQLRSGFCSALMSYRHRIGLADSDSCPECHRAPHTVNHLFECPAHPTALLPTSLWDSPLSVTDFLCSLPSFSYLPPHARPPPEPPPT

SEQ ID NO: 3289 - protein, 943 aa, synthetic construct
  source 1..943: note = Description of Artificial Sequence: Synthetic polypeptide
MHRARSEKGGPQFRMEKIVQSTGYLKCLYTNARSLGNKQEELEALAQAKKYDLIGITETWWDDSHDWSAVMEGYRLFRKNRQGRKGGGVALYVREHYDCSELQYKEGEKLVESLWVRFKGANSSDVVVGVCYRPPNQVDEVDEAFFEQLSEASRSQALVLVGDFNHPDICWETNTAVHRQSRKFLENVGDNFLVQVLKDPTRGRAQLDLLLTNREELIGDVEVGDNLGSSDHEMVDFRILTKGRKESSKIHTLDFKKADFDSLRDLMERIPWDVNMKGKGVQDSWQYFKEALLKAQKETIPTRSKRGKPGRRPDWLTGEILGVLKHKKEAYRKWKLGQMTREELKCIVRECRGVIRKAKAQMELRLAKDVKDNKKGFYRHVNKKKVIREGVQSLMDEGGNLVTEDVGKAEVLNAFFASVFTDKVGSWTSVLSDARWEEDGQPLVGKEQVRNYLEKLNVHKSMGPDLMHPRVLKELANVIEEPLAIIFEKSWRSGEIPDDWKKANVVPIFKKGKKDDPGNYRPVSLTSVPGKIMEGIIKESILRHLNERKVIRNSQHGFTKGKSCLTNLISFYDEVTGSVDMGKSVDVIYLDFSKAFDTVSHNILASKLRECGLDKWTVRWIERWLEGRAQRVVINGSMSGWRSVSSGVPQGSVLGPVLFNIFINDLDEGIDCTLSKFADDTKLGGEVDTLKGRDRVQSDLDKLEDWATRNLMRFNKDKCRVLHLGRKNPKHSYRLGTNQLSSSSAEKDLGVTVDEKLDMSQQCALVAKKANGILGCIKRSIASRSRDVIIPLYSALVRPHLEYCVQFWAPHYKKDADALERVQRRATKMIRGLEHMTYEERLRDLGLFSLQKRRVRGDLIAAFNFLKGGSKEDGERLFSVVTDGRTRSNGLKLWWERSRLDIRKNYFTRRVVKHWNGLPREVVESPSLEVFKSRLDKALAGLI

SEQ ID NO: 3290 - protein, 1049 aa, synthetic construct
  source 1..1049: note = Description of Artificial Sequence: Synthetic polypeptide
MIPGLTEDLRSISNPRKTAVINNELRRLRMDIVALQETRLSSSGCLREKDFSFFWHGKPPEETREHGVGFAIRNNLVGSVIPPNVGTERMLKIQLQTSVGMANIFSVYAPTLTSAQEDKDKFYDELSIAISEVSSHEPLFILGDFNARVGSDHHSWPSCLGQFGTGKMNENGQRLLELCSQHDLCVTNTFFNVKPQHKVSWRHPRSKHWHQLDLVLTKRSRLGSVRVTRSYHSADCDTDHLLVCSKVYIQPRRFFRSRKEGRPRIDTGKTRDPSKVCEFVQALEEALPRRDDTDISKRWEQLRDAIYDTAISIFGKKTVKSADWFEAHTEVLTPLIEKKRQALAAYRSSPSEENLQALRFARSQVQQVARRCANDYWLQLCSKIQQAADTGNMRGMYDGIKQVIGPSQRKTAPLKSATGEVLKDRTKQMERWVEYYSQLYARETVVTERALNAIEPLPTMTELDAEPTMEELSDALKALSSGKAPGKDGIPSEILKCANGTLVSELYGILCQCWREGSVPQDMRDANIVTVYKNKGDKSDCNNYRGISLLSTVGKLFARVVLKRLHVLAERVYPESQCGFRAERSTIDMVFSVRQLQEKCREQNKPLYIAFIDLTKAFDLVSRKGLFAILAKIGCPPTLLSIVRAFHDGMRGTIVYDGSTSEPFEILSGVKQGCVLAPTLFGIFFAVLLKYAFGTATEGIFLRTRTDGNLFKLSRLRAKTRVLTKRLREFLFADDAAIAAHTLQELQSLITRFADACMEFGLTISLKKTQVMGQSVGNEPFISVLDYELEVVHEFVYLGSTISDNLSFDSEINKRIGKAATTFSRLTKRVWANNKLTVHTKVQVYTACVLSTLLYASETWTLCSKQEQRLNTFHMRCLRRILGISWQDKIPNSAVLERAGTVSMFTLLKQRRMRWLGHVSRMLDGRIPKDLLFGELASGKRPKGRPKLRYKDTCKRDLSALSISANTWHSLALDKYAWKQGVKEALAMYETTLVKEAEDKRALRKIRARDTRATSAYCCSQCGKDCHSRIGLHSHRRRCSNQSNRGANP

SEQ ID NO: 3291 - protein, 841 aa, synthetic construct
  source 1..841: note = Description of Artificial Sequence: Synthetic polypeptide
MLLVYRPPRCTADALLELADVVSDVALRTPRLLVLGDFNIHAEAVLSGPARDFMDTMTTLGLSQEITAPTHVAGHTLDLVFWTKGDRVLGIRDVATLPLSWTDHYLVKFRLSADLPLHRGGGPIKMIRPQRLMDPEGFLRSLRDCSAIMANGPVDALVDTWNTEVARAVDMIAPKRPLRASRAKFAPWFSGELMAAKRSVRRLERRWRRTRAESDRLRVRAELRAYSVAVLTAKKSYFSTRIASAQCRPAELFRVVRGLLQSGTRDEMEEPLAPRCDLFAKHFADKIARIRLDLDSGCCVSGAQNVLSAPPSLFSLDQFQLLQTEDVDKVLGGVRPTTCSLDPCPSWLIKSSREGMTGWVQGIINASFRSGMVPAALKEAVIKPLLKKPSLDPRDLNNYRPVANIPFLGKVLERAVALQLQAFLEETDYLDPFQSGFRPGFGTETALVALVDDLRREIDRGSASLLILLDLSAAFDTIDHGILLERLAELGIGGTVLQWFRSYLSGRFQKVELGGCYSTPWRLCYGVPQGSILSPMLFNIYMKPLGEVIRSFGGRCHQYADDTQLYFPVTSEPGVAATDLNRCLEAVMDWMKSNKLKLNPDKTEVLWIRRPSVRECGVVPVLDGVTLPLKEQVRSLGVLLDPFLTFENQISSVARSAFGQLRLIRQLRPFLNKHDLATVIHALVTSRLDYCNALYVGLPLKSLRKLQLVQNAAARVLTNTRYTEHIMPVLRQLHWLPVCFRAQFKVLVMTYKALNGLGPGYLKDRLLPYEPARGLRSAGEALLRVPPLMEIRLTSTRSRAFSAFAPRLWNSLPRDIRMAPTLALFRRQAKATLFTRAFIGV

SEQ ID NO: 3292 - protein, 815 aa, synthetic construct
  source 1..815: note = Description of Artificial Sequence: Synthetic polypeptide
  VARIANT 31: note = Any amino acid
YLRDFTEKPKSMNPCSHESFKSRINALYGEXFHLSVRAFNRQRDKKSQLIETLTFLKRCRDNKVIPIAFTLTSAAVSSPNSKRILFNASLSLISERIRVLRFELDSLDKTLLQSHLMLTQKMSPSDWNHVDNMTAASADSLSAKCKANLIAKFNLLSKKKPEPHITKLDVNKIVINQSNIPISDNLKTVLAKGLNFAVTPKHIPVEDIISQVDVALKGIGHIQADVARAEIATILKNAKKPISNISKNERSELANLKKRDDIVILSADKGNATVIMDKNSYNNKIQDLLNDGSYSKIKSDPTNSLTIKTNKIITSSTSLIEPTKRPSLKPSAARPPRFYGLPKIHKEGTPLRPIVSTINSPTYKLARFLSDTLLPFTGKTTSAVLNSTQLVSMVKDIVLSPDDILVSFDVVSLFTKVPVPDTITIIEDLVQHGLNPDVPALVRHCLTNTYFTWNGTFYKQNEGTPMGSPLSPVIANVFMEKFESDAIQTSTLRPSLWKRYVDDTFVIWPHGLPALNHFLDHINSRHPSIKFTMEVEKDGKLPFLDVLFERRTDGSLGHSVYRKSTHTDSYLKPDSHHHPAQKNSLIKTLYHRAHCISDQHHLASELKHVHLALKMNGYSDRTIRQAVSPTIQKQPPDTPIKIITLPYIAGVTKKISKILNKHKDPGPVQYSTQNPTNTKIQVRFNTVHKIRDLIPSVKDVIPDLQYPGVYKLSCTCGDCYIGETKRHISDRIREHKSDLKHGRTNSSAVADHCFNTAGSHDIVFSDTKVLCKPPGYYQRFVHEAIQIYKHRHNFNREDGFKLSNHWKDVINQVKL

SEQ ID NO: 3293 - protein, 490 aa, synthetic construct
  source 1..490: note = Description of Artificial Sequence: Synthetic polypeptide
  VARIANT 93: note = Any amino acid
IHKEGTPLRPIVSTINSPTYKLTRFLSETLLPFTGKTTSAVLNSAHLVSLIKDISLSPGDLLVSFDVVSLFTKVPVPDTIAIIEDLVQQGLNXDVPTLALPYQHLLHLEWYILQTRGGYPQWVLPYRQWCANFGTALPTLTSPGMVHSTNKRRVPPMGSPLSPVVANVFMEKFETDAIQTSTLRPSLWKRYVDDTFVIWPHGQPALNQFFNHINSIHPAIKFTMEVEKDGKLPFLDVLIEKRPDGSLGHSVYRKATHTDAYLKPDSHHHPAQKNSLIKTLHHRAHCISDQHHLASELEHVHQALRMNGYSDRTIRKAVSPAMGRQPSEDPIKTITLPYIAGVTKNISKILNKHKIQVRFNTVHKIRDLIPSVKDVIPDMQYPGVYKLSCGCGSSYIGETKRHVSDRVREHKADLKHGRTNTSAVADHCFNAVGTHEIDFSKTKVLCKPTGYHQRFVHEAIQIYKHRHNFNREDGYKLSNHWKDVINQVKS

SEQ ID NO: 3294 - protein, 521 aa, synthetic construct
  source 1..521: note = Description of Artificial Sequence: Synthetic polypeptide
  VARIANT 376: note = Any amino acid
QPPGYENQQYITDSTSLIEPTKRLSLKPSAARPPRFYGLPKIHKDGTPLRPIVSTIDSPTYKLARFLSETLLPFTGKTTSAVLNSAHLVSLIKDISLSPGDLLVSFDVVYLFTKVPVPDTIAIIEDLVQQGLNADVPALVRHCLTNTYFTWNGTFYKQVEGTPMGSPLSPVVANVFMEKFETDAIQASILRPSLWKRYVDDTFVIWPHGLPALNQFFNHINSIHPAIKFTMEVEKDGKLPFLDVLIEKRPDGSLGHCLQESHPHGCLSKTSKRDQMAHWDTVYRKATHTDAYLKPDSHHHPAQKNSLIKTLHHRARCISDHHHLASELEHVHQALKMNGYSDCTIRKAVTPTVGREPPEDPIKTITLPYIAGVTKXISKIMSKHKIQVRFNTVHKIRDLIPSVKDVIPDMQYPGVYKLSCACGSSYIGETKRHVSDRVREHKADLKHGRTNTSAVADHCFNAVGTHEIDFSKTKVLCKPTGYQQRFVHEAIQIYKHRHNFNREDGYKLSNHWKDVINQVKS

SEQ ID NO: 3295 - protein, 980 aa, synthetic construct
  source 1..980: note = Description of Artificial Sequence: Synthetic polypeptide
MAAHTVAAAQCLPGRCLVWLFMYALCLVLCTFCRASNTFSRHDLLKIGLCYERSVTSEFLRLHKIPVELARSPGSPWIIIPAGRRRRRRRERRQKRGCRAGALARLRRQPLKPPLPSLFLTNARSLANKMDELRLQTTANNVVKDSCILLFTETWLHSSIPDSAIELAGYTAQRHDRTVDSGKSRGGGLCVYVNNSWCTNTVTVDSHCSPDLEYVTVKCRPIYLPREFTVVMITAVYIPPDANANSAIGLLHGSISIQQSKYPDAVQIIAGDFNHADLKAALPKFHQHVKCATRGTKTLDKVYTNIKLGYRARPLPHLGQSDHLSLLLIPAYAPIKKTAPTITKTVATWPEGATQQLQDCFDRTNWGVFEHQDLEVFTDSVLCYIKNCIDTVTVDKRIRVYPNQKPWMTREVQQLLKERNIAFKSRDKALYSTARANLKRGIREAKADYRRRIEERLDSNDSRQVWQGVQHLTNYRANLGAADGDTALAEELNLFFARFEVTPPGTASPNPTVHSSLNLTVEEHEVRRTLRAVNPRKAAGPDGVPGRVLRDCADELAGVFTRIFNLSLEQSTVPPCLKSSTIVPLPKKTHISSLNDYRPVALTPVVMKCFEKLVRSHIIATLPRSLDPHQFAYRANRSTEDAVATALHAALSHLEQQGSYVRMLFVDYSSAFNTILPHKLVVKLGDLGLPHSTCMWIHSFLSGRRQRVRVGRHTSTALSLSTGSPQGCVLSPLLYSLYTHDCAPVHHSNTIVKFADDTTVVGLISGGDESAYRDEVERLTAWCRGNNLLLNTAKTKELIIDYRRKKTDTPPLTINGDCVERVADFRFLGVHIGEGLTWSANTSELLKKAQQRLYFLRILRKNNITQKLLVSFYRASIESILTYCICVWYTSCTVAQRKALQRVINTAQKIAGCPLPTLEELHSSRCIKKAQNIIKDSSHPGHSLFELLPSGRRFRSVKTRTNRFKHSFYPTAITTLNTAN

SEQ ID NO: 3296 - protein, 521 aa, synthetic construct
  source 1..521: note = Description of Artificial Sequence: Synthetic polypeptide
  VARIANT 6: note = Any amino acid
  VARIANT 9: note = Any amino acid
  VARIANT 11: note = Ile or Leu
  VARIANT 15: note = Any amino acid
  VARIANT 31: note = Any amino acid
  VARIANT 63: note = Any amino acid
  VARIANT 88: note = Any amino acid
  VARIANT 89: note = Any amino acid
  VARIANT 106: note = Any amino acid
  VARIANT 126: note = Any amino acid
  VARIANT 166: note = Any amino acid
TTYNNXIQXLXNDGXYTKINRDPTNRLATKXNNIITNSTSLIDSNKQRSLKPSAARPPRFYGXPKIHKEGTPLRPIVSTINSPTYKLXXFLPETLLPFTGKTTSAXLNSAHLVSLIKDISLSPDDXLVSFDVVSLFTKVPVPDTIAIIEDLVQQGLNPDVPTLVRXCLTNTYFTWNGTFYKQNEGTPMGSPLSPVVANVFMEKFETDAIQTSTLRPSLWKRYVDDTFVIWPHGLPALNQFLNHINSIHPSIKFTMEVEKDGKLPFLDVLIEKRPDGSLGHSVYRKATHTDAYLKPDSHHHPAQKNSLIKTLHHRARCISDQHHLASELEHVHQALRMNGYSDRTIRKAVSPAMGRQPSEDPTNTITLPYIAGVTKKISKILNKHKIQVRFNTVHKIRDLIPSVKDVIPDMQYPGVYKLSCGCGSSYIGETKRHVSDRVREHKADLKHGRTNTSAVADHCFNAVGSHEIDFSKTKVLCKPTGYYQRFVHEAIQIYKHRHNFNREDGYKLSNHWKDVINQVKS

SEQ ID NO: 3297 - protein, 1025 aa, synthetic construct
  source 1..1025: note = Description of Artificial Sequence: Synthetic polypeptide
MTTCSRSSLLRAKAQRMSSHRRPNARQRYPGLKSNSTESISQGQSNVNVGPSLRIMQLNIEGLSSAKCDYIAKILQFQDVDVLALEETHLDRQCPRSKIIGYTLIAASHHPKHGLATYVKNDLKDTVQVVPHTSPHYIAIKINDVTVVNVYKPPGMEWPCPALPQPSHPIIHIGDFNSHHTLWGYSANDRAGEQLTSWAAAEDQHLLYDAKDRGTFKSARWKKCYTPDLCFVSRDQNGNPMPSTRTILDDFPNSQHRPVVIHIGLQIPLFRCAPKPRWNLRSAEWVNFTADLEESVGMIPPRAVNYRRFVGLIKAVAKANIARGFRKVFTPCWTPESEQLFRKFNADKKQETAKALLESLNLQRRERWRETVEALDFAKSSRKAWRLLRLMGAAATPAYKPPQVSPDEIARQLINNSRTSIDKSTRRQVYKELYCTLDNCQETSEFSRPFSVEEVDAGIAQLKCGKASGLDDIYPEFIKNLGPRARKWLATFFTDIHSTSIVPKEWKEARIIAILKPGKDASDAQNYRPISLLSVCYKLMERLLLKRLMPTLEEIVPQEQAGFRTGRNCCDQVLALTSHIEAGFERQLKTATAFIDLSSAYDTVWRKGLLLKLAKAVPCRPTIRLITEMLSNRWFTVHLGEAASSPRRLNNGLPQGSVLAPALFNLYTSDIPATSCRKFTYADDIALATQARKMEDTEAVLEKDLKTLEEYFKNWRLKPNPSKSVVSAFHLNNRQASKTLNVNFCGAKLRHDEHPRYLGVTLDRTLNYHHHLKQAKGKTKARVNIIQKLAGTTWGSDASTLKISTQALVHSTAEYCAPVWGASPHTNLVDAEINNALRIISGSLKSTPLPWLPVLANIAPANIRRDDATTREYNKIMKNFTLPLHQDLKEPPRPRLKSRKPFWIRASALAAENKDTATRWSESWAAMDVANKNIIHDPTVEVPGFSLPRRLWTTLNRARTQHGRCAYTFHKWKIKESPNCDCGEVQTIKHITDECSIHAHPGGIAEIHTASTTSLDWMRNLCIHL

SEQ ID NO: 3298 - protein, 736 aa, synthetic construct
  source 1..736: note = Description of Artificial Sequence: Synthetic polypeptide
SLSHTSAAVSSPNSKQILFKASLSLISERIRLLRFELDTLDRTLLQAHLTLTQKMSPSDWNHVDNMTASSADSLSVKCKANLISKFNHLSKKNPVPHITKLDVNKIVINQSSTPISDNLKTVLARGLNFAVTPKHIPVDDIISQVDVALKGIGHIQADVARAEIATILKNAKKPISNISKNERSELANLKKQKKNRSDIVILSADKGNATVIMDKDSYNNKIQNLLNDGSYSKIKNDPTNSLTIKTNKIITSSTSLIEPTKRPSLKPSAARPPRFYGLPKIHKEGTPLRPIVSTINSPTYKLARFLSDTLLPFTGKTSSAVLNSAQLVSMVKDVVLSPDDILVSFDVVSLFTKVPVPDTIEIIENLVQHGLDPDTPALVRHCLTNTYFTWNGTFYKQNEGTPMGSPLSPVIANVFMEKFESDAIQTSTLRPSLWKRYVDDTFVIWPHGLPALNLFLHHINSRHPAIKFTMEVEKDGKLPFLDVLFERRPDGSLGHSVYRKPTHTDSYLKPDSHHHPAQNNSLIKTLYHRAHCISDQHHLTSELKHVHLALKRNGYSDRTIRQAVSPSIQKQPLDTPVKTITLPYIAGVTKKISKILNKHKILVRFNTVHKIRDLIPSVKDVIPDLQYPGVYKLSCTCGDCYIGETKRHVSDRIREHKSDLKHGRTNSSAVADHCYNAVGDHDIVFSDTKVLCKPTGFYQRFVHEAIQIYKHRHNFNREDGFKLSNHWKDVLNQTKH

SEQ ID NO: 3299 - protein, 776 aa, synthetic construct
  source 1..776: note = Description of Artificial Sequence: Synthetic polypeptide
KSKFHRLYGEGFHITIRSFNKLRDKKAHLIESLTFLKRCHNSKVIPISFTLTSAAVTSSNAKRILFRASLALISERIRLLRTELDHVDKTLLKSHLTLTEKMSTSDWEHVDNMAASSAATMSAKCKDNLISEFNLLSKKKPDPHIKKDVDKVVINLSNSPISDGLKSVLAKGLNFAVTPKHIPVDDIIAQVDVALKGLGHIAADVTRSEIAATLKSAKIPVSNISKDERFELSQLKKRDDIVILSADKGNATVIMDKTVYNDKIQDLLNDGSYTKIKRDPTNSLVTKTNSIITDSASLIEQTKRFSLKPSAARPPRLYGLPKIHKEGTPLRPIVSTIGSPTYKLARYLSETLQPFTGKTTSSVLNSAHLVSSIKDISLSPGDLLVSFDVVSLFTKVPVPDTIAIIEDLVQQGLNADVPALVRHCLTNTYFTWNGTFYKQTEGTPMGSPLSPVVANIFMENFETDAIQASTLRPSLWKRYVDDTFVIWPHGRPALNQFLNHINSIHPAIKFTMEVEKDGMLPFLDVLIKKRPDGSMSHSVYRKVTHTDAYLKPDSHHHPSQKNSLIKTLHHRAQCISDHEHLTSELKHVHQALKANGYSDYTIRKAITPTVRKEPSEDPIKTITLPYIAGVTKNISKIMNKHKIQVRFNTVHKIRDLIPSVKDKIPDMQYPGVYKLSCICGSSYIGETKRHVSDRVREHKADLKHGRTNTSAVADHYFNAAGSHEIDFSKTMVLCKPTGYQQRFVHEAIHIYRHNFNREDGYKLSNHWKDVINHFGS

SEQ ID NO: 3300 - protein, 1266 aa, synthetic construct
  source 1..1266: note = Description of Artificial Sequence: Synthetic polypeptide
MPAQDTTRRAVRATASSSTGHFPSFTRALSPSQASVVLGEQISFGTFDERCAAALAHCTLLDEVIATLPKLYQVALSPVLTDIHHDATKRVEIAAQLERLRQHKAAGTLPSPLKGLGSTPAIQFMKGFLESQKPDFPGKAPDIVKACAAKLLDGFIETKAAEHAWYESRLQAMEVTRRVLTAADTHWKDELEQRYQVLEGFVRPPVEGQVPATVPSAEELHPLKFVTDPVMVAQHENIRRSIPRLASTVIMLVVNRALTQQQRNKAKRDLKDQADVEMATDDTAVDSAVKRLEKQVEGLVSGMKALTNGKGKVSFSSSSRTHVEDAHPFVSGQSPSSRPFSLVDHRARHEAQGVQLGKRLRQRQDDGHQGPSRRLRCSSGEAGSPQEGQGEGTREGQEDPEEIVAYVRAAPWRYDAPHSYPDVILMLPAPRAIQLLLERVPLEVKRAARFRSRVFLGPHVTVPEHLQMHVSSSLRYLMYSVPSSNVVREAWEDFKDRFRWRVFFTEKLIDSPNDDDPDFDPDYVVPKARKRFDDGVRTTPAYIELGLRKGDKFVDDYISNVMPSVKATSRSLNLVWLDELKDYLSANKYIVSPSDKNLGVCILQADWATDQTRTLWNDPSNYRKLGSLLEADEIMEEKHERIFRAARLARRLGKRQLAEFLVSKIHGKDAKTAGYTLGQFYGVPKVHKRPVKMRPIVPCHSVSQAPSATYVSKMLKPLVSRQPHVIHGSKHLVRQLESLQLDKHRKAWIVSGDIVAFYPNIPLENCIRVVTQMWRNSPEAEKLSPEERQLFLMSFMTANKRLVIQFGDEYAEQIRGLAMGIACSPDLANLYGSHYENPILARPDMKSKFAFFGRYLDDVLGIVYASSAEEAMSYANEIRYDGVEIEWSVSEYHTPFLDLFLYLDPVEKRLHWKPYSKPLNHRERIPWASHHPKDVKKGTFIGEMSRLATLCSKLEHYRDAISDLSNLYLARGYPDDAVRSWVKAHFSQRWERRLGEPIVRDEVFVLKSHFNPAWSAFNVHGLSEVVVESWLSSLSKLDGANQSQDRTWHAAESTDGSELKIFRQTTLGQFQGEQSSLYPGESRPEGVAGRVGVANVAKPRVTYDPRDVMDVDELVALSEPSFSAHDLSVVWTDNALRVPKSLRIRYAMAELRLDADPQVNPALHVPLGVEDQVGDLGPASDAESVASGDDGTTNSKPYRICTAKKDSGIVQEDLDIRSVGFHDRAWLVSRKKIRNLGDIVNSWKKDIIQAALNSDSVPHMHVDEWQ

SEQ ID NO: 3301 - protein, 1096 aa, synthetic construct
  source 1..1096: note = Description of Artificial Sequence: Synthetic polypeptide
  VARIANT 278: note = Any amino acid
MWGGHRENLEGRALAELIDSYNLCTLNDGSPTMIPRPGARAQPVDITLCSPDLMSELSWEVIQEPLGSDHLGILVKSFNGRQATSGARIRHPKAGGWNLSKADWEKYRMVLDLKFSTSESTSCTYDYLTQEIRSAALGSIPRFPQWLYLNPNRAIKPWWDDDCNRVKQESIIAYESYKRAPTLENYVNLNRKLAISRRTYKEKKRIMWYEFCNSLDRQTPSNVIWKRIRSLKKGYSPQVEVTDDGHWVEEFHKSLTPDYASQFIDLSNIPIGDEDLNXPFQLWELKYALKKGGSTSPGQDGIHYQMLQNLPFPALLSLLRIMNEMWVGGAMIESWRTHLIFPLLKPGKDPNSYQSYRPIALSSCVCKTYERMIKHRLDWWVEEYNKLAPHQLGFRRHRGTLDCLAAFVNEVHLNRTENKPLLAAFVDIHKAYDNVNIAILKDKMLVMQVPGRVIVNIINMLQQRQLIIRRGVLVTGPRTTGIGLPQGAVLSPLLFNIYTSDLRDWLVPEIRIVQFADDFTVYTGGKSEENLVEIMGQALHDLNAWCNHLGFRISGNKSSVTMFSRKRQNILAGTIQLGPFKVSQSPIVKVLGLYVDHKLTWRPHIKRIIQSCEKALNVLRYVAHVTYGTDPKIALLLYRNLILSKIDYGCGIYGDACQTSLSGLDKVQYKAIRICLGAMRSTPTNVLLVEAKIMPLHIRRELLLGKFLSKRLIKFKEVSLMRVSELSEVVRSHRFWLKKKTPLMCEMFRVTEKLYSGLEVLHASPRRSLHYEVSCKESPYVHLDLYDKVKEEWGDLTYLAFIARMREIIINPYLLFTDGSKSEQGVGCAVLDPQTGSFRLYKLPNNASIFTAEIVAIWNAVILAEQIQSNDIIVILSDSKSALQKIKRPGDVFDPIIIEIISHLINAMGRLHLVWLKGHAGIVDNEKVDVLAKRAILLGEHTPVLNLADFEGALRKRCYDAWQKLYDLEKEIKGKYYADLQPRIPNKPWFVEVLEGERQFYTTIMRLRFNHNLTNPHLHKIKLLDSPKCDCDSGEDGDIDHLLFRCSRYNRNRDKFLKELATHVRFPCSAKSILAIMNPDALRIIYKFIRENKIKI

SEQ ID NO: 3302 - protein, 849 aa, synthetic construct
  source 1..849: note = Description of Artificial Sequence: Synthetic polypeptide
MVSSFRVDHQLYSDHMPIITTLLIHDKQQIYNDNTLPLLPKLNWSKQNLQKYQQSISFYLNHIVYKYDTLDAEVNYLNDIIRSSAIGNNNKKGPKVWKADWFDVECDRARRKSFKQLRLFRRTNEVEDKHLYLKYNFDFKRLCKNKKQKYYVDCARRLYNVKSSKEFWQQVRAFQKRKPWVLGNVSPEQLFEYFCSLHNSSVTARLVFDVSHRVDAFLDKPFSFDELELVLSKSKENKAPGTDRICYEFYKFAPIVFLNRLLLLFNKIFETSKIPASFKESIIFPLYKKGNKNSASSYRGISFINVICKLYSGLILHRLNNWLESNNILKESQAGFRSNYSTIDNLFNLTNIIKIKLSKKKQKVYAFFVDLSSAFDSIDRFSLIYKLHRTGLSTKIVTSIKNLLSGTTASVMCRNGLSPNFGTNIGVKQGCLLSPTLFSIFINDLEECLGGGVVISDNCKIKLLAYADDVVLLASNPISLQLMINEMESYCYRWKLKINLQKSKIMIFRNGGRPANNEVWYLGTQKVEVVNEFKYLGIILTPTLSYTKHFQNKLSKAKMSLNTIWHHFMDNTSIPFSTKIRIFNSVNRSMMCYGAQVWGWQRFVEVERLFYFFIKKLFKSPKTTPSAFIHTETGIDPIYLYTFEMHFKYLVRVLQLPDNRYPKILCHEIIKSKILWFLEIKNLITKFNLPNDLNWQNIGNFTLWEANFNILIKSLQADMNNTFQLKLFNSGSHPLYKNLQYNLGDNPYLSDSHPFHLIRMIFKVRGDLLPLNYKFYKNRDLDCLMCASGEVEDLFHFLAVCPALSNMREQWFGSRTLPAQHVAAYLNGKDWEALAKYCLAALSRRALLT

SEQ ID NO: 3303 - protein, 735 aa, synthetic construct
  source 1..735: note = Description of Artificial Sequence: Synthetic polypeptide
LNNKVNVEDKSFSQTIVNDISSMESLDDYKHIINQDFTNKEVLQHIKLLKSGKASGTDMISNEMLKHGAPFIINSLTKMFTQVLNSGIMPLHWNSSLIIPIFKSGNPKDANNYRGIAISSCVSKLYTMMLNTRLTKYLQETNQIVDNQFGFKKNHRTTDNIYILKSLINKYVNCKLKKSGNYLFSCFIDFSKAFDSVWREGLLYKLLRLGVGGNFYKAIKAIYKNTKYSIKLSAGITPYFNSCRGVKQGCNLSPQLFNIFVNGICDDVKNFDPVDLNGLKLNCLLYADDLLLFSTTQEGLQKCIDAVQNYCDNWHLKVNINKSKIIIFNRLGKNLENKFQFYLDATKLQCVNYYNYLGIVFQTNGKFHNAMSRLQDKAQKALFKMYKMLWISEECYSVSLAKKLFNSIIKPTALYGADVWGGVMLNIYKGSGKNKCTVDNCNFETKLFSDKLIPEKLHIKFCKRVLGVHRKASNDPCRGELGQYPLILDICVSVMKYYQRLVCKKKTILSLMQPMKNPKLLCMTHGLTLYKNYKKNNSIIDAAYEESKTLVHDPWLNFIQKLLVITDLTNSDPHQNNFCDIFKEKLKCLYRMKWKNNLLNNCKLDFYRCAKENFEFEHYLEKIKNKNHRIAYTKFRTSAHFLPIESGRHKGILKENRLCNLHECNEVGDEKHYILYCNNCQIKEQRSRFLAALYIYAPKLEDFSMDELFPIIVSSNDFFILSIFAKFIFYILDMF

SEQ ID NO: 3304 - protein, 1147 aa, synthetic construct
  source 1..1147: note = Description of Artificial Sequence: Synthetic polypeptide
CINDSLLETFVSKHDIVCLLETWLDYTDSVSVPNGYLYFRVDRKKHKNARKASGGMIIFYKSKFRKGINKFISKYKESLWLKLDKHFFGLENDLYINSTYIPPIGSSYYNSSDLTGEDIFNIIAEESLHYSNHGNVCILGDLNSRTVNLNDTLDDINISDIDIPYTELMDNNRQSMDTMNNKYGQYLCDLCLTTDMIIANGRIVGDLMGKITCFQYNGVSQVDYCVVQKSFLPKINYLKINELSHISDHCSLSLAINTNYVNEHSIDISLTPYKKYNWNNSSKENFVTQLNSKDSVDKMNTFLDNHFNLEESDKAISDFNDIMHFTADKALKFTAIKSRKFSRKNKRKNKQKWFDNDLAHVRKCLKDISRLVDKFPFDQNLRMQRMSINKRYKKLVKLKKNKFKEKLLHDLMNLETKNPSEFWDIIKQIKEYNDLDTSKHPPSIASTEWTNYFSKLYNISTTDSNSVLDSEVTNFVDNMDHNATSNPDLDKEISIAEIIKAIKKTKVNKSSGPDSILNEMFKCYSPLLLACISKLFNHILSSGCFPVHWSTSYLVPIHKSGHIWDVNNYRGIALSSATSKIFNTIIHIRIQHFLDKNNFFQDTQFGFRKNHRTTDNVYILKSLINKYTNKVGKHYLYACFVDLRKAFDSVWREGLLFKLANAGVTGKIIHLIKSMYSNTKYAIKTNQGYCKPFMSSSGVKQGCNLSPLLFNIYINDLSESLVQTEPVRLHDMSFNCLLFADDIVILSNSGSGLQDSLNLFNDYCKKWKLTVNIKKTKVIIFNKRGRKINDIFFLGDEQIEVVSSYTYLGITFQNSGNFTVAVNNLVKKAQRALGVLKQTLLLNNIIASPINAIKLFRSSVMPILLYGSEIWAAFNFKPNITPELFIQKLFSDSSKIESIHIKFCKQLLGVHKRASNIAVRAELGSYPLITEICTQMYKFWLRVKNKECSNIVHCAYQSECTINSNSWANFVSKLLEITRLNETDHNANIFRNNLKRIYYEKIWLPTLSKKEHNKLRIYNKYKSDYEFEPYLNKINNLNHRVSVTKFRISAHKLPIEKLRYQKIPSEQRFCTLCSDQSVGDEMHALFDCKLDEIVKARSYFWNTLSLYNDNILKLPKEDMFVHIMGIKDSFIANSLGKFINTILQCNT

SEQ ID NO: 3305 - protein, 676 aa, synthetic construct
  source 1..676: note = Description of Artificial Sequence: Synthetic polypeptide
RGEGSNSKKERCIQENAKSGTEENKVRYKRLKKQAKKVVAKAMREENEKVLSELKENPNKVYKIVKAMKGDGRDVTGGRCMRGSDGKLNFSERDRSKVWKEHMEKIMNEENEWDQDVEADLVEGPVERVSREEVVKAIRDMKTGKAAGPSEVSAEMIFASGDIGIGVIMELCQRVLDGRGMPEEWEVSVVVPIFKGKGDAKSCGAYRGVKLLEHAMKIVERVIVNRIRKLVEVDEMQFGFMPGKGTIDAVFILRRMQEEYRAKGKKLYMCFVDLEKAFDRVPRKVMEWAMRKRGIPEAMVRAVMSLYEGAKTRVRVGSELSEEFEVKVGVHQGSVLSPLIFAVVIDVVTESAREGLMREMLYADDLVLMDDTMEGLREKFVKWKKAFESKGLKVNLGKTKVMVSGTEEKALVSKVDPCGMCGKRVKVNSVRCVKCGKWIHGRCAKIKRVTQRLARDFACGRCKNGVGRVVEQEEKLCDEVESVKEFTYLGDKVSVGGGCEAAVTARARFAWVKFRECGELLYGKRFPLEMKGIVYKSCVRSALLYGSETWCLSENELGILRRTERAMVRVMCGVKLMDRKITEDLMQMLGLKEAVDRLAKANGVRWYGHVLRREDGHVLRRALDLEVSGPRKRGRPKKTWKMQVEEESGKVGMRMRDALNRAKWREGVRAIATSLR

SEQ ID NO: 3306 - protein, 742 aa, synthetic construct
  source 1..742: note = Description of Artificial Sequence: Synthetic polypeptide
INKNKKNFFKNEMINKLETCDKTDQNEYWSLLKQLRCQQNSLNPDSTINSDEWLDHFSKLYNNNNNNADFKQSLKLLEDTKLSNHELNNVISYNEIKKAIKNLKNKKSTAEDSISNEMLKTKNSLLIPCIQKLFNFILESGTYPTSWKSTILVPIHKSGDRSNPSNYRAIAISSCLSKLFTGIMNCRLTNHLEKNKLMNEVQFGFRKNRRTSDAIFLLKTAVEKTLYGKKETGAKCKRLYSCFVDLKKAFDSVSRDALFLKLQKTGINGNFYNIIKSMYTDQEYKVKLNSGITKGFHPTSGVKQGCNISPTLFNIFMNDLPGIFGENVDKPIMIDTFPLNCIQYADDLAIISESVDGLQNCLNKLNDYCTKWYLNVNVRKTKVMIFNNSNRLIKNMNFKINNEEITSVKEFCYLGTIFTPNGKFKINQSNLKNKAMKALFSIRHTILNHKMISTKLSLKLFDQLISPILLYGSEIWANEITNENNYLEQACNHFYRFILGVSKVTPLIGIRGEIGRIPIRIKATLSLIKYWHRLSLLPENHILKSALKETVSSNSSWIKHVKTILGHTDLSEVNKIYKVGNIAELTKLLEEKLKNKYIQTWYQQLSHVPKNGKSGNKLRTYNLFKMEYEFEGYLTEIQDFNLRRMVTKFRLSDHNLEIELGRRKFPRMEANYRLCKKCNTGTVEDEKHFILDCCFFTQERNTLLEDCKLEMCSTTNRNLIFTCIINSSTALAKYLKNTIYKT

SEQ ID NO: 3307 - protein, 1047 aa, synthetic construct
  source 1..1047: note = Description of Artificial Sequence: Synthetic polypeptide
  VARIANT 219: note = Any amino acid
  VARIANT 939: note = Any amino acid
IFIYVCLYPPENSVIHNRQDIDIFEKLSQDVIKYSNIGEVLLMGDFNARTGTLADHIINDNSTYMPIPDNYVDDEYNNRNNKDQKVNSFGKKLLELNKNNNLLILNGRTPGDLLGKFTCYNFAGGASTVDYALVSKSFLSNIQYFRVNEINNLSDHCAISLAITTRDLLSSDNNEIKCTPLPDRYLWDTKSIKRYQDALHSTEIINKLVSFNYENNNIXNSVTELTNIICNAADNSLKKIKHKISSSNKMKNTKRQKWFDDDCWNLRKKFREAAKLVEKYPKDCHIRGQFMVLRKKYNKILKIKRKQYKQNLWDSVTSQESNPKQYWKNFKIFSKNDTSISANNDIIQADEWYNHFKNLNNLKNSKTCKYDSDFQNKIINETREMETNKEINKELNEPITIGEVKAAVKKLKLNKSSGEDKIINELIKYGQNYLMEPITAVFNNVLKSGTFPKGWKGSIIVPIHKKGSRSDPDNFRGVALSSCLGKLFTATLNNRLIKYLEKNNLYSPYQFGFRRNRRTTDCLFILKSIVDKYIHSEYSKNSKSKKLYACFVDYKKAFDSMWRDGLYWKLQKYGITGNIYNLIKNMYSGVSYKVKTSKGLTNEFDSFMGVKQGCNISPTLFSLFINDLPEKIKSANGTPPELNSQKLNCILFADDVLILSQTQEGMQCSIDALAKYSNSWKLSVSLNKTKLMVFNKRNHTLNKKSVFYEGNEIATVDSFNYLGIVFTPNGKFKTASNTLKEKAMKAMFPLKQSLLTLSHYKISTALNLFDKLIVPIINYGCEVWGEESAKHSNIIESVQFAFCRFLLGVSKNSTKNAILGELGRYPLNVKIETQMLKYWLRLKSPVIPNIVATAFMEINTWKTGWVERIEEITKNNNLSELSKQHEKKIGEVLRENYVKTWRRELFNDSRMNGATNKLTSYRKFKTTFNMENYLNDIKXLKLRRLFCKFRISDHKLLIETGRQKKIPRNERICKLCTDDKIEDEYHFLIGCSKYDIPRNKLFKYIQGKKSDFLKMNEDEKFRLIMTSFAGIETAQFIHTSMNLRDET

SEQ ID NO: 3308 - protein, 702 aa, synthetic construct
  source 1..702: note = Description of Artificial Sequence: Synthetic polypeptide
  VARIANT 10: note = Any amino acid
TDSQDINTNXKHESNILNKLSTDSKELNEPISQLEIQKAINNLKNGKSPGKDNISNEMIKAGRHTLIIPVQKLFNMILTSGFFPTNWNTGIITPVFKKGDKSDPSNYRGITLLNTLSKLFTAVLKQRLIKYIDVNNLIVKEQIGFIPKFRTSDHIFVLKQILAKYLEKGKKVFACFIDFKKAFDSVWHQGLFHKLAQNGITGKFYTIIRSMYSESLSCVKTKNGLTSEFPVKRGIRQGDGLSPLLFNIYVNDIKNEIEQSNNDPPPPSLTVSQLSCMLYADDLLLLSVSESGLQNALNSLGTYCKKWKLEINTTKSKIMIFNKMGKHIKKHKFCIDKQELENVPTYSYLGIKLSASGKFYKAQEDLANRAMKACFKLKQQLFSETNIPIKIYLKMFDSVIKPVLLYCCEIWSNENINIKNLSNFNLPMEKLHSKFCKFLLKVNCKASNIACLLELGRYPLAFSSIVQTIKYWLRISDKPCNTLIYEAFRLGKDMDSKGIKNWVSHAKNIFNITNMDHMLDTVTADKKQTIITSLESNLKSMFKNHFKETLYNDNKGKNRKNKLRTYRMIKHNFDFEKYLEDVKNPSHRSALTKLRISAHTLQIEAGRYINQTVEERKCHYCQEKQIEDESHFLLKCSLYADLRNKFLHTTKVITTIDKSDIENTVDILKTKDKQSLIHLAKYIFECFNLRNDTHKQKIPAAL

SEQ ID NO: 3309 - protein, 1091 aa, synthetic construct
  source 1..1091: note = Description of Artificial Sequence: Synthetic polypeptide
  VARIANT 4: note = Any amino acid
LYNXYLISIIDKGHRDILGVRFENKLTGFTFLVFSCYLPPENSPWGRDANAFFSHLLSQLYMTDDVDTIIICGDLNARLGNLNDNIDVVDNIRNRHVIDTKINQHGHSFCEFLQESKLCILNGRFDRHQNDFTFISSRGRSVVDYVCVPQDHLSYCNNFNVITMSSLVEKYNLYDALTDRSKLPDHSLLIFDFLDRPLGSIVEQSLPNDINIGNNRHSATVRKYCLNQTPINFLESEVAREALLHIISKIEICRETQQEIDEIYDDLCKCILNEMNSTIPNYNCSSGARKRFRHHKPYWNDELYSMWRVMRERERSYTRFGGSKNIRTILRNDFKAARRAFDKKLRCCERNYRNDLVSSIEKVCTENPHQFWEHINKLGPVKRKDIPMEVYDDGGHITSNHNIVLNKWKHDFSSLYNQSDLDGFDANFYEHILHHKLVLENDLDDPLYDSNSELNKNFSTVEIKTVVAKAKSGKAVGVDKIPYEVLKNDSSVAILTHLFQLCFDSAKVPCIWKKALICPILKVRSSDPRVPMNYRGISIQSTLSKLYSALLNNRITRFLENNNILVDEQNGFRKDRNCEDHIYILTSIIRNRISHDLSTFAAFIDLRKAFDSVDRDALLYKLLINGINGKMYKSIRAMYSDTNSSVKLNDFKTDWFNTEQGVRQGDNLSPTLFSIFINDLAVEINLKQKGITLDNNVNVSILLYADDIVLLADNEIDMQMMLSHLNSWCEKWKIRVNNVKSKMLHFRKASEARSAFQFCIGDDVLDYTDKYRYLGIVLDEFVDYSVTAGIAADSASRALGALFVKFKTLKNLGFSTFTKLYDASVAPILDYCSGVWGFSKFEKCEMIQNRALRFFLGTHRFSPLPAVKGDTGWVSCRDRRWAHMVRLWKRLTELDDNRLVKRVFLWDHSLNYNNWSSEIYQIMELVDLNYEHLIDVNIHALRENIARRSESSWSEDVSHKPKLRVYATFKFEYKPEKYVLINLSRGQRSLLAQLRMGILPLRIETGRFRHEPVSERICKFCDANVVEDEMHFLFDCQQYNELRHEYLDSILNEITGISREQILVRLFSGPIRKLALFIEKAFYKRRNLLYV

SEQ ID NO: 3310 - protein, 1083 aa, synthetic construct
  source 1..1083: note = Description of Artificial Sequence: Synthetic polypeptide
MTPACFVDYKLSLPNRGTDYVCSHTRDSDSLLVTQTFGLPSYSNHLSPALYSCYLMKLLYNMILLPSDAHSDVINQHCRALPVLCRALIVLLLMISGNVHVHPGPSTVASPNSDLCSDICFTDFCSRKSLGFLHVNTRSLLPKMDQLKVWVHSSNPDVLVITETWLRKSVLNTDVNLSGYNLFRQDRSSKGGGVAIFTKDHLQCSVVSTKSVPKQFDLLVLSIKLSNSSLLTVAGCYRPPSAPACTLPALSSLLAPYTKSEFVLLGDLNWDMLKPPDQVLKQWDSLNLSQIITNPTRYDSKHPEKATLLDVILTNNPDRYQSGVFCNDLSDHCFTACVRNGCSVKRPVLICHRRLLKNFNEQAFLHELASVKWYRISLIPSVEDAWTFFFDIFSGIVNKHAPIKKMRIKNRFSPWFDRDLAELLHLKNCIWRKARHTHTQADWLSFRQMRNKCTQAIRKAKVSYFKEQFSLCGSNPKKFWKTVKDLENKPSSSQLPMSLNVDDVVVTDKKHMAELFNHHFIKSGFLFDSAMPPCPSNISSSPTPSNATIPDASPSFSPAPLQSFSLQAVTESEVLKELLKLDPKKTSGSDGLDPFFFKVAAPIIAKPISNLFNLSLLSGEVPIAWKAATVRPLFKGGDQADPNCYRPISILPCLSKVLEKLVNNQLTGFLDVYSILSGMQSGFRSGYGCVTATLKVLNDVTIALDSKQCCAAIFIDLAKAFDTVDHSILVGRLRSIGVSEGSLAWFANYLSQRVQCIKSENLLSQPLPVTKGVPQGSILGPTLFSIYINNIAQAVGSSLIHLYADDTVLYSAGPSLDFVLNALQQSFLSVQQAFSTLNLVLNTSKTKVMWFGKKNAPLPTGVITTSEGLELEVVTSYKYLGVWLDGALSFSQHISKLQAKVKSRLGFLYRNRSSFTPAAKLTLIQMTILPMLDYGDIIYRSAGKGALERLDVLYHSAIRFATNAPYRTHHCTLYSSVNWSSLYTRRKTHWLMLIYKTLLGLTPPYLRYLLQPSSSTYNTRSASHILLKVPKAHTSLGRSSFQFAAASDWNELQQTLKLDSFISISSFKDSIMDTLTDSCGCFV

SEQ ID NO: 3311 - protein, 1208 aa, synthetic construct
  source 1..1208: note = Description of Artificial Sequence: Synthetic polypeptide
  VARIANT 349: note = Any amino acid
QRNSKGVMVLINSNFDPNVQIVQTDHQGRWIILNMLLDNKQIWLINLYGPNNDDPSFFENIYKNLSTLQATLDSIIMVGDFNTVLNTSMDRKGNHTTNYHPQALKEIMNVMDILELVDIWRLKYPDLVRYTWRRLNQASRLDYFLMPFSLAPKVKVLIGDRMRSDHHIIGIYITLTEFPRGRGYWKFNQSLLDDKLFRTRTEEFITDFFRHNIGTADPLIVWDTFKCAFRGHAIQYSSIKQKQFRSKESILTKEIEGLTVQLDSNKNGTIEAQNKLEEKQKEMEELIQERSSVIYYKNKANWMEYGEKCTKFFFNLQYRNATKKMYKCYQKNVLKLVTNDGVTHDSPNXILKEEVKYFKNMFSFQAPPSPLTETNCMDFFPNNNVKLTSVQKDSCEGQITEEELLDAIGAFKDGKTPGLDGIPVEVYKTFFDILKGPLLACFNHSYINGRLSDTQQEGLISLLLKQDPSGIYKDPVHLKNWRPLTLQCCDAKILAKCLAHRIKKVLSDIIHPNQTGFLHGRYIGDNIRQVLETIEYYEISGTPGLVFIADFEKAFDKVRLEFIYKCLEYFNFGESLIKWVKVMYSNPRCKIVNNGYISESFKLSRGVKQGCPLSAYLFIIAIEMLAVKIRSNNNIKGLEIRGLKTKVSLYADDSCFLLKPQLESLHGLIEDLDTFAILSGLKPNYDKCTILRIGSQKNANFTLPCSLPIKWSDGDVDILGIQIPKERNDLTPIHFYRKLAKIDKILLPWKGKYLSICGKITLINSLVISQFTYLLMVLPTPSDLLFKLYEQKIFNFIWNGKPDKIKRAYLYNEYEFGGQKLNIKALDLSLKASVIPKLYLNPNWFSSKLVRMSHPMFKKGLFPFIQITPAHFRLFEKEIISKISLFFKQALESWLQFQFNPPEKTEQIIQQILWLNSNIVIDKKKIFEEMFKKGIILVNDIINRTGGVMSHMQLTQTYGNVCSTQNYNQLIAALPQKWKRQVEGEKSKELVCRPCIKEHKWLKKSVINKNIYQFHLRTKKLTAVPYKLQNSWEEIFDVPIPWHMVYELIRKTTPDSKLQIFQFKLLYKILATNRMLYIWGIQSSQLCRFCCEEAESLDHLFWYCPYVARFWSQVQEWLKNCNICLELTLQIAILGDLKSHSQSINNIIIILAKMFIFNLQSVEAMRIERFNCFVKHHSTVEKYMANRNPKWMMLRDRWEGLNGAEGWD

SEQ ID NO: 3312 - protein, 1279 aa, synthetic construct
  source 1..1279: note = Description of Artificial Sequence: Synthetic polypeptide
  VARIANT 407: note = Any amino acid
MVRGEISIASYNCNGLADYKKRRSVFTWLKEKEYNIYCLQETHSTSLDEVAWKKEWGGEIIFCHGQRNSKGVMILINKNFDLNVQIIRNDSQGRWILLNMKVDEKEIWLINLYGPNQDDPHFFENIYTNLLNLQATNDLIIMVGDYNTVLSTSMDRKGNHSTNYHHRALKEITNIMDTLEIVDIWRLKNPDLVRYTWRRLNQASRLDYFLVSFSLASKVKKVLIGDRMRSDHHLIGIHITLIDFPRGRGYWKFNQSLLEDNLFLTKTKFITEFFQYNIGSANPLIVWDTFKCTFRGHSIQYSSIIKKQFLAKETRLTREIHELIVQVDSNKNDTTEIQNKLEEKQKELEELIQERSNVIYYKNKANWMEYGEKCTKFFLNLQYRNANKKNLQKLVTEDGVIYDSPNXILKEEANYFRQMFSFPSHPLPLNEDYGKEFFPNNIKNGKLTNVQKDQCEGQITEEELFEAIKSFQSGKTPGLDGIPVEVYQVFFDILKAPLLDCFNYSYRNGSLSGTQQEGLISLLLKQDPDGKYKDPVYLKNWRPLTLQCCDAKILAKCIALRIKRVLPGIVHPDQTGFLHGRYIGDNIRQLLEIIEHHETYKKPGMVFIADFEKAFDKVRLDFIYKCLDFFNFGNSLIKWVKIMYSNPRCKIVNNGYFSESFELSRGVKQGCPLSPYLFVMAIEMLAIKIRSNNNIRGLEIQGLKTKVSMYADDSSFMLSPQARSLQCLIKDLDNFSVLSGLKPNYDKCTILRIGSLKNTTFTLPCSLPIKWADGEVDILGIHITKDINKLSTMNFNRKLVKIDKILQPWRGKYLSIYGKIALINSLVISQFTHLLMALPTPDDSFFKSYEQKIFRFIWDAKPDKIKHAYLYNEYELGGLRLLNIKALNLSLKASLIQKFYLNPKWFSSRLIRKAHPLFKNGLFAFVQIAMSHFRLIENYTFFKVSVFFKQALQSWLQFQFHPPEKIEQILWLNSNVLVDKIPVFMGKMFEKGILFLNDIVNWNGRVMSFMELSELYGKVCSIQEYNQLITALPQKWRRRVAAGGGRELVCLPNIKDQNWRRNKNSINRKVYQFHLRTRMLTTVPYRLQNSWEEIFDVPIPWYRVYELIYKTTQDSRLRAFQLKLLYRILATNKMLNIWGIKSSKLCRFCCEDTESIDHLFWYCPQVACFWSQVQEWLKMHSIDLKLTLEIVLLGDLERPGQSITNILILLVKVFIFNSQSVDSIRLDRLKLYVKHHSIVERYVLRRNPKWVASRDRWDGLREAEGWYVELETSGSGVAV

SEQ ID NO: 3313 - protein, 1281 aa, synthetic construct
  source 1..1281: note = Description of Artificial Sequence: Synthetic polypeptide
  VARIANT 743: note = Any amino acid
WFGALSYLFSDLHAMQATIGTTNERRAGLTFTSWNVKGLNEPIKRGKVLAHLKALSSDIIFLQETHLKNNSHNRLKCKWVGQVYHSNFSAKTRGTAILVRKGIPFLHKTTIVDKEGRYVIVIGEIHSTSVTLLNIYGPNIDNPSFFKRVLALIPDISHTNLVIGGDLNCVLDQYLDRSSTRRTPTSYSSEFLNTYIKNSNLFDIWRISNPTGREYSFYSHVHNVYTRIDYFLVDAKLLPYTCNVRYHDIIISDHSPLTFSLRLGDIVPNERVWRLNPQLLTEPTFCEHLKDQITFFFDTNDNTETSPALLWETLKAYLRGCIISFQTARSRQNRGELVELEGQIHLLDRENASHPSMEKHKKITSLKFEYNQILSAKIAKSFLYAKQKYFEFGDKPHKLLARQLRKNVSDRMIHKVKSASGELLSSPKDINDRFRQFYETLYTSKADPNPLIMQNFLEDCNLPALNQEDSNFLNKEISLEEIRETIKSLKSGKTPGPDGYPGEFYKTFSNMLSPYLHKMLVQANEDGALPSTLDEAFITVIHKKGKDPEEVGSYRPISLLNTDQKILAKTLANRLSTLIGKLVHSDQTGFIPNRNSFFNLRRLFNIMYSQRLPNVDLAVISLDAEKAFDQVEWPYLFKVLQKCNIGDGFIKWIQLLYRNPCARILTNQSLSPRFNLYRGTRQGCALSPMLFALIIEPLAQAIRSHAAIHGYNTKDTLNKISLYADDILLYVTEPQDSIPAILXVINLFGTFSGYRINWNKSELMPIRLQNTSWLEHLPVKLSSEKFTYLGIVVTKQYSLLFKENFPSLMQKLKANIQFWRTLPISLLGRINAIKMVFLPQLLYLYQNIPVFIPKSFHKQLDSIINPFIWDYKTHRIGKKHLCKSKMEGGLSLPNFIFYYWAANLRAVTFLLDDAPPPSSWLSMEREECHPFSIGAVILSPVNLEMSLYRNNPIIHSTVRIWKQIKVHFELRPISFMLPVARNPSFAPSNLDNTFERWGELGISTIGDLYIGGTFASFESLRETYNLPRSNFFRYLQIRDYVRKHLPTFGNAKPSMFDGCIKICPTSDKLISRIYDAFQSVSAPSTDAIKAKWEEELGTDISVADWEDSLEYIHTCSINSRHRLIQFKVLHRLHYSKTKLHRIFPGTSPMCDKCQAEQGTLLHCFALCSNLYGYWCGIFGVLSEVLETSIDPDPLLIILGVSDSLNGLTNPQKQLISYSLISAKKLILLFWKKREAPSTKLWLSELANTVHLERIRYILNNKLSTFDQIWQPFLSYLDQAAL

SEQ ID NO: 3314 - protein, 1185 aa, synthetic construct
  source 1..1185: note = Description of Artificial Sequence: Synthetic polypeptide
  VARIANT 5: note = Any amino acid
  VARIANT 6: note = Any amino acid
  VARIANT 7: note = Any amino acid
  VARIANT 141: note = Any amino acid
MSLRXXXYFAMIVSYVAALLIISVRPCWDDTINLLPENIYTKHIGSPIHRSGLYTAYHNVLNNGQVYLAPYSTEPLRRDKHKSNIYRKLLNYLFTTLLLSGDVQLNPGPNITEPAILTGVESRGWPRPLIVAAVEVGECYXPMVSLDSPGSRIDFDSSNIPKPLYAIPDFASGTQAVLISSPHPVQAGGIVNSATELPLIKTKQNGLNPAVRKHRKCNFFQCVNHSRVIWDPRAKPKGLLGGHLNIRSVIPKSDQIQHLLTDSNLDFLCLSETWLHKNSPCAALIVPGYNVFRRDRIEGRGGGLMIYIKEHIRCKQIEWSCDNELECIGLNVTLSPQMSFTLIGMYRPPSTKSVFFDQFNNMLRECDFGKEVILMGDFNINYEDKSCRKTLKRITNTFDLTQLVKGPTRVTCCSKTQIDLVFSNKPERVTKSFNMVTGLSDHNLTLIARKLSKSRFKLSTVRKPDQLRIPKSELNYFENAINGINWNDLLSYTDVEADSEVFLSTIQATINGFLKKIKSKPGQKSTLPWLNGEIWKLMKERDYALKTALKSKLEHDRRRFTMLRNKVMKEIRQAKANFFINIIGEAKGNSKLIWENLKKLTGKDHSNTAKRLEIMVNNNLTQDAVEIAIAFNSYFIDSVRVLTQNPSTGLLGSVLVNDAQPVFIIREVSESKVNKVISSLKNSKSKDVFGLDSTFLKNYKESLIGPITKVTNTSIGLGVFPRVWKSAIITAIFKSGDPADVSNYRPISILPVVSKVVEKCVAEQLISHLNNSPFTLHSMQFGFRAKHSTETANCFLLENVKSKMDKGGVVGAVFLDLRKAFDTVNHEILITKLSKFNFSPDALRWMKSYLEGRTQCVRVSNELSPTLSYDVGVPQGSILGPLLFSLYINDLPSVCTGSEVQMYADDTVIYVHAKSKQQAAQELTTVMVQVTKWLSDSCLHLNVKKTVCMFFTKRATDATEPDVYVSGEKLQVVSDFKYLGIILDSNLSFKKHVKKVIQITKFNLANFRFIRNCLTTEVAKLYFKSMILPHLTYCLTSWAQACYTTLKPIQSVYKQALKVLDRKPNSHHHCYILRKHELLSWENLVQYTDACLVFKILNGLAPPPLSIFVKQKTQTYGSRSTRSAMRGDCIVPLRKSTFSKSAFSVRASHVWNTLPSDTHNCTTYHTFTKCMKTWLKVNQTCEHNP

SEQ ID NO: 3315 - protein, 998 aa, synthetic construct
  source 1..998: note = Description of Artificial Sequence: Synthetic polypeptide
LLDIRAAVTHQHYDQEYDFPELDPLFVPPRAIELIPEAAPRRRRRRRGIRSGLLVRLRRRAHHPPLPSILLANVQSLDNKVDELRARISFQRDIRDCNILCFTESWLSPDILSPSIQPAGFSVHRADRNKELSGKKKGGGVCFMINYSWCDCDNVQKLKSFCSPDLEYLTIKCRPYYLPREFSSVIVTAVYIPPQADTTTALKELHWTLCKLETTYPEAAFIVAGDFNKANLRKTLPKFYQHIDCSTRAAKTLDHCYSPFRDAYKALPRPPFGKSDHDSILLLPSYRQKLKQEVPVLRSIQRWSDQSESMLQDCFDHADWDMFRVASENNIDVYTDTVTEFIRKCIGDVVPTVTIKTYPNQKPWIDGSIRAKLKARTTAFNHGKVTGNMVEYKQCSYSLRKAIKQAKRQYRDKVESQFNGSDTRRMWQGLQTITDYKGKTSHVADTDVLLPDKLNTFFARFEDNTVPPTRPAPKDCGLSFSVADVSKTFKRVNPRKAAGPDGIPSRVLRACADQLAGVFTDIFNLSLSQSAVPTCFKMSTIVPVPKKAKVTELNDYRPVALTSVIMKCFERLVKDHITSTLPDTLDPLQFAYRPNRSTDDAIAIALHTALSHLDKRNTYVRMLFIDYSSAFNTIVPSKLIIKLGALGLNPALCNWVLDFLTGRPQVVKVGNNTSTSLILNTGAPQGCVLSPLLYSLFTHDCVATHASNSIIKFADDTTVVGLITNNDETAYREEVRALAEWCQENNLSLQRQQNEGADRGLQETAEGARPYPHRRDRSGEGGKLQVPRRTHHGPWRSGARKITSPSNVNKTKELIVDFRKQQREHAPIHIDGTAVEKVESFKFLGVHITDDLKWSTHTDSVVKKAQQRLFNLRRLKKFGLAPKTLTNFYRCTIESILSGCITAWYGNCTARNRRALQRVVRSAQRITGGTLPALQDTYSTRCHRKAKKIIKDINHPSHGLFTPLSSRRRGQYRCIKAGTERLKNSFYLKAIRLLNSHH

SEQ ID NO: 3316 - protein, 1043 aa, synthetic construct
  source 1..1043: note = Description of Artificial Sequence: Synthetic polypeptide
  VARIANT 45: note = Any amino acid
  VARIANT 327: note = Any amino acid
CFCHRILRQKRASGYQDSDHSPRIRQRFFLQQQQAGLTGYSPNTXQGRHPRYSQEEATRRGRRAGCLVRTRRRRVGKLPLPSVLLANVQSLDNKLDEVRSRISYQRDIKNCNILCFTESWLNDDMDIQLAGYTLHRQDRTAHSGKTRGGGLCIFVNNSWCTKSKEVSRFCSPEVEYIVINCRPHYLPREFSAILFVAVYLPPQTDAGTKTALSQLYKDISKQENAHPEAALLVAGDFNAGKLKSVLPNFYQHVKCATRGKKILDHLYSTHRDAYKALPRPPFGKSDHNSILLIPAYKQKLKQEAPVTRSIRKWSDEADAKLQDCFAXTDWNMFRDSSDGIEEYTTSVTGFINKCIEDVVPTVTVRTYPNQKPWITGNIRTELKGRAAAFKERDSNPEAYKKSRYALRRTIKQAKRQYRAKIESYYTGSDARRMWQGLQTITDYKGKHSRELPSDTSLPDELNHFYARFEASNTEACMRAPAVPDDCVITLSVADVSKTFKQVNIHKAAGPDGLPGRVLRACADQLAGVFTDIFNMSLTESVIPTCFKQTTIVPVPKNTKATCLNDYRPVALTSVAMKCFERLVMAHINTIIPETLDPLQFAYRPNRSTDDAISIALHTALSHLDKRNTYVRMLFIDYSSAFNTIVPSKLITKLRTLGLNTSLCNWILDFLTGRPQVVRVGSNTSATLILNTGAPQGCVLSPLLYSLFTHDCMARHDSNTIIKFADDTTVVGLITDNDETAYREEVRDLAVWCQDNNLSLNVTKTKEMIVDYRKRRAEHAPILIDGAVVEQVESFKFLGVHITNKLSWSKHTKTVVKRARQSLFPLRRLKRFGMGPEILKRFYSCTIESILTGCITAWYGNCSASDRKALQRVVRTAQYITGAKLPAIQDLYTRRCQRKALKIVKDPSHPSHRLFSLLPHGKRYRSAKSRTKRLLNSFYPQAIRLLNRDQKAPQQLLPPSHKTPEQVIKWLPGLFALCAPPPSSTLCLSYMHSHFNYTFMYILPQLARPTSAPAHWLTGLSALCPTTRQPLFLRCCYSLFIIYA

SEQ ID NO: 3317 - protein, 1015 aa, synthetic construct
  source 1..1015: note = Description of Artificial Sequence: Synthetic polypeptide
  VARIANT 388: note = Any amino acid
  VARIANT 425: note = Any amino acid
MFFSLALFALFHIMSISGKLPRKGLKIAHINICSLRNKVHEINNLLTSDNIHILAISETHLDNSFDDTSVAIQGYNIYRRDRNAYGGGVAVYIQSHIPVMLREDLMSSVIEVLWLQVHLAHLKPFLLGCCYRPPSANSQYLNNMCEMLDSVCDVNREVYFLGDLNIDWFSSSCPLKRKLLTVTSACNLVQVINQPTRVFTNTTGTRSSTCIDHIFTNAVELCSKAVSVPIGCSDHNIVAISRKAKVPTAGPKIVYKRSYKRFCCDSYVDDVKNICWSDVINEEHPDAALDEFMKLLLPIIDKHAPVKKLTVRTVKAPWIDEELKNCMVERDGAKGVANKSGCTSDWLTYCKLRNYVTKLNKKKKKLYYEAKINDIKNDGKKTLEYFKXNYGQKDKFNSIFHRIRWLIHHKTIRMMEKKLWSTLNXIMGRKTNSTPSFIESDGLFITKPFDVANYFNDYFIGKVGKLRQEMPTTNSEQLYSCIKKQIMKEKQCKFEFCKVSVGEVEKLLLSINNDKPPGIDNLDGKLLRMVADSIATPICHIFNLSLEESLCPQAWREAKVIPLPKSGKAAFTGSNSRPISLLPALSKLLEKIVFDQIQCYFSVNKLTTDFQHAYREGHSTCTALTQMTDDWLKEIDNKKIVGAVLLDFSAAFDIIDHNLLLKKRMCYGFSTSAISWIQSYLSNRTQRVFFNGSFSNVKHVKCGVPQGSSLGPLLFSIFTNDLPLALNKACVSMYADDSTIYASATTANEVTETLNKELQSVLEWVASNKLVLNISKTKSIVFGTNHSLSSRPQLNLVMNGVAVEQVEETKLLGVTLDCKLSWSKHIDSMVVKMGRGLAVIKRCSAFLTPHSKKQVLQALVLSNLDYCPVVWSSAARKDLVKLQLAQNRAARFALNCNQRADINTMHASLSWLRVEERLTASLLLFIRNINVLKIPNCLHSQLTHSSDTHTYPTRHATRGLFTVPKSRTNSRKRTVLYRALIAWNFLPSHIAQINSKPGFKKQIKQHLAAQRLSPI

SEQ ID NO: 3318 - protein, 770 aa, synthetic construct
  source 1..770: note = Description of Artificial Sequence: Synthetic polypeptide
MISCRPHYLPREFSSVFFVAVYIPPQSEAGTKTALNELYSAISKQENAHPEAALLVAGDFNAGKLKSVLPNFYQHVKCATRGKKTLDHLYSTHRDAYKALPRPPFGKSDHNSILLIPAYKQKLKQEAPVTRSIKKWSDEADAKLQDCFASTDWNMFRDSSDGIEEYTTSVIGFINKCIDDVVPTVTVRTYPNQKPWITGNIRTELKARAAAFKERDSNPEAYKKSRYALRRTIKQAKRQYRTKIESYYTGSDARRMWQGLQTITDYKGKHSRELPSDTSLPDELNYFYARFEANNTETCMRAPAVPEDCVITLSAADVSKTFKQVNIHKAAGPDGLPGRVLRACADQLASVFTDIFNLSLSESVIPTCFKQTTIVPVPKNTKVTCLNDYRPVALTSVAMKCFERLVMAHINTIIPGTLDPLQFAYRPNRSTDDAISIALHTALSHLDKRNTYVRMLFIDYSSAFNTIVPSKLITKLRTLGLNTSLCNWILDFLTGRPQVVRVGNNTSATLTLNTGAPQGCVLSPLLYSLFTHDCMARHDSNTIIKFADDTTVVGLITDNDETAYREEVRDLAVWCQDNNLSLNVIKTKEMIVDYRKKRTEHAPILIDGAAVEQVESFKFLGVHITNKLTWSKHTKTVVKRARQNLFPLRRLKRFGMGPQILKRFYSCTIESILTGCITAWYGNCSASDRKALQRVVRTAQYITGAKLPAIQDLYTRRCQRKALKIVKDSSHPSHRLFSLLPHGKRYRSAKSRSKRLLNSFYPQAIRLLNI

SEQ ID NO: 3319 - protein, 1090 aa, synthetic construct
  source 1..1090: note = Description of Artificial Sequence: Synthetic polypeptide
MYLLLCLLFTQCHPGLNRLNDQWVSELSSPYALQFANTPTRPSCQYHQELGLSLQLHLYHSQTQLDLHLMAYFQNLKLLNYFFSVSKDSVRFIDNGAGSTKSSRIGQLRYIVMLLLLISGNVRPNPGPVDTMQSLPTPYDFKNRAGFGLLHVNVRSLFPKIDMIRIWAKTTNADVMVLSETWLKKSVSNNSISIDGYTVFRTDRMSKGGGVAIYVKSEFNTSEILSITKAKHFELLAVKVNVYKDSHITVVGCYRPPSASGDALNSLSDVLHKLNDSEFIILGDLNWDMLTSVSDSFKELCDSLNLAQLINAPTRPNPRAPNKSTLLDIILTNTPHKYTSTGIFCNDVSDHCAIACVRNTKMTKAKPRYIFKRHFRQFDEQAFLHDLYHNIDRVSLIPDVDTAWDYFYMKFVSICDKHAPVKKFRISGRDNPWFSDNLAELIRKRNISWAQARHTNAPVDWASFRALRNKCTGLIRKSKSDYYLNAVTENLNNPTKFWKLIKSVSGSNVSSGLPDHLMMDSNEVKDKAHIVGVFNKHFISAGSVFDNGGAQASNVSSVTVNYDIGPHVNHFNFEPVSYTEVYKALKAIDTKKSAGPDNLDPYLLKIAAGIITEPVAHIFNLSLLTNSIPSIWKSAYVLPLLKGGDPSDANNYRPISKLPILAKVYESLVNSQLKNFFIEKNILSGVQSGFRSGHSTTTAAMAVANDIINALDKKQHCAALFVDLSKAFDSVDHELLLARLRNIGLSEGAVNWFRNYLSDRTQCVYTDNHKSSFLEINRGVPQGSILAPVLFSIFINDLGNGMQPAKLHLYADDTVIYSCAPSLVQAVEELQTAFQSLQASLYGLKLVLNVQKTKFMTFTRARTLPENVSIVTSGGLSIEKVSSYKYLGIWLDDKLSFKVHVDNLVTKLKLKLGFYFRNKACFPLMARKKLVQATFLSVIDYGDLLYMHAASSVLQRLDSVYHASLRFITNAKSLTHHCTLYQMVGWTSLYMRRKIHLYVFIYKALLGKLPLYLCSLVSFTTSSYHTRSARWLLLKVPRTFTVLGKTAFSSCAPDAWNSLQSMLHLDMLVPLNEFKILMGDSVTEECKCFF

SEQ ID NO: 3320 - protein, 591 aa, synthetic construct
  source 1..591: note = Description of Artificial Sequence: Synthetic polypeptide
  VARIANT 392: note = Any amino acid
MDVVEKEGKRKPYKSNLSNNEQGVLKALKTKPYVYLPSDKGGEFCVIEKSRYCEAAYKHLSDSNTYKKISRMSPNTIETKINKVWKDIAAKMNLKKRLTKSFVTKNSDLPNFYHLIKTHKDGPSIKIRPIVSNTNGPTTKTSWLLSKILKPLLNNVPYHLQSSDCLMARLNKTGKTTHSEFKYPFSLDVVALYTSIDPSEAIECLRRRLENNLLIKEMNTENIINLLTVILENTYFTFDQNIYKQIKGLPMGSSISGLLAIIFMDYLERQTLRTIQSIGFYARYVDDIFITTKSKKEAEEIFHIFNEAHPDIKFEIEYPDENGSLNLLDLRIKIDVDTPTYGFYKKSARKEIFMHQRSALPYLQKVNVIKNEKQRIANRCTEGKENYKQQLXFDKVLRRNGYHKEDIERMNSKPKTPMDRTQKKKKYFYLNIPFISDTLDFKIRKELNHTGLPIRISHKSWTLRQALANNTKKENICTMENCQTPKKICFRKNVVYCITCNACKEIYIGSTLRNLHQRIKEHLDPAGKSSVYRHLQQCQPRKERKSISIKILAGDNIQKNLRFKEAILILDKHPSINTKEEISEIASLICC

SEQ ID NO: 3321 - protein, 2038 aa, synthetic construct
  source 1..2038: note = Description of Artificial Sequence: Synthetic polypeptide
  VARIANT 277: note = Any amino acid
  VARIANT 292: note = Any amino acid
  VARIANT 311: note = Any amino acid
  VARIANT 428: note = Any amino acid
  VARIANT 457: note = Any amino acid
  VARIANT 521: note = Any amino acid
  VARIANT 525: note = Any amino acid
  VARIANT 800: note = Any amino acid
  VARIANT 1116: note = Any amino acid
  VARIANT 1135: note = Any amino acid
  VARIANT 1136: note = Any amino acid
MSKNGTDPHLLELCYKAHVFLNGSKEIPLSTAVGHWREIDSTGIFDSDFSELMEQIIAKPFKTEGLQLKIENAIKTFDKFIADAVNPDKLINHKHLNFFYNQLYYNPLKNFNFSIPIKSILKNNNIPSHRNFFNNEESTPLNKKSISFKNISHSKPFSYLTALTNNLKYENIDNILISIRNCTDSFFINLNICFFELKHLIKNNFINYFNDYFYIFYLKIQKFNNKKLQKSNYYQNNIPLLFKISSLTNDFFINIENYFSKIKTKRNINLFLNDFLXILKIKINILLFKYSXFKKLNPKNKHEKISTRSSXASGRLALAVTPSSPLDLTINTTKQTTTDINTDTTNTSHKFSNNRYSLFLDQNEPLDLSIVKHPHKNTNIPSTVKNTYNPLNKQKPFHKTTTKTIFSNAQNNIKKHNIDTSKRPHFSXPIPKSCNTDIKYEIPPIEKNTPKLNDIIXSNITFNPKTPNIQQNISLPKFILPSNLHNNTTNVDLDAESTLVNPHFQLNFNLKPCPNLFIPKXDLPXNLNMEIDQKLLLTNTKASDETISYSPITQTQTDESVLTHKLIELISINTQANRIIEQINSDIDLFSQSPHSYEIPNTETKEIFTVYNNLDIAKKRVEIIIEEDILKTKTQTNDDIPMINFNNNYINNNSLFKNILLSNESVENLFRDISDNDSIISKSPNKKINNQDFLKKTVKINKTMFNLRNDGYLICIGGKCEKKKIGIHNIDNIIEHRKTNHSDTIDKNTTFLCLLCEGSVKRKTILLNKIIQHTETFHSEKHFPVTREELNNKNKILELXMNTEGTLNCRYTNIKKHCQNDLTYKSTYAQIEKHIAKKHKRKTCNINEIICHCGETLEHHNIIEHHNKHIGVLPAEDKLRMIPDNIPVSVKDIGNDISILSTFFCMHLLPQSQQLLYNHTLLKPSYKQNFKTFFETFPFSQYPNWNEIILPFKTSTVNWAVFYFNKLKAFATIIDPLSPNSLQKHRKIADTILNTIKNIQNIIYPSNINLTELNYPMCANTNESGFFICHIIQCISINHNYITIPIISEIRKRLDNLINKVIIDRAPIDNILKYTNILNNIKILQNNNSENPDEGLAEINRIHECIFPIKHKIKKXLSLIHHLLLLKIIKLNKKXXFNPPSTIIKNNKIELTYKLRFNFNINYKSTINKIFNNSINTLSPHPDRIILNFEREIIIINDIKFKYKLPYYPENFIHKPTTIEEITNTFKIVDLSSSPGKDQISYLDWKKIDPDNSILCSLFNNILFKSITPLKWKTFKTKLIIKPGKENSSHDLSSWRPLAILDTSYRLFATLINRRLLEWIKLGNLININQKAIGCPDGCAEHNSVLLLLNERAVRMGTNINIVWLDLADAFGSISHDLIWNVLTNMGINNNTIKLFKNMYNNCNTYYECENNHYNFLKICIIIVTLIMNVKTTTTKTIPINNGVKQGCPMSMTLFCLAINFIITNILKDHPFIINNYNVSILAYADDIVLISDNRIKIAKILTDIIKYTSDVKLKFRPTKCGFYENNRNHDEKPLKIYNEIIPIIDENNIYKYLGVGFGGKSNHNIDNILEKALTDAEATFLSDLHPSQKLFAYKTSIHSRLIFPFRTCIVKHMILDCDRNRIVDNRTKQLGFDQKIKRLIKNSIGDIFQNISNNFIYAHCSMGGLGIVPSIDEYLIQSTIQLTRLLMSSDVTMRDFIIGELIECVRARFNYLENEIEMAMKWLNGDIDDEKVGKPCLFLKFKKSVYRLKIKFSIICKLTYIDNIFSLEISKNDFKIVINNENIDNASKIMHILTGEWYALEWYKMTHQGHIAETVGKSQFSKHLIKSTTLGDNQYFFLIKARNNSLNLNSNPSNHKDKKDVNCRLCRIQWETQAHILNHCTLSQNARRNKHNHVLEIVHNFFASKNYDIDIEKSPPNVDTTLRPDLIIKTTDKNKIKLSLVDIKVPYDNETNFINARKQNLDKYRNLAIETGKDNNCKAAVYTIIVGSLGSWDKENNKDLQKLGLGVNEIGEMARMCIKAAIEASYMIFMNHVTNNK

SEQ ID NO: 3322 - protein, 1070 aa, synthetic construct
  source 1..1070: note = Description of Artificial Sequence: Synthetic polypeptide
MLSQHSRSQALVKEEGCDRLGEPTLNLAILMEMKPKRNPLGRNPLSDAPYRNPGMVLNGQGPGRLPLGDAPCRDLGMVSSEQGSGRHFLSGALHRRPGVVKNEQGSSHLSRRVRRARKLVEPTRIRVGSWNVGSLTGKLRELVDVATRRRVNILCVQETKWKGQKAKEVDNTGFKLWYTGTAANRNGVGVLIDKSLKDGVVDVRRQGDRIILVRLVVGDMVLNVISAYAPQVGHDESAKRLFWEDLDSLVRTVPSSEKLFIGGDLNGHVGTTSAGFEAVHGGFGYGSRNQEGEEVLDFAVAFDLMIANTFFRKRRSHLVTFSSGQHYSQIDFILTRREDKRACLDCKVIPGECVVSQHKLVVADFRFQMRARRDKQAKIARTKWWKLKEETSEVFKERVIKEGPWKEGEDANNMWEKMANCIRKVASEVLGVTKGGRGVDKDTWWWNEEVQRTIKEKKECYRRLFHDRSVDNIEKYKEAKKIAKRAVSVAKGRAYEDLYQRLGTKEGEKDIYRMAKVRERKTRDFNQVKCIKDEMENILVKEDEIKHRWQEYFDKLFNGENENTTLQLDDSFDDTNRHFVRKIQESEVREALKRMKSGKAMGPDGIPIKVWRCLGDIAIVWLTKLFNHIFRSNKMPEEWRRSILVPIYKNKGDIQSCTNYRGIKLMSHTMKLWERVIEHRLRRITRVSMNQFGFMPGRSTMEAIFLIRQVMERYREKKKDLHMVFIDLEKAYDKIPRNVMWWALDKHKVPTKYVGLIKDMYNNVVTRVRTSDGDTDDFPIRIGLHQGSALSPYLFALVMDEVTRDIQGDIPWCMLFADDVVLVDESRAGVNRKLELWRETLESKGFRLSRTKTEYMRCDFGTTTHEEGDVSLESQVVPRKDTFRYLGSMLQRDGDIDEDVSHRIKAGWMKWRQASGILYDKRVPLKLKGKFYRTAIRPAMLYGAECWPTKRRHVQQISVAEMRMLRWICGHTRRDRVRNEDIRDRLGVAPIEEKLIQHRLRWFGHVQRRPPEAPVRSGTLRRDSNVKRGRGRPKLTWEEAIKGDLKGWNIPKDLALDRSAWKTAIHVPEP

SEQ ID NO: 3323 - protein, 678 aa, synthetic construct
  source 1..678: note = Description of Artificial Sequence: Synthetic polypeptide
  VARIANT 11: note = Any amino acid
  VARIANT 171: note = Any amino acid
KTLLKVETNPXTSTNNKWFVNISKTEIPPSVSNLLQLGGNFCLPPNKKTSITEFIKDIESNRCIQKERGEIRNSVIPLLHNFLHNNSSLDEVEKELLRMKRATSEFCKSNPNVIFTRADKGNITVAMDRLDYINNMEQLLHDKETYSIIKNNPIKKVEKDLNTTIKRWYDXDFISKQSYFSLHSSDSTIPKAYGLPKVHKENFPFRIIVSSVNTALYPIAKFLHKIINNSLPFDSRQVYNSFDIAKSLSGMKIREEYCLLSLDAKSLFTNIPLDLAMDGIRKRWPSIENNTKIPFDEFIFALKFILSSTFFTFNNVFYKQTFGTPMGSPLSPIIANIVLHDLEEKALKSINLEIPFYYRYVDDIVMAAPPNSLNFILETFNSFHNRLQFTIELEQDRSLSFLDLSLKITDNTIIIDWFHKKTFSGRYLSFFSHHPICHKIGTIYNMVDRALLLSHPTFQQKNLELIIGLLLKNGYPLEFIFKYIKIRIKNLFNTKMAPIITNDQDQTKKDENTKKFIVVPYIRNISEKTTSLLDKNTFTFGYRCINKINNFIKVHKDKTERDCSSNVVYKIFCNNCDATYVGQTKRQLRTRAKEHINNIKLDPSKHSVITNHRIFFDHSFNWKDIKILDTEENYQKRLISEMIHIKQQTNGLNSQNDTDLLHDSYFCLLDSLKDNTNI

SEQ ID NO: 3324 - protein, 955 aa, synthetic construct
  source 1..955: note = Description of Artificial Sequence: Synthetic polypeptide
  VARIANT 805: note = Any amino acid
  VARIANT 909: note = Any amino acid
MMSRACDASMPRSRPMARRAAYWWSAELAELRRATVAARRAHTRAKRRGMEDALNNAAAVLREARKALRTAIARAKAAAWDELLSELDRDPWGRPYKIVMKRLRPWAPPVSETLDPQFLGEVVDKLFPTRGRDIPEKTGPPPGWTEELEVSRHEMVAAFARITGRKAKAPGPDGIHAKVWARASSIIGEALRGPYTKCLREGTFPRRWKRARLVLLKKEGKPAESPSAYRPLCMLDDAGKIFERIIANRIIRHMSRNGPDLSPGQYGFREARSTVDAIRQVRSLSESITGDGKVALAISLDIANAFNSIPWGEVVAALSEHFRLPPYLVAIVRDYFRDRVLEFRDKTGLQQRRDMSCGVPQGSVLGPLLWNATYDKVLRGALPPGCHVVGYADDTFVVAGGASWVIAIAMGNWAVNCVVGSIKSLGLRVAPEKTEAIFFHDGSSRVPPRAFVRVDNTRVRVGATLKYLGLLLDGRWAFVEHFDKLAQRLGRRTDALLGLMPNLRGPRVGARRAYAYAAMAGALYGAPVWFREALASRRIRDVLHAVQRRLARRIVRAYRTAPSAATMVLAGLPPAEFTADALAWSYARAKAVRLQGGVVTPRVAALLRERARRRAMRAWRESLANDPPAAGSRILEAVLPHLDEWVGRPWGGLSYRTTQVLTGHGCFGEYLCRIRKEPTTQCHHCEADRDSAQHTLEDCPAWEELRGVLREEIGDDLSLRAIISQMVSRERAWVAVSSFCEQVMRQKEEAETVRERRPGGRMPPGEGNDGRGGGDGGHDPPWLPPRPPRRRRPAPRPPGPAARLXKGGGGPADQPRSPPPSPQLRRRGATAPIWRGGGDPPPLRLPAPPSGHAAAGGGPLTPASPARQTRPDGPGGATLRHNAESLPPLPRRGGGRGKGLLSPPQGRKXGRAAVSAARRGPGLRRGPDTPGLYPQQHQGKRRGRDGVPLPRPRAD

SEQ ID NO: 3325 - protein, 989 aa, synthetic construct
  source 1..989: note = Description of Artificial Sequence: Synthetic polypeptide
MVTPLRAIGGRPKSLRPSRRARQATESIPPARQSLASYPSRIRYANNSNNNWPHSPVTERAPNTAALRKMSKERLKKSRGRTRLPKRRKTKMIVCTFNARTLASEASIEDLMVQAQKIKYDIIGLTETRRHQSHHAIFDTGEELFLGTCDNRGVGGVGVLVNTNLAMSIDSFECLTTRIGRLRLNRCGSLPAVSIFVVYAPTSNYDEEEIERFYMELEKFYKEDHTFYKIIVGDFNAKIGPRRSPEELHIGTHGLEWNDQGERLSEFIMSTKTIHGNSQFQKAESKRWTWESPGGQFHNEIDHIIFNRRFCLTDVAVVPKFQTGSDHRLLRAKFYFTERGEKSAKFKSKKATPRMTTNWELFGTIAATWEDAVLDNIDEEYDRLVQHLHVCAKNAESEKATNRRLSSETLELIRQRGLARASGNHKLTSELTKLCRDAIKEDLKERRAAVLASAAEAGKSIRNARLSFANYKTKMTALRRPDGSITSSRKAMEKIIHDFYSDLFDSHVHLPTYQIPQDGYVVPNVLPSEIRHAISLVKTRTAPGPDKVRPEHLKNLPPVLINTLARLFTRYLSECKVPSQWKTSRTVLLYKKGDIHDIGNYRPICLLSVVYKLFTRVILNRIGRTLDEGQPCEQAGFRRGFSTIDHIHTVTKLIEVSREFKMPLCLTFIDLKKAFDSVETEAVIEALAKQGVQTQYIKILRELYCGFTTRISPFYKEVIIDVKRGVRQGDTISPKLFSAALENIMRRLEWEGMGVKIDGRQLHHLRFADDIVLITPNISQAAQMLADFDHECGKVGLQLNLNKTMFMKNELVPEAPFALNGTNISECSSYVYLGREINMRNDLVPELRRRKRAAWNAFKSVEEVVKRTKNLRLRAHLFDSTVLPALTYASETWALRKQDENAIRVSQRGIERAMLGISRLTQVREGIRSSDLRRRSKIRDAVSFAKASKIRWAGHVMRFRDDRWTRAVTDWIPRDVRRPRGRPPTRWSD

SEQ ID NO: 3326 - protein, 893 aa, synthetic construct
  source 1..893: note = Description of Artificial Sequence: Synthetic polypeptide
MKMPNRAASQSNSAEGPLSRPALTVLSWNAEGISDAKEEVLAHMCKQMNCDVLCLQETHRGSDNPRPKIKGMKLAIERPHRQYGSAIFMNEKIRPDSTSYTHNNDIEVLNVTIKGLTISSIYKPPNISFSYPSTTTNRHIVIGDYNSHSTQWGYDTTGDDGALVETWAQNNDLKLIHDPKLPKSFASARWKRRYNPDLVFCSRLLAPTSRKFVAEPIPRSQHRPIGIQLTAVITPNKTPFKRRFNFAKADWPAFTEHLDHALTHLPADPKNYESFIDIVKKVSRTHIPRGCRTTYIPGIDEESSQLLANYTTAYDTDAFSEDTINLGEELISRISQRHRQMWQHMIETTDLRHSSRKAWATIRKLGIDSTRAQQHYNVTADEVANQLLKNGKAPKTTNSHRHKLPGVDQNMSLFTRPISEEELQKGISTLHVNKAAGIDDIRSEQIKHMGSVAQKWLLDMFNNCIENTCVPKQWLRTKVVAILKPGKDSNEAKNFRPISLLCQTYKLLERLILNRIGPHVDSQLNCEQAGFRPGKSTTGQLLNLTQHIEDGFQNNLITGAVFVDLSAAYDTVNHRRLQTKLHDITNDLKLTRFIQKMMQNRRFFVELDGQKSRWRKQKNGLPQGGVLAPTLYNIYTADIPSTENTRNFIYADDTCITAQHSTFEAVELHLNTALASLSEYYRANYLRANPSKTQVCVFHLKNREAKRELKLKWNNVQLNHCEHPVYLGVKLDRTLSFKKHIEKTIGKVESRNAIIGKLASSHYGADPKTVQSAAVALCMSSAEYACPVWSRSAHVKKLDTTLNNTYRKITGCLKPTKVEEIYHLAGIGSPNQRRTNTCLKERMKQATDDRHMLHGYLQPHKRLISRHSFLDSVPPPEQNPPPSAKPVLIKGLT

SEQ ID NO: 3327 - protein, 1076 aa, synthetic construct
  source 1..1076: note = Description of Artificial Sequence: Synthetic polypeptide
MDTYKVYVLFYIALCIIIGLRGHSSYSKHETAFVPVRAPSRAHKQLHRSGYHKTPIKYYANASATFTLPIICCGDVESNPGPFELTSCNTNKRYKYTRGELVNINSNSCGKSLRLPVQTWKTISELEIGKEFKTRRGCRAGVRKLKHFKHPIPIILPTARTKLPKKYPRFPRRRCLTSVPVAPQSGCDLPSFLLSNVRSACNKFDELSAVISYLHVDIAAITETWFRNDCPLDNFSIPGYYLCTKSRTNRIGGGVAIYVRELLNPSPADVQVPINLEVTWVKIRPPRLPRSISCIYCAVVYYPQPDVELETELIDHLETTIDVILTNHTDAGFVILGDFNRMNIDPVLLTHSFRQVVDCPTRGAHILDKIITNIHQFYDKPQICSPIGMSDHNSIMWFPLKIKPKLPNTTRYVFNRPMTDSAIRAFGQWISSYDWPEVTEDVDVNVRCGSFYSTLNNAINIYFPVRKVLLHFRDKPWMTGEIKSLIHKRQIAFHQGKGILWKRLRNKVNSSIQKAKVKYYRSRIQKLKKSNPSRWYQEIRILTKGSRQSLNIPVDGVDPSERDKIANAINEHLISVSSDLQPLNLAALPAYLPSRSLPEVYPWQVNKVLSKIKCSTANGPDNISARLIRLFSVELSGPLTYIINASFSQGKVPASWKCAIVVPIPKVNPARIDKLRPISLTDHFAKVIEGFIAKWMYQDIAQHIDPCQFGNQKRLSTSHCLINILHYVFLNAEVPKTSSTILLTDFQKAFDRIDHTVAIKKLIEIGVRPAVVYWISDFLSERKQRVRYHSDLSEWCQINAGVPQGTKLGPLIFLVMINDFKSSESIHMFKYVDDLTLVECRKTNQISNMQEAVECLSLWADINKMQLNPTKCIKMDICFSRVPVNQSSIILENCVLSTVSQVKLLGVTIQNDLKWEAHVRDIEKRANAKLYMLRSLGKFGLSHEDLITIFIGYIRPILEYATQVWSGGLTSAQKQRIERLQKRALRIIFGKDYHSYANALTKSKLQTLESRRNDLCVTFFKKTLSCTDQFKQFIPQRAHNRTLRRTNKIPEPRCKTKRMQNSPIPDLIRLYNKSFL

SEQ ID NO: 3328 - protein, 938 aa, synthetic construct
  source 1..938: note = Description of Artificial Sequence: Synthetic polypeptide
  VARIANT 463: note = Any amino acid
  VARIANT 475: note = Any amino acid
  VARIANT 602: note = Any amino acid
  VARIANT 615: note = Any amino acid
  VARIANT 622: note = Any amino acid
  VARIANT 649: note = Any amino acid
  VARIANT 665: note = Any amino acid
  VARIANT 727: note = Any amino acid
  VARIANT 774: note = Any amino acid
  VARIANT 809: note = Any amino acid
  VARIANT 916: note = Any amino acid
MMRQTNKNGYRPGCRPGEQEPRPPVTNQAEVGKLNTGFKSKSRIKIIDCKAATLISSFNVRSLKSKEKMGELTALAEEKRIDILCIQEHHIYHENVDIQMKDMGKGWVLAMSSGTKNTVNSTVGGVGILMSPFAYKSLEYLEKVSSRILLAKFSGNPAPTVITCYSPTNCSPDNEAVNFYSLLSDVIKKIPQHNMKIICGDMNAQVSSADSKGFTFGNRTNRNGQYLLNMTFECDLIACNTRFQKAKEKLWTFTYPNKSQAQLDYILVNKKWRNSVKDCQAYNSFGPLNSDHRIVSTKMQLSLRSNKKVKAKSNLPHDWQLFKSDCSIKEAYTVEVNNRFEALYQDIENPTANEIYSALIEAHEGAATKYVPKRKGKKKRVPWENEKIREKRKCLKVAYNKKNGAPTAEHAETLDKAKKDLQDAYDEEQSNYIAQKCTEIEIGAVQQQTRKVWDIVKEITGKXSTPVDQLRGKTXQERLNQWKDHFSNLLGQPPPDNNNPVSKFTIAELKVAVTSLSNNKCPGVDGIPAEVWKSGALDQQLLEVCNRTLIHGEKPDLWSRSIIIPVPKKGDLSTPQNYRGIALTPIAAKVFNKMLLNRIRPXLEPLLRKNQNGFXPGRSTVXHILTLRRLVEGIKAKHLTAVLTFVDFXKAFDSINRKKMLKILXAYGIPHTIVTAVGVMYKDTTAQVRSPDGETDSFTILAGVLQGDTLAPYLFVIALDYALRTAXEGFEDLGFTLQERKSSRYPAVMITDTDFADDIALISDDLEKAQELLXQVESAASQVGLQINSTKTEFMLRNLREGEICTADXTKSKQVQNFQYLGSWVISKQDLNIRKAKAWTALNKLTAIWKSNLGRKLKVRFFTVETVLLYGSEAWTLTSSLEKQLDGCYTRLLRAALNVNWRDHMTNIELYRDITXISARLRDRRLRFSGHCWRSKSE

SEQ ID NO: 3329 - protein, 765 aa, synthetic construct
  source 1..765: note = Description of Artificial Sequence: Synthetic polypeptide
MVITNTWFKEHPRRVYTWKSPGDIVRNQIDYIAINSRFKRAVKQSKTYPGADCGSDHVPVICTLQCKLKKLKRPKVVKILDFKQLSKPDIRQEFTVQVKNRFELLIDEGEENTWETMRNILVETAEEYVPTKERKRRNKWMTEEILLMMKDRQKIGNRQCKKYRDLDKQIRQKCNEAKESWLNEQCVEIENQFDKNSNVYQRINEISGKKSGCSNPGCIKGKDGSILFEMKDKMSRWTQYIGELFEDSREAMPSFADEVKGEKILKSEVRWAMSKMKKNKAAGPDGVVTEMFEALEEYGVDRLTEIINKIYDDGTFPDELGRSIFITLPKKPGAVDCEQYRTISLICHITKIILRILLLRARSRITPMVGREQFGFVKDAGTRNAIFVVRNITERAVEMQKDVYMCFIDYSKAFDKVKHSELFEELKKLDIYRKDLRLLQSLYWNQFACIRVEGECSEYINIRRGVRQGCVMSPDLFNMYSEIILRELEDENGIQVGGHSITNIRYADDTVLFSESEKDLQRLLNVVVKESERMGLEINYTKTKCLVVSKKSSPKCNLKLKEQIIKQVSSFNYLGSMIAEDARCETEIKRRIALAKSAFSKLGKILTNRTMSMRTRIRVLNCYIYPVLMYGSETWTLASDTKKRLESCEMWFLRRMMKIPWTDKVSNEEVLTRAGVQRKMIREMLIRQLKFMGHITRKEGLENLALTGKIVGRRSRGRRRILWMDSLQKLLEERGVKELGVVLIQKARSRGLWNSMIAKVKRYGT

SEQ ID NO: 3330 - protein, 1050 aa, synthetic construct
  source 1..1050: note = Description of Artificial Sequence: Synthetic polypeptide
  VARIANT 36: note = Any amino acid
MRNSMKLHTGSVVFRVNKDRAVRSGLPSTVPSMLGXKQQQQKDDTSGITTMTFGQWNVRTLLDREGTGRPERRTALVAMELEKYRIDIAALSETRFSESGRLDDMGYTFFWSGKPDGVRREAGVGFAIRKEILAKLTEMPKAVNDRIMTMTVPLTKKGNATLISVYAPTMTSPDETKENFYNQLRRTLRDTPRTDKLILMGDFNARVGRDYEKWQSVIGRHGIGKCNTNGELLLALCSEFELLLTNTVFKQREEHKTTWMHPRSKHWHLIDYIITRQRDRMDVHSTRTMRGANCLTDHQLLRSKIAFALRSKRRKQGATKLAKLNTDRLHVNTQRLNLEQDMEKALTNWGVQEGMTVDQTWASLSKVVYETASNTLGKPERKHQDWFDPEDSELLILMKKRDETHQRVLQTRSTRSTTTAYKEACRHLQRYTRKMKTTWWEKKAEDLQRSADNNDMKSFYTGLKEVWGPQTRSTVHLKSLDGNTTFSDNKRVLERWSQHFETLLNQPGDIEPAARDRINQRPVVTALDDIPTRKELNLAIASLGDGKAPGVDGIPSEIWKHGGATLTNSLLMLIQQAWAEGSVPQEWKDANIVTIFKKGDRTQCGNYRGISLLSIAGKVFARILLNRLNAHITPDILPETQCGFRNNRSTVDMIFCLRQLQEKCIEHNRSLYVVFVDFTKAFDTVGRTGLWQLLRKYGCPEKFTGMIESLHTGMMAKVKEAGETSDSFPVSNGVKQGCVLAPTLFSIFLSAMLEEAFADFEEGVYIQSRQDADLFNVAHFKAKTKSTQILVRELLFADDSALVAHTPEQMQHVIDVFSSASKKFGLQINIKKTEVLFQPGTDHREEEEILVDGTALNQVDDFTYLGSTISKDGRIDSELVKRMSKASSAFGRLRTRLWNNHHVSTRVKCKIYRAIVLSTLLYGAESWTLYKSQVKKLHAFMMRHLRAIMRISWKDKVTNKEVLERANLPSMEDLLIRKNLRWTGHVIRMPSERLPKQVLFSQLPAGERGIGRPRLRYKDTIKRNLKRRQIETKTWTTAAGQRAVWRTAVK

SEQ ID NO: 3331 - protein, 986 aa, synthetic construct
  source 1..986: note = Description of Artificial Sequence: Synthetic polypeptide
MNSHAHTPDILVDDINESKYYTPQEFKNSFSYKPDNISLLHINSRSLNKNFEYVENLLHSLNNFAFSVIGISETWLHQNSPDMFNLPNYKLIRADRKGRRGGGVAFYITQNLNFKIRSDIKLTQAESLFIEINNSNVKNVIIGLIYRPPDSNCELFCDELDFYLHKIGDENKHNFILGDFNINFSPSSDNSNSTNCMQLMHSYGFFSIINKPTRINPHSSTQIDNIFSNVHNNKTIGGILCSEVSDHLPIFLTCECKLSCSKSFDELYRKESKRNIELLKQDLFFEGWAEVYNVNDVNTAYKHFSNKLQYYYEKNIPLGKMSNKRNKPRNPWITKGLLKSIQTRNRLYKLHLRNPTDTNLNTYKIYRNKLTKLIRTSRRLHFSNKIKKASSNTTATWKIIKEVMGKKTNPPPTDNITLNGTKIHDPSLHANSFNSFFTNIGPELASKINRTHAHFKDYLSNQNQESLFLNPTNPSEIINITQSLNNSKSHGFDRISMSLLKEIMYPLAKPLTHIFNHSLSQGVFPDLLKIAKVNPILKKDDPHEISNYRPISLLPSISKVLEKIVHNRLHKFITKHKILNSNQYGFRKNYSTDLALIQIYDKITSAIANKEHVIGIFCDLSKAFDTLNHAILLSKLSHYGIRGQPLLWFKDYLTNRRQYVTFNSYDSDPLLIQCGVPQGSILGPLLFLLYVNDIINTSPLLSFILFADDTNIFYSHKDLNSLNNTLNYEINKVSDWFKSNKLSLNTKKTHFMYFKHHSHNTETPIYIKIDGMLLEKKTNSKFLGVLIDETLTWNDHLHQVTMCISKSIGIISKLKFLLPHATLFLLYNSLVLPYITYCNSVWANCGSTKINSIFKLQKKAIRICTGSHFLAHTDPLFYKLKTLKIFDLNTTQVAVIMFKYINNLLPPSFDNMFRFNNSVHSYSTRISGNFHLTNPKLSITHKSVRHSGPDIWNDFPDNIKSCSTIYSLKATLKRQIIQSYAPHSLN

SEQ ID NO: 3332 - protein, 1075 aa, synthetic construct
  source 1..1075: note = Description of Artificial Sequence: Synthetic polypeptide
  VARIANT 76: note = Any amino acid
  VARIANT 105: note = Any amino acid
MGRKPKYPCGVCSRAVTTRTTGVQCEGTCLKWFHAECIGLTSTEYVAFDSSSIVWICNHCGAQNLAHSCLSSLQLXPDTNRFGVLDPDGQNVISEENSNSCRPTXDSSNPSSPGSPAYSSSPQNIKQRRSKHKPRPRVLRFLNVNCQSIRAKMQPFSILVHQHNPDIVIGTESWLSDGINSNEVFLDEQYSILRRDRSNDPHGGVFIATKTDLIVTREEELETDCEILWCRIEMAGSKTLRVAAYYRPKEDDEVSLAELQRSLSRLDRRHLVVLAGDFNLPGWKWDGPYVGPCAYPALHHQFGEIINDHGLTQLVKEPTRQANTLDLILISNPTLVNSVKVVPGISDHNCPVADIDMSPPRRYQPKRKVPMYKKADWEGFAELMQHVADYICSKSSSASVHDLWQLFKSGIEGGIQTFVPHKMLKQKQDLPWITSGIRKLIYKRDRLHKQVTRLRKQNMLVPFPLETELQHLKRLIQAESRKAYWSHLESIFTADGPNEYEGMKRFWKFVKNNRTDRCGIHTLKTDEHTITSPQDKAEALNKQFKMAFTNETDVPADLLPETSPYDSMPDIHISTEGIVKMLKKLKVRKAPGPDGIPALVLRKLSRVVAPSLRAIFDVSYRTSEVPDDWRLANVVPIYKKGDKTDPENYRPISLTSIICKMMEHIFASNIMGHARRNSILRPLQHGFQAKKSCELQLTGFVTDLLNNMEDNNQTDIVITDFSKAFDKVGHQRLLKKMEYYGVRGHNIDWISSFLSNRKQQVVLDGHTSSTVEVQSGVPQGSVLGPCLFLFYINDLPNQLSTKVRLFADDTVLYHTIQTPEDAELLQQDLDQLCGWSSKWMMALNPKKCQVITVSRKKTKYVHRYSLNGEILESVSAAKYLGITLTADLNWTQHVSATCKKANNTLAFLRRNLRVNSTRLKTTAYQALVRPLLEYGSAVWDPHTIRCVNQLEMVQRRAARYVLNRYHHTSSVSDMLSQLGWTSLQKRREHQRLTLLYKMHYSLVDFDIHHYIQPATVVRTTRSSRPYCYRVMQSRTEQHIHSFFPRTVRQWNALPLEVVLAPSVEAFQRQLKTGGK

SEQ ID NO: 3333 - protein, 994 aa, synthetic construct
  source 1..994: note = Description of Artificial Sequence: Synthetic polypeptide
  VARIANT 143: note = Any amino acid
  VARIANT 177: note = Any amino acid
  VARIANT 320: note = Ile or Leu
  VARIANT 443: note = Any amino acid
  VARIANT 444: note = Any amino acid
  VARIANT 945: note = Any amino acid
MMADTSTCVLQLNAEGPYPLKARSDYPHIAKENWVNVICLQETHCETEEQLHIEGFDLICFIPHKKHGIASYVKQGMKASTTGRSPVNSALQWSTFEAMGTHFCNLYKPPPVDVEIILFPKMPRNSFVCGDFNSRSTAWGYPXTNKNGKLIFEWLESQELVILYDSKDNPTFYSGSXKSWTCPDLSLVSSNIRHTCSRTVLPKFPRSGHCPIIISSDIKLQLSNLPKKRWNFRKADWPKFQELTNNKLTSRLPDPSTSNVNDSYSAFCSMLHQAAKLSIPRGRRHPYIPCWDEECDRLYESCAKSKTIEEREAVGNDLLXSLGEKRRIRWEEEVSEINFTHSSRKAWTTINKLTGRSSAPKQCPVTANSIASVLVNNGKWQDKTTEAKAHSRSVNSEIKNLLKSTPESTSMSEAFTLDEVETALKSIKSGKAPGNDNIHTEFXXNMSRKATSWLQAFLSTCMTTSTIPSKWKTAKVIAILKPKKPADEPKSYRPISLLSHIYKLLERLLLARIVDTVEEKLPTTQAGFRKGKSTTDQVVRLVNNIETAFQKKQKFGAVLVDLTAAFDTVWHRGLYLKTLQTIPDVRIVKFIMLLVQDRSFVLETSNGECSRKRKLRNGVPQGSVLAPILFNIYVSDMPKGECMQYSYADDTALGFDNHSFEAIKTSLEKDLKMLAEFFNRWHLKMSIPKTVSSVFHLANRCANRELNISLDGSRLNFVSTPKYLGVTLDRSLTFHEHAKATAQKTQARVSLLKKLAGTGWGANFTTLRTSTLALAFSTAEYAAPAWSHSTHVHKVDVVLNDAMRLISGTLTATPVSNLPILSGIPPAQLRRDAQYTKLAQKHDRDKCLVPAPSAFEGQRLPRRHFATQAAELPLEKPPSTLATWIAKRWSDLQWNSSTTNLKEFIPKPCAKPSGSDLPRKAWVNLNRIRTGVGRTQYFLHKIGAXSSPNCACGEIQTMDHVIDDCPIYKSPHGASGLRELDDETICWLNKDLPI

SEQ ID NO: 3334 - protein, 952 aa, synthetic construct
  source 1..952: note = Description of Artificial Sequence: Synthetic polypeptide
TDTDRGKQSKFKRKLRDRKLQIFYTNCDSLLNKRNELLLLLQSHDVDLVLLTEVFPKNHQNPLTHRDFILEGYDLHCNLEDGNRGVAIYIARDLYHLVGECDLQHSFHESVWILITLRGSDKLLIGCMYRSPSLDNHEELKRAFTQVTSINSSHVLIAGDFNYPNIDWKLGRARSHTEQEFIETVADCYLHQHIGEHTRYREGQRSSMLDLVFTNEDGMINHIDYVPGIGRSDHIGILFGLTVYTPDTHTPTPHLQFYRGQYDDMCKELDQIEWESELENKSVEDAWEFFLVTLTEKMEKFIPKSKPKHRRKKQRWMTREALRKQSQKHRAWKEAQRTKHPVDIMRARRLAKQLQTLTKQLCRNFEKDLAMNVKSNPKAFWRYTNSKLKTSCRLGELRTPDGERISTDKGKADALNTFFATTFTDEDKGHIPKLPPRHKGETLTSISISEDDVYKKLVHLSKYKCAGPDGIHPCVLKETAASVSEPLSIIYNASLKEGKLPSAWKVSHVVPVHKKASKMDVKNYRPISLTSVPCKILESLIRDEIVAHLMENDLLCDEQHGFVPGRSCVTQLLTVMEAWTEMLDKGTPIDVVYLDFKKAFDSVPHLRLLSKLETYGICGQIKEWIADFLQGRCQRVRVNDKLSDWTKVRSGVPQGSVLGPTMFVLCINDLPDGLQGSVKIYADDTKLYGKASTKDDLCSIQSDLDALMEWSNTWQMHFNTQKCKVLHIGPGNVKHIYALGDDVLEATSEEKDLGILIDDELKFHNHVAYAVKKANGVLSCIRRSFECRDRSTIPKLYKGLVRPLIDYGDSIWYPRFKTDSKTIERVQKRATKMIYDIRNRPYIERLRALNLPSLEYRRRRGDMIQVFKIIHGLERIPVDTFFEHSTSNTRGHSLKIVKQRCSTKIRQDAFSQRVINDWNTLPEEVVTATTVNAFKARLDRVWKDKRFCSPYE

SEQ ID NO: 3335 - protein, 541 aa, synthetic construct
  source 1..541: note = Description of Artificial Sequence: Synthetic polypeptide
MVDRVSLWHKLLRSGVDGKVFTVIKNMYSQAKSCVIVDGQMSEAFQCDVGVRQGENLSPLLFAIYLNDFEDFLSKHFKGLKFLVENVCADILDKEVNKDLFLQLYTLLYADDTLILADTAEELQVALNALSQYCKIWKLSVNAMKTKVLIFSRGKVRKFPVFRFGEDEIDVVDDFVYLGVQVNYNGSFKKAISKQVSQARKALFSMSLKVQRLKLPLDIQCELFDQLVLPILIYGCEVWGYEDLSQIEIFHRKFLRSALCVNKFTPDCMIYGETGRAWLANSIKHRMVSFWLRIVKGSPSKYSVKFYFLQRLISQNVDMSTSFKWLSCIEKILNHAGLGIVWLKQGEGFSNSWILSTLKLRLNDISKQDVMATIWTNSVCLNYRIFKEDCLFERYLVLLSKKDRITLSRFRCRSHRLPINNNRFKEAVNEISIECPCCDMHESGDEFHYVFVCPFFRKERELYLGRKVIVKRPCTSHMLNLFSCSGIGQLKKLVLFLRIIMSYFARLYTCKSEQSNHMSPIKRNVTTRSGRLIKQPTILDL

SEQ ID NO: 3336 - protein, 1047 aa, synthetic construct
  source 1..1047: note = Description of Artificial Sequence: Synthetic polypeptide
PSQRVNIELCCEITVSADKLAPNMLDNFGIIVVLSVIASLPHFIAESRPALLAGVTMEFQLVQNSIDTERYSDQYRYTKDELLSLRNTSHSRLPDNVFARIKELGIDKRRGCRAGSHKWRKIAVVEGRRRRTPKPPGVRAPQLIPIKTITTVSTDRQSQGNLPTIYMCNPRSLNNKLDEFSVVVHELCCDVCVVTETWFRADQPESDFAVDDYLVFAKSRDSRRGGGVAIYAKPESMPKTVNFLPPHPHHEVIWLQLRPKRLPRDISCLYVAAVYSPPDNDCVNDLIQYLVNAIDDIKTRHGDAGVVILGDFNRADTSELTSTCNLRQVVRKATRGTAILDLILTDIHQWYSEPEILSPLGLGGDHNAVLWKPKLNKTNSKNKAVRKFVRPMKDSAIREFGQWISQHTWDDVMASSSAQEKCDKLYASLQNAMDEYLPMKSVKMHPRDKPWVTPYLKSLIGQRQKAFSNDRTEEWKRLRNKVQNKKTELKKNFYKDRVLKLKRENPSSWYKHLKIMTSSKTASNIIIPESPELDDLAIADCVNDHFANVSQDIPELDLQSLPAYLPTPKPQLTVQPHEVYKELNRIKPGKSSGPDGIPARIVKEFAVELASPLCEVLNSSYHSGSVPSQWKGAIIAPIPKEKAASSIDKQRPISLTDHFAKIAEVFIYRKLLADVRHQLDPKQFGARAGRSTTHCLVEIYNFLCKRAELPSNVTSIVSTDFSRAFDRVDHTILIRKLITLEVHPWVIVWICSFLTDRQNQVRYHGELSSTRSMTAGVPQGTRLGPLLFLVLIDDALRESEVERWKYVDDMSLASAEPSNQHGQFMQNVLVNLEEWCNQNNVRLNPKKCNIMRVTFSKTPLPDRDFSLCNDVLQEVSAVKLLGVILQRDLKWNDHVSVTISRASSRLYMLRRWKEFHLPAADLVTVYVGFVRPLLEYACPVWHSSLTCAQSAALERIQKRALRLIFPGTSYNTSLDLARIVDLETRRKTLCINFATKASRSEVGSDWFTENNPTRNLRKNKRYREPRCRTNRYQNSPIPFMTKLLNFN

SEQ ID NO: 3337 - protein, 715 aa, synthetic construct
  source 1..715: note = Description of Artificial Sequence: Synthetic polypeptide
LTKTEKDLLSRGLNSAVTPEELPVVDLITATETAIRNNKLPETEAEQIRLKVSAALANAKAPASNITAQEKRALASLAKDKDITILPADKGRCTVVLNTTDYDSKILSLLGDSNTYEKLKRDPTSTYKKKVIDLLQKLEKEQAIDKPQYYRLYPGEATPCFYGLPKIHKEGTPLRPIVSSINSVTYNISKFLASILAPMVGNTPHHIKNSQDFAEKVSNLQLESGETMVSFDVTSLFTCIPTSEATEAIHKRLLLDKNLQERTTLSPAQICTMLDLCLNTTYFQFRESFYRQKHGCAMGSPVSPIVANLYMEEVEKRALLSFTGAAPSRWFRYVDDTWVKIQTKEVEKFTTHLNQTDTFVKFTREDVKGDSLAFLDCEIRIEEDRNLSIEIYRKPTHTDQYLLFDSHHPLEHKLGVIKTLQHRATKVPTTSHGRKKEQDHLTTALKTCGYPDWAFTKTRKKRDPSNEEEKDKRHSVSIPYMAGVSEKFRRILQKHNIPVQFKPSNTLRQKLVHPKDKTPRHKQSNVVYAVQCQQECRDLYIGETKQPLHKRMAQHRRATTSGQDSAVHLHLKESGHSFEDNQVRVLAREDRWFERGVKEAIHVKMEKPSLNRGGGLRHHLSPTYNAVLHSFHKQKPKHTHSFTRAGVTSPGDPAVKRKTSQTETRSTTLPTTLPTTPETSIQTTGILMQRLSVDISMPMVQKGYIFKLCTEPDQN

SEQ ID NO: 3338 - protein, 1288 aa, synthetic construct
  source 1..1288: note = Description of Artificial Sequence: Synthetic polypeptide
MSVCYKCKSSVVNSIACLNCKKAYHPSCLRAFKNYSAIGQDLTSISACPCCDKLKSLQNPTSPTLNISTNTIFEDLGILKQETDLIKKTLDDLKTFITESPTTVCTFDKIDEYVRKSFDDLESKLISLLKDTLNREIEKLKNSIKNEVIAEISTNLNRTNDNIKTANSSDLTLKSTNSKNVSTQSVSKTNRYKVRIFADQKGRHCIDLLETYIPVSKYVIQSVVKPYSSLQELLKTENNNEQLGNNDFVVIYAGNHEAQKGKIPDENTLNELINHKFLNTNIILIGCPYFVNRPILNNFVYELNCNFYNVAKNNKNIYYLDSNDKIFDQFKTDNFVINKAVKRCIIKNLGDLITECQDHTNRSAVEQNPVATFLDTSLPSVDKSDSQSFLSVFLNRFVCLQPSHSKISISINKKTVNSFHGIYQNVRGLKSKSVTFFNSFLSTSDEFDLIVITESWLDDTVLDGELFSDNYYVFRRDRDLRHLGIHRGGGVLIAVNNKYNCRQLDISNISRRSSPAIDLVAIKINVTSYQHLFVFVVYIPPSISFSDFDNFFDLLNNFDEINNDNVLFLGDFNTPLFSGFSKNNFSISLKHFASFHNFNQFNNIRNNRNNILDLIFSNMDCAVSKSSFSFVPEDPFHPSLEFTLDIVAKTPDKFYMNRDHVAFNFKKANFDCLYTTLQVVDWSELEKFSDVNEACRVFYETLYNCFELSVPKLFCRKNYRTFPTWFNTDIINCLRRKSNILKKYRRTKNMHFYEEFKKLRSLSKSLITTAYSQYIGHMENTISKDPKKFWSFVQAKKRNSRIPGVLYHNGNAISNPNDIVNSFAKFFKSVFSDMTLTSDSPSMMTNLNSFITVNEINEHEIIRVLKRSKDTLTAGCDGIPSFLLRDCAHIFSKPLVYIFNLILQTSTFPNIWKIAHVCPVFKTGDITQIQNYRPISILCNFSKVFESIIYDRIYSSVKRFISPSQHGFVEKRSTVTNLACFTQFISDALDRKGQVDVIYMDFKKAFDQIDHHLLLLKLDQYGFSGSLLSLIKSYLANREQRVKYRNYISDSYVATSGVPQGSNLGPLLFLLFINDICGSLSTCAKLLFADDLKIYTEIKSIEDCLTLQNNINAVVKWCNENRLYLNPSKCNVMSYTKKREFLEFVYDISSVTLHRTFIIKDLGVIFDTELAFSEHIRDVTARAIKSYGFIYRNCRDFKNLSVMKTLFFSLVRSKLEYGALIWHPIYKIHIDQLENIQRRFLKFLVFIIDGNYPIRGYDQNLLLNRFGLQSLQFRRICIIIKFLYNLIN

SEQ ID NO: 3339 - protein, 603 aa, synthetic construct
  source 1..603: note = Description of Artificial Sequence: Synthetic polypeptide
  VARIANT 84: note = Any amino acid
MALRAARKNYYGQRIQNADNKSKCAWNIVNKICGRSKKCCEIQIEGDPKQIVNDINQYFINSAPFVRSKSNNNTISSNAKTMYXYPVTSQEIITIIQNLKNKKSAGFDEISNNIIKYCNEEISAPLSFVIQNSLDYGIFPEQLKRAQVLPIYKKGDPTLISNYRPISLLSSFSKIFETVISSRITNFLMKFQLLNSSQHGYIKGKSVDSAIFSFTNALLDKLEEKKVVLGIFLDFSKAFDCLDHNILISKLKKYGIRGIMLKLITSYLNNRYQQVTITKNSTVYTSNKLLIKQGVPQGSILGPLFFVIYINDLLNILTVSDNNSAVNFADDTNILIWGENMTDTMKEAKICMNKVINWTKENKLVLNFEKTYGIHFAICNHKNTEKPNKIVISSKEIELIEKTNFLGICIDHKLSWTNHIDNLLKKLNSVHFTIRVLKKYINIEQLRIIYFANFQSLLSYGIIFWGQSGKISKVFVAQKQVMRTMFNLKYNETCRNIFKSNNFLTVTGLYIYRLLLFFFKQNLLFNVTNDHKYDTRKVDLEYPRHKLTLTEKNSYYAGIKLYNSLPVHLRTPCNLNLFKKKIFDYILDLEPYTLNEFYNRQVF

SEQ ID NO: 3340 - protein, 1658 aa, synthetic construct
  source 1..1658: note = Description of Artificial Sequence: Synthetic polypeptide
  VARIANT 1383: note = Any amino acid
MPATSTWCQGPVPRIIGGSQEPAAFLSWGTLLCSGYGIIQHRDQQRLAGTPFFICRSLGTCQRAISSIIRTKMLLSGDVEENPGPSLRGMQWNCAGLSQGKRLALHKTLVDERIAFCLLSETRMTPGEAACFSVAGYQHHGIARNCKGGGVSILVREDLPVETGMAVVGRIEQVHATIHLARGTALTVTSAYIPPKHTFTATDLDTLLTTDGAQLIGADANAHALAWDRASPPNTKGETLTQWCIDNQFLVCNTGECTRYARHHGESTPDVTLSRNCTVYTWTSLYSPDSDHHHIFFDVIVGDDTDALSCPRLRKPMYAWLKADWRNFRLKVDELCRKIGREKNVNTLEQKLSSAIRIATKVSVPRGCRATPPHWTPELAKLDEEIAGCGPSHRREKLVATRKQILDRTTKKRWSTLCSRLAVSDRCSWHIVKKVYAPRPLTTPAVLVDNAAITDYRQAERFSKLYSSRARRHPDSHPPAPIKTIASEFSPITMAELRRSIKLLPSGSAAGPDCLYNEALQHLGRTALNVVLRLFNESLRTGVVPPAWKTGVIIPILKAGKKAEDLDSYRPVTLTSCLCKVMERIIAARLRDTVESQLTPQQSGFRPGCSTLEQLLHVRAALCRPTHQYRTGAVFVDYEKAFDTVDHDKIAREMHRMKVSPHIVKWCVSFLSNRTGRVRFKEKLSRSRTFERGVPQGTVLGPIMFIIVMNSLSQRLAEVPLLQHGFFADDLTLLARHTERDVINHTLQCGLNVVLQWSKEYFMSVNVAKTKCTLFGCIERHPLTLQLDGERIGADRTPKLLGVTFQCLQGMATHAAETRRKMDFRLLQIAAISASTWGPRRQVLRAFYLALVQAHTMYGIEVWYWDASERSRDLLAAAQHKASRIIAGIPHGTRKEDSLLEANLLPLKTTTLVRSMKFMLMCESRGGCLRRSAEEVYHSKHPVRALHSRIMRSYPHLRIEPREHPLETSTLRHSCRPLFHTQIKPVCADDPDDVKREASEKWIARHFARRGKEPPRREHYELWTDGSVSLGEKSGAAALLYRNNTLICAPKTGAGELSCSYRAECVALEIGLQRLLKWLPAYRSTPSRLSIFSDSLSMLTALQTGPLAVTDPILRRLWRLLLQVQRRKIRIRLQFVFGHCGVKRNEVCDEMAKKAADLPQLRDTWIPDIIAYAKRVLRSEEVHENTHRFGITGNHFPTKHKEELTREEETALARFRVGSSRHYGWMLRKINPSVPPQCRWCNPQHAAIGPTIQTAPTVATRTLQRTSEPTKCTECDATYQCRSSAVTHMVNKHGFVRADALRRIKYGDATPAVDIPPEPPPVVAIVPLPSSTRVPMRPQVLHCTLCASKFAVPGRLLHHLRTIHGIGSGSCRVKRGRENEDSXQGDGRAPAAPASQDTRKLPFQCDLCEASFGTRSSLSLHKKFKHKSIVTEDGTVVVVQFPRKRAREGNVDVPGKGEVQCGVCQKVLSCRDSLIRHCKAFHKGEGVELKCSKSTKLCATDSPHTNTSMLVCPTCGRQCASKTGLTLHQKKMHGMKVERAVTSQRGDCEETSLHLMSCPGLKELRVRFAVEGVCVQDVCFSKRLAQFLIAVERSRPQVKSSPKVTVIQPTLPSATSPLIAECGASRKSTGRRNSPDTLRDRGGMQSTSNRNRKKRGRE

SEQ ID NO: 3341 - protein, 975 aa, synthetic construct
  source 1..975: note = Description of Artificial Sequence: Synthetic polypeptide
MDVGTTKVQVYNRQTLLRYSNHAYLTIKDGLLHTLRDLGLLREPDLLTAVSPGANGGRRSTRKRCTRTRKRGKRAGVRARLRTNPSRPALPSILLSNVCSIENKMDYIRLQQTTQREFRDCCMFVFTETWLSERVPDAAIQLDGLVAVRADRVAALSGKNRGGGLCVYINTKWCRNSVLVSSHCSPLVEFVVVKCRPFYLPREIASIHIIGVYIPPSANTKDALWELYSAITDIQNTHPDGLIIIAGDFNHANLRSVLPKFHQHVEFATRGPNTLDQVYTNISSAYRAEPRPHFGYSDHISVMLIPAYRPLVRHSKPVLKQVKTWPAGAMTALQDCFECTDWNMFREAATYSDYINLDEYTSSVISYITKCIDDVTVSKCITTRLNQKPWFTGEVRVLLRARDSAFREGDEVALRTARAKLSRAIRVAKRAYTQRIHSFFQENGDTRRMWQGIQAITNYRSTPSACDSDASIADALNDFYARFEAQNNTGMRKTITLPSDQALRLTVADVRMTLERVNPRKAAGPDNIPGRVLRECADQLADVFTDIFNISLNTSTVPKCFKTTTIVPVPKKSSVSCLNDYRPVALTPIIMKCFEKLVKKHIKTLLPPALDPLQFAYRQNRSTDDAIATTLHLALSHLDKKDTYVRMLFIDFSSAFNTIIPQHLIEKLSLLGLNTSLCSWVLDFLTDRPQSVRIGNIISRTTTLSTGAPQGCVLSPLLFTLLTHDCAATHRTNHIIKFADDTTVVGLISNNDESPYREEVQRLTDWCRANNLSLNVDKTKEMVVDFRKTRSDHLPLYIDGSNVEIVKSTKFLGVHLAENLTWSHNTSYLAKKAQQRLYFLRKLRKSHLPPSILKTFYRGTIESILSSCITVWAGNCTVMERKTLQRIVKTAEKIIGVSLPSITDIYTTRCIRKATSIVADPTHPSHSLFTLLPSGKRYRSIRALTTRLCNSFFPQAIRLLNTQGPDRSLSHSHSI

SEQ ID NO: 3342 - protein, 1119 aa, synthetic construct
  source 1..1119: note = Description of Artificial Sequence: Synthetic polypeptide
MAKLIIFAVFACMVLPKVVTSFNRPIVCQYSIYISSSLLPSTYSSSYTLYNYLQHLCPPVTNKTRICRHFKSSSHIFSLFYLLLLAAGDISPNPGPCSIPTYIQPRFPANLRKSSRSSTFSNLIQIPTLPSSCLPFSCALLNTRSLTNKSTLIHDLFALIHLVFLHQKPGSHRMIPPLRLHSLMAVSLSLTPPEPLDVVGELEFSSRCRFKPIPIPPAFSFNSFEVHAIHIFHPLSVRVAVIYRPPSASSSAAFLSDFDTWLSFFLCTDSPAIILGDFNFHIDDASQPWPSRFLRLTSSFELQQWTNTPTHKDGHFLDLVFTKKLSLSGFNSEPFPLSDHNLVTFSISHSPCPPASSPTVLVRDTRDIDLPALAQSFRSSLISLKEMSDPDTLVSEYNHILSSTIGSFAPLQAKRTRALNPRPWLNSQTRFLRSCTRSAERMWKKSRTQADFIHYKFLLSCLNSALSKANKSTTVPLIHKPDSYAPVRDLLNVCGRNPVRKQTLFTINFYCPASILPCQKPTRVLQYPYKQSQIQPTTPVFSIQYFLHPSSTVSVNQTHSPQDFADFFKDKVESIRNQIPTSTNVNQLLLPKPPSACLNSFPPVTMSEVSKLLLSSPLTTCPLDPMPSSLLKHCVAELTPLLTHIFNSSLASGTFPSPFKQACVKPILKKATLDPACLSNYRPVSLLPLASKLLERIVFSRITNFLHTHDLLDPLQSGFRPGHSTETALCRVTNDLQVAKAKGHFSILLLLDLSSAFDTVDHSLLMQILYSLGIRNQAASWLSSYLSNRSFTVSYDNKTSSPVPLNVGVPQGSVLGPLLFSLYTLSLGDLIHSFGFNYHLYADDTQIYLSTPSLTAETEAQISNCLLAISNWMNQRHLKLNLTKTELIIFPPKPGPTPLFTISIDGMLINPVNSARCLGVIFDSSLSFSDHINTTVKTCHFFLRNIAKIRPFLSPDTSKTLMHALILSRLDYCNLLLTGLPNSHLSPLQSVLNTAARIILLSSKRVQAPPLLKSLSWLPIKQRITYKLLLITFKALHSSAPNYISSLVSLYVPARNLRSSQSNRLVVPPTTTAVSRIKPFSLATPYIWNAIPESLRRESSFNVFKTKLKDYLWEHLDNT

SEQ ID NO: 3343 - protein, 839 aa, synthetic construct
  source 1..839: note = Description of Artificial Sequence: Synthetic polypeptide
ILYIMTWMNENLHRHIATHFGENTLKLVREYERTARKLADYRNHLRFNLRCRYQGITPCSLRLGSSVKGHRAKVILQKAQKQLLNERVRQTNFSIEVLVHKFDNAKQRLTAKLPVLTLQRVVEFTERAQLAQHAKGKERQINKFTSLLSRTNNTQRTDKSTGRKEDENKTCQNIKDLWVKNLSDRELTEPEKDVLAKGLNFAVAPRYVPVVDFITATESSIHNNKIPVDEAENIRLKVSAALANAKAPPSNLSLQERRALTSLAKDSSVTILPADKGRCTVVLNTSDYHAKVSTLLNDSDTYEQLKRDPTSNYKKKVIDCLQHLEKEKVISPALYRRLYPGEATPCLYGLPKIHKEGAPLRPIVSSINCVTYNIAKYVANILAPLVGNTVHHIQNSMDFVKKVKELKLEIDDTMVSYDVTSLFTCIPTAEAIDTVRKRLKQDTTLSSRTKLTPEQVCSLLDLCLNTTYFKHKEVFYRQKHGCAMGSPVSPIVANLYMEEVEKKALDTFKGTTPSHWFRYVDDTWVKIKEREVPAFTKHINSVDKNITFTREDVKDSKLAFLDCAIVIKEGRDLDIEVYRKPTHTDQYLLFDSHHPLEHKLGVIRTLHHRAETVASNAEAKEKEYKHLKGALKTCGYPDWAFIKTKSKTNRKTRPTNRREEHSRRNNIVIPYVAGTSEKLRRIFNKHRIPVFFKPSNTLRQKLVHPKDPTPKHMKSNVVYAVQCSEECSDLYIGETKQPLCKRMAQHRRANSSGQDSAVYLHLKEKGHSFEDSNVHILDREDRWFERGVKEAIYASLEKPSLNRGGGLRHRLSPTYNGALTSLPRQFHNSSHFQSCTLKD

SEQ ID NO: 3344 - protein, 770 aa, synthetic construct
  source 1..770: note = Description of Artificial Sequence: Synthetic polypeptide
KGHRASNILQKAQKHLLNERVRQINFTIEALKQKIEQLKQSLTKQLPDVTLERVVQFIEHAQMAQHIKSKERQISKFTSLLSRSSGLKRTEELTWRQKDETSKNTKDTWVKNLSDRVLTQPEKDVLAKGLNYAVTPQHIPVVELITATESAINNNHIKVEEAEQLRLKVSAALSSARAPPSNLTTQERRALTSLSKDPNITILPADKGRCTVVLNTTDYHCKMTSLLSDSNTYEPLRRDPSSSYKKKVIDCLQQLEKEEAIDRALYHRLYPREATPCLYGLPKIHKDGAPLRPIVSSINSVTYSIAKYLANILAPLVGKTVHHIQNAKEFVTKIQGVKLEAEETMVSYDVTSLFTCIPTTEATETVRNRLQKDNTLSSRTKLSPNQVCLLLDLCLNTTYFKYKDQFYRQKHGCAMGSPVSPIVANLYMEEVERKALLTFNGTTPSHWFRYVDDTWVKIRSNEVAAFSEHINSVDNNIKFTREDVHENKLAFLDCLISIQEGGILKTEVYRKPTHTDQYLLFDSHHPLEHKLGVIRTLHHRAESVTTDTESKDKECKHLRGALKACGYPDWAFVKTRATKPNRNTKRNNRPEAERRRNIVIPYVAGVSEKLRRIFNKHHIPVFFKPSNTLRQKLVHPKDPTPKEKQSNVVYAVQCSEECTDLYIGETKQLLSKRMAQHRRANTTGQDSAVFLHLKDKGHSFENSNVQILDKEDRWFERGVKEAIHVKVEKPSLNRGGGLRHHLSATYNAVLTSVPRQFQNSSHIHSCNSNK

SEQ ID NO: 3345 - protein, 1067 aa, synthetic construct
  source 1..1067: note = Description of Artificial Sequence: Synthetic polypeptide
MSLLLLVLSFMFVLPKVTSSFSPPADCPYSITISSSLLHSTHCCSYNLYTFLKNLAPPTNTSQKHNNFKSFSHLLSLSLLLLLAAGDISPNPGPCRIPISYRPRNASLLVKPSQTANLSNLIQIPTLSSSYLPFSCALLNTRSVTNKAALIHDLFCSKSFHLFAITETWLSQNDNAIEAALSYGGLSFSHTPRITGRGGGVGVLLSPHCRFKLIPIPPTFRFPSFEVHAVQLFHPLSVRVAVVYRPPSSKSLATFLSDFESWLSFFLCSDTPAIILGDFNCHIDDPSQPWPSRFLHLTSSFDLRQWTNTATHKDGHFLDLVFSKNLDLSAFNSEPFPLSDHHLISFSISHVSPSPSTNAQPKTLIRNTQRVDITALSNSLSSSLSSFCASSDPELLVNTYNSILSSAINTHAPLQPQHSRAHNPRPWLNPQTRFLRSCARSAERIWRKSRVKADFLHYKFLMVCLNTALSQAKQVYYNTLVNNNKSNPRRLFSIFNALLHPSPNESIISEHTPQDFADFFKSKVDSIRKQFSQPSDTGNLNLPKSPLSVFSSFNLVTESEVSQLLRSSPPTTCSLDPMPSSLLKQCAPALTPALTHIFNSSLASGTFPSLFKQACVKPILKKATLDPSCLSNYRPVSLLPLASKLLERLVFSRVTNFLCTHNLLDPMQSGFRPAHSTETALCRVANDLQTAKAKGRYSVLILLDLSSAFDTVDHSVLMQILYSLGIRDQAASWFSSYLSNRSFSVALANKSSTPVPLSVGVPQGSVLGPLLFSLYTLSLGDLISSFGLKYHLYADDIQIYLDTPALTTDVQTQIGNCLLAISSWMNQRHLKLNLAKTELMVFPPKPGPSPPFTITIDGMTINPVNSARCLGVIFDQSLSFSNHINNTAKTCRFFLRNIAKIRPFLSQVTAKTLIHALILSRLDYCNLLLTGLPDSHLSPLQSILNSAARILLLSPKREPVQPHLSSLAWLPVKQRIAYKILLLTFKALHSSAPHYISSLVSLHVPGRLLRSSQSLRLFTPSTPTALSRLKPFYLAAPYLWNSIPESLRREHSPTLFKKKLSCYLLEH

SEQ ID NO: 3346 - protein, 1191 aa, synthetic construct
  source 1..1191: note = Description of Artificial Sequence: Synthetic polypeptide
MDPEKIIVWNVRGLNSLARQNSVRELLNCYGADIICLQETKMAQPSSRVLLSMLGSDFTGSLALPSNGSRGGILIAWRRHLGITGATRTDIHSISVQFCSVEGHQWWLTCVYGPQSNEAKIEFLQELRHIRAACQGPWMITGDFNLILHAEDKNNSHINRAMMGRFKKLVDDLALKEIPLHGRKFTWSNQQNQPTLVKLDRVLCSIDWEELFPGAVLQSAASEDSDHCPLLLGFKDCKGVKRRFHFESFWTKIEGFHEVVHNAWNSVPVGHCPFSTFDLKLKGTAKALQGWSSKKVGHIETQLHLARDLIHQLEIAQDGRILSVLERWLLSKLKKLALALASTKRTIARLRSRISWLKEGDANSKLFHSFARYRKKKNSVSKLTVGNQVLTAHSDIAAAVDQFYFDLIGASKDRNISINLEALETAGTPFPNLIELDSPITEQEVCNAINSLPSDKSPGPDGFTGRFYKICWSIIKEDLMAAVIAIWNRKFDNFHKLNSAFITLIPKKDNADQVKDFRPISLVHSFAKLITKILASRLASRLNDLVSPNQNAFIKGRFIQDNFMLVQQTAKLLHQQRHPCLMLKLDITKAFDSVSWPFLIEVMQNLGFGQIWRDIISGLLLTSSTRVLVNGHPGSIISHRRGLRQGDPLSPMLFVLVMDVLGQLVSKADEEGLLQPLSTRQLQHRVSLYADDVVLFINPVAEDMTMISDILQLFGEASGLYNNNQKSSVYPIRCHEDNLEIIQQFWPCEISSFPCKYLGLPLSLHKLRREQVQPIVDKIANQLPGWKADLLTKAGRSVLVQSVLTGVLIYSVMAVDLPSTTLKDIDKIRRGFLWRGRKNAMGGHCAVAWGSVCRPRELGGLGIFSITELSWALKMRWAWLQKTEPGRPWASLPLHTPKKIREFLQVALYSEIGNGASTLFWSDRWLDGQRIGDIAPRLIETIPMKLINKRTVQEAIEDNGWINDIPGSLSVGALADFLRIWDLVAHVDLDPHKEDKHIFRLAANGKYSTKAAYEGLFIGSVEFEPFERIWKTWAPPKCRFFLWLVAHKKCWTADRLEKRGLDHPEKCPLCEQERETIDHLLVNCVFSRECWFLLLRQFGLQGLAPQPTDINFMEWWHQANEAIQGSFRDGLNSLIMLGAWILWNHRNRCIFDGLSPNVANFLIHVGDERRLWETAGAKGLTSLVASLSHVA

SEQ ID NO: 3347 - protein, 838 aa, synthetic construct
  source 1..838: note = Description of Artificial Sequence: Synthetic polypeptide
MPLSESEKRKFWEDLDGMVRAVPTNEKLFIGGDLNGHVGSTNVGYELAHGGFGYGSRNQGEDILDFAVAYNLVIANTFFRKRDSHLVTFSSGHRSSQIDFVLTRREDKQACLDCKVIPGESVVPQHNLVVADFRFRIRTHRDKQAKIARTKWWKLKGETSEVFRERVFVEGAWSEEEDANNMWVKMATCIRKVASEVFGVTKGSIGEPKDTWWWTEDVQKAIKEKKECYRSLFHDRSAVNIERYKVAKKTAKRAVSEAKGRAYDDLYRRLSTKEGEKDVYKMARIRERKTRDLNQVKCIKDEMDQLLVKGQDIKQRWQRYFDNLFNGENETMDTQLDDSFDDLNRCFVRRIQESEVKEALKRMKGGKAMGPDGIPIEVWKCLGDIAIVWLTKLFNHIFRSNKMPDEWRRSTLVPIFKNKGDIQSCTNYRGIKLMSHTMKLWERVIEHRLRGMTHITMNQFGFMPGRSTMEAIFLIRQVMERYKEQKKDLHMVFIDLEKAYDKIPRNLMWWALDKHKVPTKYVTLIKDMYDKVVTSVRTTDGDTNVFPINIGLHQGSALSPYLFALVIDEVTRDIQGDIPWCMLFADDVVLVDESREGVNRKLELWRQTLESKGFRISRTKTEYMRCDFGTTISEDGDVSLGGQVVPKKDTFRYLGSMLQRDGDIDEDVSHRIKAGWMKWRQASGVLCDKRVPQKLKGKFYRTTIRPAMLYGAECWPTKRRHIQQLSVAEMRMLRWICGHTRLDRVRNDDIRDRLGVAPIEEKLIQHRLRWFGHVHRRPPEAPVHRGIIRRDNNVKRGRGRPNLTWEEAIKRDLKEWNIPMELCLDRSAWKEAIHVPEP

SEQ ID NO: 3348 - protein, 957 aa, synthetic construct
  source 1..957: note = Description of Artificial Sequence: Synthetic polypeptide
MTIVWQEGAGFILSPFGLSLRDFWRLFRWPGILFQLCSVLLQRLNSKLKATARGLQAWSAKKVGHISASLALARVLLHQLEIAQDSRGLSPAELWFLLCLKKHSLALSSLQRTIARLRSRIGWLREGDANTKLFHMHSRFRKKKNFVPKLVSNGAVLTSHDAKADLVNEFYGNLLGQCSDREQTISLESLGIPCHDLSALDAPFTEKEVWDTILHLPSDKAPGPDGFTGKFYRVCWEIIKADVMAVFSAVGSRRFANFQILNTAYITLIPKFEGADQVKNFRPISLVHSVAKLLTKLLANRLAGRLHDMVSPNQSAFIKGRFIQDNYMLVQQTTRYLHQQKQPRMLLKLDISKAFDSVSWPFLLEVLQHLGFGQVWRDIISGLLWTSSSQVLLNGLPGQPILHRRGLRQGDPLSPFLFILVMDTLGFLINKAAQDGLLQPLAPRALQHRVSLYADDVVIFLRPAAMDINVILDCLQLFGDASGLRTNVQKSSVYPIRCGDQDLALLQNMLPCELAEFPCRYLGLPLAIKKLSKIQVQPIIDKIANQLSGWKAELLTKAGRKVHVQHVLTGMVIYLAMAVDLPAWALKAIDKIRRGFLWRGRRDVKGGHCHVAWGIVCRPRELGGLGISSMKELAWSLRMRWLWLAKTEPSRPWASLAIQVPKKVKDFFSMAMQTELGNGATTFFWTDRWLSGHRIAELVPRLFGIIPKRRVSKRTVVDAISNQSWISDIQGALSVGIINEFLILWDLIDSIVLRPQVEDKHFFRLAANGKFSSKEAYRGFFLGSSEFEPFHRIWKSWAPPKTKFFMWLVAHRKVWTADRLQKRGMDHPERCPLCDQDQETLDHMLIGCVFAREFWFKLLLQVNLQFLAPQSEDSAFLEWWRTLCTKVSGIARDGLNSLVILGVWTLWKQRNGCVFDNKSPSIADAIRRVELEVHLWEMAGAKKLSLLTAPIPGIPAS

SEQ ID NO: 3349 - protein, 801 aa, synthetic construct
  source 1..801: note = Description of Artificial Sequence: Synthetic polypeptide
  VARIANT 526: note = Any amino acid
  VARIANT 619: note = Any amino acid
  VARIANT 795: note = Any amino acid
MAKKKRRKAPWAEAPSSPRAPAPVAHGPGGVRSGLVGLPSTVGFAAQGKCAPAPFASSVSWTGWSQGISPLAPTLAHSSRVLLPAATSDAAVSKSRLGFPPDFVGSHSFPHCAAFLSRLWSLPVSSRSDFHGGWCVTSLRPPVPEEEWPRLGSGVVRSSKNLGEMDPKNKNIPNPSWDRWGQKDSAQGSQSWNRNRNLSWRLKPQIGKSDPQEGLMSSSSGDGIQSGNPILSPSSLKKEIDLARPAFCQKCGVEGHHARNCFNALWCDICRKDTHVTARCVLPKQSKPNMPIVGMAADGLGFYLSHFAKPISKKPKRVFIGLVKVIEGLVSAEDLAKDFGFHFPWGKTWKATKCHSGFLMQFPSQERLDEMISFPELKMKMSGAKIVVVPWSSRAKPKSRLHTAWIVAENVPEELQNYQSICEIGSMIGAVEEVDLMSLDSEDIVRFKVHIKSVAMIPPVVEVAVKPFLYDIYFRIESISDEGWNDETINLGKRASVDIHGINDPVFDKSGKKPRNDDEVGDEDPXPNFKVGESSSQGKESFKKSEVFMDSSKDKSGDGMRLEDLSDEKVDFDPNEDDLLSSQELEEFAKDMEEMHTDFQAKVGEVLSIPLTKDEKQDXVGKKSSEILMSTSEGIRKSSRLEKNEDIKVADKAISRAEAKDAFLNKGMNNNPFSLLNASNEDLFDISNKLGVCLGSSDSSAMANLDLIRDLEMSRKILAIQSCGSKKNEEPIVDDINEVDSSVHADSEKDIDYDLLDVMVLRKGRKIKHRKKQQKKASPKIRYTPNKKREAENFXLPPDPF

SEQ ID NO: 3350 - DNA, 25 bp, synthetic construct
  source 1..25: mol_type = other DNA; note = Description of Artificial Sequence: Synthetic oligonucleotide
ccacaaggccctggcagggcttaaa

SEQ ID NO: 3351 - DNA, 30 bp, synthetic construct
  source 1..30: mol_type = other DNA; note = Description of Artificial Sequence: Synthetic oligonucleotide
gtgtgagtttctgccagagccattctatga

SEQ ID NO: 3352 - DNA, 35 bp, synthetic construct
  source 1..35: mol_type = other DNA; note = Description of Artificial Sequence: Synthetic oligonucleotide
tacaaggctttgttgttgttgttgttgtttttttt

SEQ ID NO: 3353 - DNA, 38 bp, synthetic construct
  source 1..38: mol_type = other DNA; note = Description of Artificial Sequence: Synthetic oligonucleotide
ggttcaacgggccgggcccggtaataataataataaaa

SEQ ID NO: 3354 - DNA, 22 bp, synthetic construct
  source 1..22: mol_type = other DNA; note = Description of Artificial Sequence: Synthetic oligonucleotide
tgagcacggtagcattagtcga

SEQ ID NO: 3355 - DNA, 78 bp, synthetic construct
  source 1..78: mol_type = other DNA; note = Description of Artificial Sequence: Synthetic oligonucleotide
aaataataataataataataataataataataataataataataatcaataaaaataataataatattattattataa

SEQ ID NO: 3356 - DNA, 27 bp, synthetic construct
  source 1..27: mol_type = other DNA; note = Description of Artificial Sequence: Synthetic oligonucleotide
taataataataataatataataataat

SEQ ID NO: 3357 - DNA, 200 bp, synthetic construct
  source 1..200: mol_type = other DNA; note = Description of Artificial Sequence: Synthetic polynucleotide
atgcggaatcagggatgaccatggattctttggctgtgggtagagtcctttctaacccagcgaaggataagggtgcggtaccgtaatggaacgacgcgggtcaaatcaaatcaaatcaaatcaaatcaaatcaaatcaaatcaaatcaaatcaaatcaaatcaaatcaaatcaaatcaaatcaaatcaaatcaaatcaaa

SEQ ID NO: 3358 - DNA, 28 bp, synthetic construct
  source 1..28: mol_type = other DNA; note = Description of Artificial Sequence: Synthetic oligonucleotide
ctaacctccgcaggggtggtggaataaa

SEQ ID NO: 3359 - DNA, 105 bp, synthetic construct
  source 1..105: mol_type = other DNA; note = Description of Artificial Sequence: Synthetic polynucleotide
ctgaggccttattattgtctcctccggttgaggctgtcatgtctactactgctatgttgggggccatggctccgggccctgagcatatccagggtcccttaagtg

SEQ ID NO: 3360 - protein, 1221 aa, synthetic construct
  source 1..1221: note = Description of Artificial Sequence: Synthetic polypeptide
MKANPAMETRSMRNRRMRSPEEGAPTGAGPGTGDRASGQRLEEDNVQERPSSQRAQPVPRTRNRNGSSRNHQGHAAPTDVAVADRRQSLTLAGGRRQRIMWTREMNMYVIRCYYVCTRMETDMSGRSGMLEMFNERFPRFARQLDLNKLYTRQRAIMSHNMLTAAEVEYIKLEVQREIGEEGTRSSDTSRRSSVGLDAPITSESRDSPAPTAPGPTADMQRQQLRDELALHMGTAVTQFRGTDPMSRHRIPKLRYSYRLTSAVSILNQDILPQYLEAVENLEDLQFIVYSAAIAVVKTLGLRTRPQGEDGTRPNAQKPVWMRRLESRIATLRSKVGRLTQYKQGNRSTRLVRHVAEIVRPAELRDLREVDITEILDTHVQRLSALAKRLRRYGECSKRKEQNRMFNINEREFYNRIRNDKVDFGEGLPEIGDVTQFWANLWENPTEHDGDGMWLAEEERQCDGIGDMTAVVVTAQDIREATRYTRNWAAPGPDFVHNFWYKKLTTIHGRMAECFNTVLGDPTQLPEFITRGVTFLLPKDQHTADPAKYRPITCLSSLYKVLSSVIARRVQAHCDANNVMTEEQKGCRRNTQGCKDQVIVDAVIVGQATQKQRNLSMAYIDYKKAYDSVPHSYLLKVLQLYKVDGNVIRLMQHAMGMWSTSLHITDGTAVLRSRTLSIRRGIFQGDTFSPLWFCLAMNPLSKALNQCNYGYQLKSGERSTRVTHTFYMDDLKLFAESVQRLHQLLQLVTTFSNDIRMEFGIDKCRSIHLRRGQVMDASCFRVNEQEEIRNMVEGETYKYLGFLQLRGIRHTMIKKELQEKFLSRVNCILKSFLSAGNKVKAINTFAVPLLTYSFGVVKWTKTDLEAIERAVRVAFTKHRMRHPKSSIERVTLPRAAGGRGVTDIQALCVSQIQQLRAYFVESQNRHEIYRTVCEADHGFSALHLAQEDYQLNCDIKTVDEMIAMWKQKELHGTHPHQLELEHIDKVASNTWLVRGDLFSETEGFMVAIQDRVIATKNYRHYILHEDVEDRCRKCNSVGETIEHVVAGCSVLAGSAYLDRHNEVAKIVHQQLALKHNLVDRFVPYYKYLPDPVLENSCIKLYWDREIITDVLIRANRPDIVVYDKRMKRVTLIDIAVPLDHNVQSTFSNKIAKYHDLAEELKQMWHLEDVRIVPVVLSATGIVPKSLLRSLDELELKKDLHSIQKAVILGTCSIVRRFLNHHN

SEQ ID NO: 3361 - protein, 965 aa, synthetic construct
  source 1..965: note = Description of Artificial Sequence: Synthetic polypeptide
MCFLIPVVTNTRKTREVRCRRNPHNLRSIHVSTISQLSLSVGLWNCQSAVNKADFITSIATYSDYNLMALTETWLRPEDTATHATLSANFSFSHTPRQTGRGGGTGLLISKEWKFTLIPSLPTISSFEFHAVTIIHPFYINVVVIYRPPGKLGHFLDELDVLLSSFSNFATPLLVLGDFNIYVDKPQAADFQTLLASFDLKRAPTSATHKSGNQLDLIYTRHCFTDQTIVTPLQISDHFLLSLNIHITPEPPHTPTLVTFRRNLRSLSPNRLSTIVSDSLPPSRKLTALDSNSATNTLCSTLASCLDRLCPLASRPARASPPAPWLSDALREHRSKLRAAERIWRKTKNPAHLLTYQTLLSSFSAEVTSAKQTYYRLKINNATNPRLLFKTFSSLLYPPPPPASSTLTTDDFATFFCTKTAKISAQFAAPTTNTQDTTPTPHTLTSFSQLSESEVSKLVLSSHATTCPLDPIPSHLLQAISPAVIPTLTHIINTSLDSGLFPTTFKQARVTPLLKKPNLDHTLLENYRPVSLLPFMAKILEKVVFNQVLDFLTQNNLMDNKQSGFKKGHSTETALLSVVEDLRLAKADSKSSVLILLDLSAAFDTVNHQILLSTLESLGVAGTVIQWFRSYLSDRSFRVSWRGEVSNLQHLNTGVPQGSVLGPLLFSIYTSSLGPVIQRHGFSYHCYADDTQLYLSFHPDDPSVPARISACLLDISHWMKDHHLQLNLAKTEMLVVSANPTLHHNFSIQMDGATITASKMVKSLGVTIDDQLNFSDHISRTARSCRFALYNIRKIRPFLSEHAAQLLVQALVLSKLDYCNSLLAGLPANSIKPLQLLQNAAARVVFNEPKRAHVTPLLVRLHWLPVAARIKFKALMFAYKVTSGLAPSYLLSLLQIYVPSRNLRSVNERRLVVPSQRGKKSLSRTLTLNLPSWWNELPNCIRTAESLAIFKKRLKTQLFSLHFTS

SEQ ID NO: 3362 - protein, 1137 aa, synthetic construct
  source 1..1137: note = Description of Artificial Sequence: Synthetic polypeptide
MENQTQTKSILARSSPRIKRTAVDAADSGHPSTSGLRNHQNPNEQSQKRQKYTMPENRTIMKCYYKSEPQRRGYQKRMHQLWKQEYPDSQITEPRLADQRRFIIRNKVFSEVELEEIQKICKVDYHQTTAQTAAETPATLGMVEQIEPEESVALLQEFEEPALETSVEPPGTLTARQQELKDKIMAHAAANAIRQRLPTLKTVPKRHLAPLMKDVNAALSTVQITSIEQTNQFAYSAAVIVTEELGLLQPRQPQRKSTGKPKWKVRLELKIKKLRSDASNLKNMKERKLKNDKIKQYLIRKYWLNTRKIEEALEIVKEQITATARKIERYEARIIQYRQNQLFQSDQRRFYQSLNQTTDTVTIKPEKTATTKFWKELWENNKNYNKNAGWIKEFEGKFSQNKMELMEITTEMISKRVQKVKNWTSPGSDQLHGFWLKHLISLHGKMAQQFNEMLQKGSISEWLTTGRTYLIQKDPAKGAAPGNYRPITCLPTMFKLLTGIIADRIQDYLEEKNILPDEQKGNKRKSRGTKDQLLIDKMILENCKSRKANLHMTWIDYKKAFDSLPHSWIIKCLDAIGICKTVGTFIENMMEHWKTELFVGNESYGLVNIRRGIFQGDSLSPLLFIIAMIPLSTILQKTNLGYQISKNSHKISHLMYMDDLKLYGKTETEIQSLTNTVRIFSTDINMEFGLDKCSTVALKKGKIIESEGINMPNGQTIKCHQPEAYKYLGILQLDNIKHEHVKTVVSKEYTQRVRKILKSKLNGGNTIKAINTWAIPVIRYTAGIINWTQVELDNLDRKTRKLMTIHHSLHPRSDVDRLYLPRRSGGRGLLQVKQAVKEEEHALAEYVKQSEEPALIEVKNQKLLKTQQTKNQYKKTALQTRADSWHNKTLHGKFLDKIEGKADKEKTWLWLTNGTLKKETEGLILAAQEQAIRTNAIKAKIEKSADDPKCRLCKETDETIDHILSCCKKIAQTDYKQRHNYVAQMIHWNLCLKYHLPAAKNWWDHKPAKVLENEHAKILWDFRIQTDKVLEHNTPDITVVEKNKVWIIDVAIPGDSRIDEKQQEKLSRYQDLKIELQRLWQKPVQVVPVVMGTLGAVPKDLSRHLETIDIDKITICQLQKATLLGSAHIIRKYITQS

SEQ ID NO: 3363 - protein, 719 aa, synthetic construct
  source 1..719: note = Description of Artificial Sequence: Synthetic polypeptide
MPIKMVRPRRLMDPNGFLMALGDVPASSVGDSVDALVTLYNGEMARAIDTIAPERPLAMRRAKLAPWFSGELAAMKRETRRLERVWRKRRSESNLERVKAQRKTYCKAMAAVKKTYYSSRIEAAKNRPAELFRTVRGLLNNTPQTAPTDDVAEKCEAFSQFFSKKIALIRSELDATVDAISEDVARAPACPILMDSFQSVQPEDVDKVLGEARATTCILDPCPSWLVKEARGGLVEWVRVVVNASLREGRLPAGLKQAVIKPLLKKPSLDPTNWNNFRPVSNLPFLGKVVERVVASQLQGFLEATDYLDPAQSGFRPGHGTETALVSLVDDLRRELDRGSVSLLVLLDLSAAFDTVDHGILLGRLVGMGLGGTALQWLQSFLEDRTQKVLIGDSCSAPQPLSCGVPQGSVLSPLLFNIYMKPLGEIIRSFGVRCHLYADDVQLYHSFSPASKEAVQILNRCLAAVSDWMRANKLKLNPDKTEVLLVSRKAEQGIGLQPVLDGVALPLKAQVRSLGVLLDSSLSLEPQVSAVARGAFAQLKLVRQLRPYLGKPDMATVVHALVTSRLDYCNALYVGLPSKTVRKLELVQRSAARLLTGAPYREHTTPLLKQLHWLPVSFRAQFKVLALAYKTLNGSGPTYLSERISPYEPPRRLRSSSEALLSVPPPSQVHLAGTRDRAFSVVAPRLWNSLPREIREAPSLMSFRKQLKTWMWDQAFGPS

SEQ ID NO: 3364 - protein, 1189 aa, synthetic construct
  source 1..1189: note = Description of Artificial Sequence: Synthetic polypeptide
MNLSNILVWNARGLNNKARRDYVRDTILSSKADIICLQETKVASFSSHLLLSVCGSDFDKFLTLPAVGTRGGILIAWKGAVCQVISSRIDNFSVSVQFAGMDGMNWWFTGVYGPQEDDRKIQFLQELLDFRTLCSGPWLLSGDFNMIYQAADKNNANLNRALMGRFRRFLDDCLLKEIPLHGRKFTWSNERSSPTLVRLDRVFCCNDWEDFFPNSLLQSASSGVSDHCPLILSLNVQTHKKRRFHFESYWPKLPGFLEAVSHSWNAPVSIACPVEGIFLKLQRLSKGLQKWSHHKVGNVKLQLATAKEILHRLEIARDNRVLSPGEEWLRKKLKLHCLGLASLERTIARLRSRILYLQEGDANTSFFHQQARYRKKKNFIAKFQVEERIVTSQEEKQQAALDFYDNLLGTAEHRDYTLDLHSLGIQQHDLGDLELVFSMEEVWSVVKDLPLDKAPGPDGFTGRFYKVCWDIIKEDMMGALLAVQCGHVSKLKLLNTTFITLLPKKVDALLVKDYRPISLVHSFAKLVTKVLAARLAPHLPSMVSINQSAFIKGRSIQDNFLLVQQLTRSLHHSKEPHILLKLDISKAFDSISWPFLLDMLQHLGFGRSWCNLISLLLCTSSTRILVNGEPGEYILHHRGLRQGDPLSPMLFILVMEALNAMVSYAFREHMLQPIANQHAKHCISFYADDVVLFMRPSHQDISAIISILDIFGHATGLKTNISKSSVTPIQCGANELTTISALLPCATKNFPCTYLGIPLSIRRLANSDLLPLVDKVADKLPGWKANLLSRAGRLVMVKTVLSSVPIYLMLALELPKWVFKAIDKRRRGFLWKGQGDANGGNCLVSWEAVQRPLKYGGLGILNLEMFGWALRARWLWLQKTDASRPWAGLPIRVHRNAKALVDVAITSVVGSGESVKFWSDRWLLGKTVAEHCPTLIQVISRRALKRRTVAEGLTNRQWVSDIRGGLSVTVLVEYLQLWNLVDGVVLQPDIADQHIWRLSAHGTYCSKSAYDALFVGSIPFGPWRRVWKTWAPLRCKFFVWLAIKNRVWTADRLAKRGLPHPVACPLCDQAEETIQHILVSCVFARQIWTSMLHNLGLLAIVPQHGCTRFSNWWCQSIKKVEKSLRKGLNSLIILVAWEIWKHRNACVFEGVVPCTQRVQSAVIEEGNVWCLAGASALQDLLLRQLPRGP

SEQ ID NO: 3365 - DNA, 100 bp, synthetic construct
  source 1..100: mol_type = other DNA; note = Description of Artificial Sequence: Synthetic polynucleotide
agtagactgcagccccaggccctttccatctgggtgtgactcagcacttcctaggaaggaccatctataaagcctgagtccacaaggccctggcagggct

SEQ ID NO: 3366 - DNA, 100 bp, synthetic construct
  source 1..100: mol_type = other DNA; note = Description of Artificial Sequence: Synthetic polynucleotide
ccacggcacctggcccagtgttttttaatacaaattatagcctatggatcccactgaggacctctgtttgtgagactgggtgtgagttgctgtcagagcc

SEQ ID NO: 3367 - DNA, 29 bp, synthetic construct
  source 1..29: mol_type = other DNA; note = Description of Artificial Sequence: Synthetic oligonucleotide
aaggatggggttcaacgggccgggcccgg

SEQ ID NO: 3368 - DNA, 100 bp, synthetic construct
  source 1..100: mol_type = other DNA; note = Description of Artificial Sequence: Synthetic polynucleotide
gtttcgcgtcgtccgcctcagtttcggcccttgttttgactcgggaggcgtgtccaaacgccaggtaaccactatatagtgagcacggtagcattagtcg

SEQ ID NO: 3369 - DNA, 32 bp, synthetic construct
  source 1..32: mol_type = other DNA; note = Description of Artificial Sequence: Synthetic oligonucleotide
caataaaaataataataatattattattataa

SEQ ID NO: 3370 - DNA, 17 bp, synthetic construct
  source 1..17: mol_type = other DNA; note = Description of Artificial Sequence: Synthetic oligonucleotide
taataataataataata

SEQ ID NO: 3371 - DNA, 100 bp, synthetic construct
  source 1..100: mol_type = other DNA; note = Description of Artificial Sequence: Synthetic polynucleotide
atgcggaatcagggatgaccatggattctttggctgtgggtagagtcctttctaacccagcgaaggataagggtgcggtaccgtaatggaacgacgcggg

SEQ ID NO: 3372 - DNA, 23 bp, synthetic construct
  source 1..23: mol_type = other DNA; note = Description of Artificial Sequence: Synthetic oligonucleotide
ctaacctccgcaggggtggtgga

SEQ ID NO: 3373 - DNA, 100 bp, synthetic construct
  source 1..100: mol_type = other DNA; note = Description of Artificial Sequence: Synthetic polynucleotide
attctgcaaacctccagtgaggggaaggttgagggcagtggttggtgctcacggtggtgctgctcaaaactgacaggcagacacccggcctccagcttgc

SEQ ID NO: 3374 - DNA, 33 bp, synthetic construct
  source 1..33: mol_type = other DNA; note = Description of Artificial Sequence: Synthetic oligonucleotide
caaggctttgttgttgttgttgttgtttttttt

SEQ ID NO: 3375 - DNA, 17 bp, synthetic construct
  source 1..17: mol_type = other DNA; note = Description of Artificial Sequence: Synthetic oligonucleotide
taataataataataaaa

SEQ ID NO: 3376 - RNA, 100 nt, synthetic construct
  source 1..100: mol_type = other RNA; note = Description of Artificial Sequence: Synthetic oligonucleotide
  misc_difference 1..100: note = This region may encompass 5, 10, 20, 30, 50, 70, or 100 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3377 - protein, 4 aa, synthetic construct
  source 1..4: note = Description of Artificial Sequence: Synthetic oligonucleotide
DEAD

What is claimed is:

1. A system for modifying DNA, comprising:
   (a) a polypeptide or a nucleic acid encoding the polypeptide, wherein the polypeptide comprises (i) a reverse transcriptase domain and (ii) an endonuclease domain, wherein the polypeptide comprises an amino acid sequence at least 95% identical to the sequence of SEQ ID NO: 1947; and
   (b) a template RNA comprising:
      (i) a 5' UTR sequence that binds the polypeptide,
      (ii) a 3' UTR sequence that binds the polypeptide, and
      (iii) a heterologous object sequence.

2. The system of claim 1, wherein the 5' UTR comprises a sequence according to SEQ ID NO: 1945, or a sequence with at least 95% identity thereto.

3. The system of claim 1, wherein the 5' UTR comprises a sequence according to SEQ ID NO: 1945.

4. The system of claim 1, wherein the 3' UTR comprises a sequence according to SEQ ID NO: 1946, or a sequence with at least 95% identity thereto.

5. The system of claim 1, wherein the 3' UTR comprises a sequence according to SEQ ID NO: 1946.

6. The system of claim 1, wherein the heterologous object sequence encodes a therapeutic polypeptide or a human polypeptide, or a fragment or variant thereof.

7. The system of claim 1, wherein the heterologous object sequence encodes a chimeric antigen receptor (CAR).

8. The system of claim 1, wherein the heterologous object sequence comprises a regulatory sequence.

9. The system of claim 8, wherein the regulatory sequence:
   (a) is a promoter;
   (b) is an enhancer;
   (c) is a binding site for an endogenous regulatory component;
   (d) is a miRNA binding site; or
   (e) alters the expression of an endogenous gene or non-coding RNA.

10. The system of claim 1, wherein the polypeptide comprises a nuclear localization signal (NLS).

11. The system of claim 10, wherein the NLS is fused to the N-terminus of the polypeptide.

12. The system of claim 10, wherein the NLS is fused to the C-terminus of the polypeptide.

13. The system of claim 10, wherein the NLS sequence comprises an amino acid sequence of PKKKRKV (SEQ ID NO: 2409).

14. The system of claim 1, wherein the polypeptide comprises a linker having an amino acid sequence of SGSETPGTSESATPES (SEQ ID NO: 1023).

15. The system of claim 14, wherein the linker is disposed between an NLS and the remainder of the polypeptide.

16. The system of claim 1, wherein the template RNA comprises:
   (a) a polyA site;
   (b) a regulatory element of Woodchuck Hepatitis Virus (WPRE); and/or
   (c) a Kozak sequence.

17. The system of claim 1, wherein the nucleic acid encoding the polypeptide and the template RNA are two separate nucleic acids.

18. The system of claim 1, wherein (a) comprises RNA encoding the polypeptide and wherein (b) comprises template RNA.

19. The system of claim 1, wherein the nucleic acid encoding the polypeptide comprises a coding sequence that is codon-optimized for expression in human cells.

20. The system of claim 1, which is capable of inducing an insertion, deletion, or alteration of a protein coding sequence to a genome of a mammalian cell.

21. The system of claim 20, wherein the insertion is at least 45, 50, 55, 60, 65, 70, 75, 80, 85, 90, 95, or 100 nucleotides in length.

22. The system of claim 1, which is capable of inducing an insertion, deletion, or alteration of a non-coding sequence to a genome of a mammalian cell.

23. The system of claim 22, wherein the insertion is at least 45, 50, 55, 60, 65, 70, 75, 80, 85, 90, 95, or 100 nucleotides in length.

24. A method of modifying a target DNA strand in a cell, tissue, or subject, the method comprising administering the system of claim 1 to the cell, tissue, or subject, wherein the system reverse transcribes the template RNA sequence into the target DNA strand, thereby modifying the target DNA strand.

25. The method of claim 24, wherein the cell is:
   (a) a human cell;
   (b) a primary cell; and/or
   (c) a T cell.

26. A lipid nanoparticle (LNP) comprising the system of claim 1.

* * * * *